US010975440B2

(12) United States Patent
Chenchik et al.

(10) Patent No.: US 10,975,440 B2
(45) Date of Patent: Apr. 13, 2021

(54) EXPERIMENTALLY VALIDATED SETS OF GENE SPECIFIC PRIMERS FOR USE IN MULTIPLEX APPLICATIONS

(71) Applicant: Cellecta, Inc., Mountain View, CA (US)

(72) Inventors: Alex Chenchik, Redwood City, CA (US); Costa Frangou, Sunnyvale, CA (US); Mikhail Makhanov, San Francisco, CA (US)

(73) Assignee: Cellecta, Inc., Mountain View, CA (US)

( * ) Notice: Subject to any disclaimer, the term of this patent is extended or adjusted under 35 U.S.C. 154(b) by 268 days.

(21) Appl. No.: 15/133,184

(22) Filed: Apr. 19, 2016

(65) Prior Publication Data

US 2016/0376664 A1 Dec. 29, 2016

Related U.S. Application Data

(60) Provisional application No. 62/150,166, filed on Apr. 20, 2015.

(51) Int. Cl.

*C12Q 1/6886* (2018.01)
*C12Q 1/6806* (2018.01)
*B01J 19/00* (2006.01)

(52) U.S. Cl.

CPC ........ *C12Q 1/6886* (2013.01); *B01J 19/0046* (2013.01); *C12Q 1/6806* (2013.01); *B01J 2219/00599* (2013.01); *B01J 2219/00722* (2013.01); *C12Q 2600/106* (2013.01); *C12Q 2600/112* (2013.01); *C12Q 2600/156* (2013.01); *C12Q 2600/158* (2013.01); *C12Q 2600/16* (2013.01)

(58) Field of Classification Search

CPC ............ C12Q 1/6806; C12Q 2525/155; C12Q 2525/161; C12Q 2525/191; C12Q 2525/197; C12Q 2535/122; C12Q 2537/143; C12Q 1/6886; C12Q 2600/106; C12Q 2600/112; C12Q 2600/156; C12Q 2600/158; C12Q 2600/16; B01J 19/0046; B01J 2219/00599; B01J 2219/00722

See application file for complete search history.

(56) References Cited

U.S. PATENT DOCUMENTS

| | | | | |
|---|---|---|---|---|
| 5,565,340 A * | 10/1996 | Chenchik | ............. | C12Q 1/6848 435/15 |
| 5,994,076 A * | 11/1999 | Chenchik | ............. | C12Q 1/6876 435/6.16 |
| 6,207,372 B1 | 3/2001 | Shuber | | |
| 8,323,897 B2 * | 12/2012 | Andersen | ............. | C12Q 1/6827 435/6.12 |
| 2003/0082758 A1 | 5/2003 | Rosen et al. | | |
| 2003/0186246 A1 * | 10/2003 | Willey | ................. | C12Q 1/6809 435/6.12 |
| 2006/0121452 A1 * | 6/2006 | Dhallan | ............... | C12Q 1/6827 435/5 |
| 2008/0050393 A1 | 2/2008 | Tang et al. | | |
| 2013/0123120 A1 * | 5/2013 | Zimmermann | ........ | C12Q 1/686 506/8 |
| 2013/0244897 A1 | 9/2013 | Lueking et al. | | |
| 2015/0038343 A1 | 2/2015 | Leamon et al. | | |
| 2015/0259734 A1 * | 9/2015 | Asbury | .................. | C12Q 1/686 506/4 |

FOREIGN PATENT DOCUMENTS

| | | |
|---|---|---|
| WO | WO2004051218 A2 | 6/2004 |
| WO | WO2008069906 A2 | 6/2008 |
| WO | WO2011014811 A1 | 2/2011 |
| WO | WO2013081864 A1 | 6/2013 |
| WO | WO2013128281 A1 | 9/2013 |

OTHER PUBLICATIONS

Mertes et al., "Targeted enrichment of genomic DNA regions for next-generation sequencing," Briefings in Functional Genomics, vol. 10, No. 6, pp. 374-386. (Year: 2011).*

Shen et al., "MPprimer: a program for reliable multiplex PCR primer design," BMC Bioinformatics, vol. 11, No. 143, pp. 1-7. (Year: 2010).*

Assay ID No. Hs00176369_m1, retrieved on-line from www.thermofisher.com; retrieved on May 20, 2020. (Year: 2020).*

Assay ID No. Hs00173565_m1, retrieved on-line from www.thermofisher.com; retrieved on May 20, 2020. (Year: 2020).*

Myllykangas et al., Chapter 2 Overview of Sequencing Technology Platforms, Bioinformatics for High Throughput Sequencing (2012), 11-25.

Clarke et al., Modular tagging of amplicons using a single PCR for high-throughput sequencing, Molecular Ecology Resources (2014), 14:117-121.

Parkinson et al., Preparation of high-quality next-generation sequencing libraries from pictogram quantities of target DNA, Genome Research (2012), 22:125-133.

(Continued)

*Primary Examiner* — Young J Kim

(74) *Attorney, Agent, or Firm* — Mandar A. Joshi; Bret E. Field; Bozicevic, Field & Francis LLP

(57) ABSTRACT

Sets of experimentally validated gene specific primer pairs are provided. Embodiments of the sets include 10 or more gene specific primer pairs of forward and reverse primers. The forward and reverse primers of each primer pair include gene specific primers that are experimentally validated as suitable for use in a multiplex amplification assay. In some instances, each of the forward and reverse primers includes an anchor domain that includes a universal primer binding site. The sets find use in a variety of different applications, including high-throughput sequencing applications.

13 Claims, 101 Drawing Sheets

Specification includes a Sequence Listing.

(56) References Cited

OTHER PUBLICATIONS

Head et al., Library construction for next-generation sequencing: Overviews and challenges, BioTechniques (2014) 56(2):61-77.

Blomquist et al., Targeted RNA-Sequencing with Competitive Multiplex-PCR Amplicon Libraries, PLOS One (2013), 8(11):e79120, 14 pages.

Markoulatos et al., Multiplex polymerase chain reaction: a practical approach, Journal of Clinical Laboratory Analysis (2002),16:47-51.

Shen et al., MPprimer: a program for reliable multiplex PCR primer design, BMC Bioinformatics (2010) 11:143.

Zhao et al., Comparison of RNA-Seq and Microarray in Transcriptome Profiling of Activated T Cells, PLOS One (2014), 9(1):e78644, 13 pages.

CoPrimers by Co-Disgnoticsm Inc., downloaded in Apr. 2015, 1 page.

Karn, High-Throughput Gene Expression and Mutation Profiling: Current Methods and Future Perspectives, Breast Care (2013), 8:401-406.

Langmann et al., Real-time reverse transcription-PCR expression profiling of the complete human ATP-binding cassette transporter superfamily in various tissues, Clin Chem. Feb. 2003;49(2):230-8.

Lin et al., Multiplex genotype determination at a large number of gene loci, Proc Natl Acad Sci U S A. Mar. 19, 1996; 93(6): 2582-2587.

Giardina et al., Whole genome amplification and real-time PCR in forensic casework, BMC Genomics, Biomed Central, vol. 10, No. 1, Apr. 14, 2009, p. 159.

* cited by examiner

FIG. 1

| Gene Name | Forward Primer | Reverse Primer | SEQ ID Nos |
|---|---|---|---|
| MARCH3 | GGGCAGCAGCCAAGAGGA | GAAGTGGCAGAGTTCACA | 37 & 38 |
| SEPT5 | AAGCAGCAGGACCGGGAA | AGCTTCACGAAGTCGCAA | 39 & 40 |
| SEPT8 | GCAGCCCCTGAGGAAGGA | ACGTCGCATCCCTGACCA | 41 & 42 |
| A1BG | CCAGCGCTACTGTGACCA | GTGCAGGACCTGGGAGGA | 43 & 44 |
| A2M | AGCCCCAACCTCGGAGGA | GAGCATGGAGAGCCACCA | 45 & 46 |
| A2ML1 | ATTCGGCCACCTCCACGA | AGCCGCAGGCTCAGACCA | 47 & 48 |
| A4GNT | GCTCCACATCAGCTCGGA | TGGTGGGGGAGGAACCCA | 49 & 50 |
| AAAS | CCATGGTCTGGGACCCCA | CCTGTGGACCAGCCCACA | 51 & 52 |
| AACS | CCCTTGCCAGCCCACACA | TCCGGCCAAGCATGACGA | 53 & 54 |
| AADAT | GGCAACAACCCTACTGGA | CACGTCCATCAACATCCA | 55 & 56 |
| AANAT | CGCGCTCATGTGCGAGGA | GGGAGCAGTGGAGCTCCA | 57 & 58 |
| AARS | GGCCGTCTATACCCAGGA | CAGGTGCGTTCCCCCACA | 59 & 60 |
| ABAT | GGGTGAGAGGACGAGGCA | AGACCAGCGTGGGACGGA | 61 & 62 |
| ABCA1 | GAGCGGGTCAGCAAAGCA | GAAGGGCTAGCACAGGCA | 63 & 64 |
| ABCA3 | GACTCCCTGCTCCACACA | CGGCTCCATTGAAGCCCA | 65 & 66 |
| ABCA4 | TCAGTGGAGTGAGCCCCA | CATGGGAATGACCGCCCA | 67 & 68 |
| ABCA5 | AGCACATGTGGCGAGCAA | TTAACTGCCCAGACACCA | 69 & 70 |
| ABCA6 | TGGCAGGCAATCCAGGCA | TGGCCACACGGTCACACA | 71 & 72 |
| ABCA7 | GCCCACAGCATCACCACA | AGTAGAGGGTGGGGGACA | 73 & 74 |
| ABCA8 | AGGGCTGAGGAAAGGGGA | GTCGACGGCTCATCCAGA | 75 & 76 |
| ABCA9 | GGGACGCAATGATCGCCA | CTGACGGGTTCCCCAGGA | 77 & 78 |
| ABCB1 | TCCGAGCACACCTGGGCA | AGGGCACGAGCTATGGCA | 79 & 80 |
| ABCB11 | AGGGCTTCCATCCGGCAA | CCACAGACCCTACCAGCA | 81 & 82 |
| ABCB4 | GCAAGGAAGCCACAGCGA | AGGCGAGATTTCCAGCCA | 83 & 84 |
| ABCB5 | GCGGCTGTGGGAAAAGCA | AGCACAGGCTCTTGAGGA | 85 & 86 |
| ABCB6 | GTGGATCCGGGTGCAGCA | ACACTGGATGTGCCCCGA | 87 & 88 |
| ABCB7 | TGGCCCAAAGACAGGCCA | GGCCTTTGCACCACCCAA | 89 & 90 |
| ABCB8 | CGAGCGGGTTGTACAGGA | CCATCGGCCATGACGACA | 91 & 92 |
| ABCB9 | CGAGTTCATCGACCGGCA | GGGACAGGCTGAAGGAGA | 93 & 94 |
| ABCC1 | ACGGGACTCAGGAGCACA | AGCTCATGGGTGACCGCA | 95 & 96 |
| ABCC2 | CTGTCACCAGGTCCCCAA | CAGTCAGGTTCCCAACCA | 97 & 98 |
| ABCC3 | ACCAGGCACTGCTGCACA | AGGATGACAGGGGCCAGA | 99 & 100 |
| ABCC4 | TCGGGGAATTGGCCCCAA | AGTTCCCGAGAACACCCA | 101 & 102 |
| ABCC5 | GGGGGAGCTCTCAATGGA | GCGTGATCATCAGGCACA | 103 & 104 |
| ABCC8 | GCAGCCTGCTAAACCGGA | GGGCTGAGACACAGAGCA | 105 & 106 |
| ABCC9 | TGGCTGGCCACATGGACA | TGGCAGCTGTGAGACCCA | 107 & 108 |
| ABCD1 | GGTGGCGAGAAGCAGAGA | GTGATGGAGAGCAGGGCA | 109 & 110 |
| ABCD2 | GCCTGGAGTGAATGCAGA | AGGTAGCAGGGATGGCAA | 111 & 112 |
| ABCD3 | GAGGGGAAAAAGGAGCGA | ATGTTCGAGACACCAGCA | 113 & 114 |
| ABCE1 | AGACTGATGGCAGCTCGA | CGATGACGCGATCCGCTA | 115 & 116 |
| ABCF1 | GGAGAGTCACGCCCACA | GCTGACAACGATCACAGCA | 117 & 118 |
| ABCF2 | AGAGAGGGTCGTGAGCGA | CCATTGGGCCCTACCAGA | 119 & 120 |
| ABCF3 | GGAGGAGTACCGTCACCA | AGAAGTTGGGGCAGGGCA | 121 & 122 |
| ABCG1 | GACCTCCCTGGTGGCACA | GCTGACGAAGAACCCCGA | 123 & 124 |
| ABCG2 | GCACTGGCCATAGCAGCA | CTGAAGCCATGACAGCCA | 125 & 126 |
| ABCG4 | AGCGCTGGATGTGGAGGA | GCAGCACAAGGTAGGCCA | 127 & 128 |
| ABCG5 | CGACCAGGAGAGTCAGGA | GGGGCCAAGAGAGCAGCA | 129 & 130 |
| ABCG8 | CATCGCGGTCTCAGGAGA | AAGCCACCGCTGAGGCCA | 131 & 132 |
| ABHD1 | AGGAACTGCGGACCCACA | GAGTCAGTGCTGCCACCA | 133 & 134 |
| ABHD10 | TAGCTGATGGGCCACAGA | GCAGCTGTAGCTACACCA | 135 & 136 |
| ABHD14A | GAACTACACCCAGGAGCA | GCAGTGACTCTCGAGCCA | 137 & 138 |
| ABHD15 | CGGGATGTCGATGAGGCA | CTCCGTGGCGACTGAGCA | 139 & 140 |
| ABHD2 | GACATATCCCCTGACCCA | CACTGTACCCCTGGCACA | 141 & 142 |
| ABHD4 | TAAGGGTGCCTCCCACCA | CGCAGATCTCCTCCACCA | 143 & 144 |
| ABHD6 | CAGGACATGAGGGCACCA | GAGTACTGCAGGCCAGCA | 145 & 146 |
| ABI1 | AGTCCAGGCAGGACAGCA | GTGCCATACTGGGAACCA | 147 & 148 |
| ABI3 | CCCAGCTCCTTGGACCCA | CTGGGCTCATCAGGCCCA | 149 & 150 |
| ABI3BP | AGATGGACGCACTGGGCA | GGACAGGTTCCTGGCGAA | 151 & 152 |
| ABL1 | ACCCAGCCAAGTCCCCAA | AACGCAGGAGGCGGAGCA | 153 & 154 |
| ABL2 | ACCTGTGCCCAACAGCCA | ACAGCCTCTCGGAAGGCA | 155 & 156 |
| ABLIM1 | CTGCGGCCTACCAGGACA | TGACCTGGTGAGCCAGGA | 157 & 158 |
| ABLIM2 | CAAGACCTACCACCCCGA | TTCGGAGGCCCTGGGACA | 159 & 160 |
| ABLIM3 | CCGACGAGATGCTGGAGA | GGTGAGGTGAGCGGGAGA | 161 & 162 |
| ABP1 | CACAGCCACACCTGGGAA | CGTTGTCCCGAGGCCACA | 163 & 164 |
| ABR | TTGCCGAGAAGGAGCCCA | CATGACGTCATGGGACCA | 165 & 166 |
| ACAA1 | CTGCACTGGGGCACGACA | TCCCGATGCACATGGACA | 167 & 168 |
| ACAA2 | ACCGAAAGCATGAGCCAA | GCCATGGGGAGCTGGACA | 169 & 170 |
| ACACA | CGTCCTCACCCAACCCAA | GCCTGGCTCTACCAACCA | 171 & 172 |
| ACACB | TCACACCCACTGACCCCA | GAGGCCTTCCTGCAAGCA | 173 & 174 |
| ACAD8 | CATCCTCACCCGAGACCA | GAGCTTGGCCATGGAGCA | 175 & 176 |
| ACADM | GGGCCAGCGATGTTCAGA | GCTAATCCAACAGCACCA | 177 & 178 |
| ACADS | CCTCAGCGAACCAGGGAA | AAGACCACGGCAGCCGAA | 179 & 180 |
| ACADSB | AGCAGTGCTGAGCACGCA | GTTAACGGGCAGGTGGAA | 181 & 182 |
| ACADVL | AGTACGGGCTCTGGAGCA | CTTGAGGCCCTCGAGAGA | 183 & 184 |
| ACAP1 | CCCTGCTACGACTGGCAA | GTCTGACGCCATGAGGGA | 185 & 186 |
| ACAT1 | GACGGCAGATGCAGCGAA | TCTACAGCAGCGTCAGCA | 187 & 188 |
| ACAT2 | CAGCATGGAGCTGCCAGA | CCATGCCTCCTGCAACCA | 189 & 190 |
| ACD | TGAGCTGCCCCCACCAGA | CTGGAGCAGCCAAGGACA | 191 & 192 |
| ACE | TTCCAGGAGCTGCAGCCA | CTGAAGGGAAGGGCACCA | 193 & 194 |
| ACHE | AAGTGACCTGGCAGCCGA | CATCCACAGGGGCCAGGA | 195 & 196 |
| ACIN1 | GCCCCAGTCCAATCCCAA | CAGAGGGACGGTCCACCA | 197 & 198 |

FIG. 1 Cont.

| | | | |
|---|---|---|---|
| ACKR2 | GTGGAACTGCCACGCAGA | TCATGGCAAGGAGTGGAA | 199 & 200 |
| ACKR4 | GTCCCCAGCCAATCAGGA | TCAGCAAGATGGCAGCCA | 201 & 202 |
| ACLY | CTGGAGCCCACAACACCA | GCATCCAAGGCACCCCCA | 203 & 204 |
| ACO1 | CCGTCATGGCACGGGGAA | CTTTGCCAGCCAGAACGA | 205 & 206 |
| ACO2 | CTACCAGCACCCACCCAA | CCCACGGAACTTGAGCCA | 207 & 208 |
| ACOT2 | GGAGGAGAAAGCCCCAGA | CACCAAGGCATGCAGGGA | 209 & 210 |
| ACOT8 | CCCCTTCCGAGCTGACCA | ATCACGCCCTCCTGGGCA | 211 & 212 |
| ACOX1 | GGGCGCATACATGAAGGA | GAATAGCCATGCCCACCA | 213 & 214 |
| ACOX2 | ATCCGGAGCTGACCAGCA | CACAGAGGCGCTTGAGCA | 215 & 216 |
| ACOX3 | AGCTCACGGTGGTCCAGA | GACCACAGGGCGTACAGA | 217 & 218 |
| ACP1 | GGCATTCCCATGAGCCA | CTCTGCAGCACCTGACACA | 219 & 220 |
| ACP2 | GGAGGGGATGCTACAGCA | GCCTCAGCACTCATGAGA | 221 & 222 |
| ACP6 | CAGATGGCAGTAGGCCCA | ATGGTCAGGTCAACAGCA | 223 & 224 |
| ACPL2 | CAGAAGCCAGGTTCCCAA | GCACATGGGCTTGGGAGA | 225 & 226 |
| ACPP | ACGAGCCGTATCCCCTCA | TGAGGGATCACAGGGCCA | 227 & 228 |
| ACR | AGGCTGTGCCCGTGCCAA | AGGTGGAGGGGTGGCCGA | 229 & 230 |
| ACRBP | ATCGGAAGGTGTCCCGCA | CCTGGCTCCATCGAAGCA | 231 & 232 |
| ACRV1 | ACACTGTGGCCGAGCACA | TCAGTCGCAGCGGGCTCA | 233 & 234 |
| ACSBG2 | GCCTCTGGGGTAGGCACA | GGCCGGTGACATAGAGGA | 235 & 236 |
| ACSF2 | CACCCGAAGGTGCAGGAA | CAGCCGAATGCAGGCACA | 237 & 238 |
| ACSL1 | GGTGCACGAAGATCCGCA | AGCCTATGCACTCCGACA | 239 & 240 |
| ACSL3 | CTTGGGAAAGTAGAGGCA | GGGGTCCACGGTTCAGGA | 241 & 242 |
| ACSL4 | CTGGGACCGAAGGACACA | TTTCCGGAACAGCAGCCA | 243 & 244 |
| ACSL5 | AGGACAGCCTGGGCGGAA | CAAGCCAGGGGCACCCCA | 245 & 246 |
| ACSL6 | GCCTGCAAAGGAGAGGGA | CCAGTGTGAAGCCAGCCA | 247 & 248 |
| ACSM1 | GCCCAAGGATCAGGAGGA | TCCCCAGTAGGTGGCACA | 249 & 250 |
| ACSM3 | CACTCTCCAAGTACCCCA | GGTTCCCCAGCACTCACA | 251 & 252 |
| ACSS1 | GGCATCTGCATCGCACCA | AGGCCTGGGAGATGCACA | 253 & 254 |
| ACSS2 | CCACACCTTCAGCCCCAA | GGTGTGGCAATGGGGCCA | 255 & 256 |
| ACTA1 | CTGGGATCGCTGACCGCA | AGGTGGACAGCGAGGCCA | 257 & 258 |
| ACTA2 | GAGACCCTGTTCCAGCCA | GTGCCCCCTGATAGGACA | 259 & 260 |
| ACTC1 | GAGAATGAGATGGCCACA | GTGTCTCAGGACAGCGGA | 261 & 262 |
| ACTG2 | GACCACAGCTGAGAGAGA | GAAGAGGGTCTCAGGGCA | 263 & 264 |
| ACTL7B | CGGGCTTCAAGGAGGAGA | TCTCAGGAGCGGCAGCCA | 265 & 266 |
| ACTN1 | TGATCAGCTGGAGGGCGA | TGGCATCCCGGGTCAGGA | 267 & 268 |
| ACTN2 | GCCATACATCCTGGCGGA | CTCCCCGTAGAGTGCGGA | 269 & 270 |
| ACTN3 | TGGGCTACGGCAGCAGGA | GCTCCCAGCCCACGCGGA | 271 & 272 |
| ACTN4 | TCATGTCGCGGGAGACCA | GGCCCTGGTATGGCGCCA | 273 & 274 |
| ACTR2 | CTCCTATGAACCCAACCA | CCCTCCCAGCAATATCCA | 275 & 276 |
| ACTR3 | AACGGACGTTGACCGGTA | ACATACCCTTCAGCCACA | 277 & 278 |
| ACVR1 | AGCCATTGCCCATCGAGA | TTGGTGCCCACACGGGGA | 279 & 280 |
| ACVR1B | GGTTCAGGGAAGCAGAGA | GCCAGCCCACTAGCAGCA | 281 & 282 |
| ACVR1C | GACGGTCATGCTGCGACA | TGAAGGTGTGCCAGACCA | 283 & 284 |
| ACVR2A | TACACCTAAGCCACCCTA | GTACAGGAGGGTAGGCCA | 285 & 286 |
| ACVR2B | GGACAGGTAGGCACGAGA | TGCAGCCTTGCAGCGAGA | 287 & 288 |
| ACVRL1 | ACAACCCGAGAGTGGGCA | GGGTCATTGGGCACCACA | 289 & 290 |
| ACYP1 | GGGGTGTTTTTCCGTAAGCA | CGCACCTTGGAGATGGGA | 291 & 292 |
| ACYP2 | CGTGACAGGCCAAGTGCA | CGAGAACTAGGGCTTCCA | 293 & 294 |
| ADA | CCAGATGACCAAACGGGA | CAGAGGCTGAAGGTGGCA | 295 & 296 |
| ADAD1 | GCCTAAAGGATCAGCCCA | CTCCCTGTACACCAAGCA | 297 & 298 |
| ADAM10 | GCAAACTGAAACCTGGGA | CTGGGCAGAGAGCTGTGA | 299 & 300 |
| ADAM11 | CTACCACCAGGGCAAGGA | AGCGATGGTCCAGGCACA | 301 & 302 |
| ADAM12 | CCGCCAGATTCCTACCCA | GGTGGAGGGGAGGAAGCA | 303 & 304 |
| ADAM15 | ACCAGCTCCCTGACCACA | CCGTTCAGAGGGACCAGA | 305 & 306 |
| ADAM17 | CTGCGAGAGGGAACAGCA | CAGCATCGACATAGGGCA | 307 & 308 |
| ADAM18 | ACCTTGTGAACGGAAGGA | GGACCACACATGGTGCCA | 309 & 310 |
| ADAM19 | CCGCCCTTCTGCAACACA | GCCTCAGCTTGGAAGGGA | 311 & 312 |
| ADAM2 | AAATGCCAGTGCTCAGGA | GGATCTAAGCGAGGCTGA | 313 & 314 |
| ADAM22 | TCGTGGAGCGCCAGAGCA | TCGAGCGCGTCGTGCCGA | 315 & 316 |
| ADAM23 | CTGCGGGAAGGATGGAGA | CACATCATAGACGGGCCA | 317 & 318 |
| ADAM28 | TGCCCTACCTGCCACCAA | CCATACCAACTAAGGCCA | 319 & 320 |
| ADAM29 | GAGCTGTCATGACCGCAA | GTCATTGAAGCGAGCCCA | 321 & 322 |
| ADAM32 | GAAACCAGTCTGTGGCAA | CAACAGCTTGCAGGTCCA | 323 & 324 |
| ADAM7 | GCAGGGTCCATATGCAGA | CTTAGGACAGGCAGGCGA | 325 & 326 |
| ADAM9 | ACCCTTGCTGCGAAGGAA | CCTCCTGGAAGGAACCGA | 327 & 328 |
| ADAMDEC1 | GTCACATGAGCTGGGCCA | AGGGCTTCACAGCAGAGA | 329 & 330 |
| ADAMTS1 | AAGCCAGCCAGCACCAGA | CCCCTCCATCATGGGACA | 331 & 332 |
| ADAMTS10 | CCTGAAGGGAGACCAGGA | TGGTCCCAGCTAGAGGCA | 333 & 334 |
| ADAMTS12 | GCAACAACCCCGAGCCAA | AGGGGTGGACGTTGCACA | 335 & 336 |
| ADAMTS13 | GGAGGACGATGGTGAGGA | CTAGCAGTGCCAAGGCCA | 337 & 338 |
| ADAMTS14 | GCAGACGAGACCACCACA | ACTCCTCCGTCACCCACA | 339 & 340 |
| ADAMTS15 | CGGAAAGAGCTTCCGGGA | GCCTTGGACACAGACGGA | 341 & 342 |
| ADAMTS16 | GCACCACCACACCAACCA | CTGAGGGCATTGCGCACA | 343 & 344 |
| ADAMTS17 | GCGTGTACCAGCTGCAGA | GGCAGAGCACTGTGACCA | 345 & 346 |
| ADAMTS18 | CAGACCTGAGCTGCAGGA | CGCTCCACGAAGAAGCGA | 347 & 348 |
| ADAMTS19 | CCTGCAGCATACAGGCCA | CCACCGCATGTCCTGACA | 349 & 350 |
| ADAMTS2 | CCTCCAGCAGAAGCCAGA | TGCGGACCGGATGGCACA | 351 & 352 |
| ADAMTS5 | CGCTCATGTGGAGGAGGA | GGGCATGAGACTGCAGGA | 353 & 354 |
| ADAMTS6 | GCCTCCATCAATGCAGCA | CTTCAGCACCAGTGGGCA | 355 & 356 |
| ADAMTS7 | CCTGAACCCAGGACCCAA | CGGCGTTCCTGACAACCA | 357 & 358 |
| ADAMTS8 | TGAGTGCAAGGACCCCGA | CCCCAGCATACTTGGGGA | 359 & 360 |
| ADAMTS9 | GCTACCCTGCCTAGACCA | CCCACAGGTCACAGAGCA | 361 & 362 |

FIG. 1 Cont.

| | | | |
|---|---|---|---|
| ADAMTSL1 | GCTGACTGAGAGCACCCA | TCCCAGGATCCAGGACCA | 363 & 364 |
| ADAMTSL2 | CTCACAAGGCCAGGACCA | GCGCAGAACTCGTGGACA | 365 & 366 |
| ADAMTSL3 | GCCCTGTAACATCCGGGA | GGAGACACCACCTGCACA | 367 & 368 |
| ADAMTSL4 | GGGAACCTCACTGACCGA | GACCCAGGGGGATCCACA | 369 & 370 |
| ADAMTSL5 | GTCTACACCCGAGACACA | TGTAGCGCTCCCGAGGGA | 371 & 372 |
| ADAR | CCTCTCAAGGTCCCCAGA | AGCACCGGTGGCTCAGCA | 373 & 374 |
| ADARB2 | CCGTGTACCTGCAGAGCA | CACTCACGCCGCTGAGGA | 375 & 376 |
| ADCK1 | CCTCCCCCAGATCAGCCA | CGGCCTCAATGCCACGCA | 377 & 378 |
| ADCK3 | GGTCATGGAAGACGCCCA | CGAGACGGTGCCTCAGCA | 379 & 380 |
| ADCY1 | GCAGGCCCCAGTACGACA | AGGGGCACCTTCTCAGCA | 381 & 382 |
| ADCY2 | AGAACGACGGAGCCCCCA | AGTACCGGGTCATGCGGA | 383 & 384 |
| ADCY3 | CGAGGCCTTGGTCACCAA | AAGTTGGGCAGGGAGGCA | 385 & 386 |
| ADCY6 | TGCGGCTGCTCAACGAGA | GCATGGCGTAGTCAGCCA | 387 & 388 |
| ADCY7 | GCAACCTCACCAAGCCCA | TAGGCAGTCCAAGCGGCA | 389 & 390 |
| ADCY8 | CTCAGGAGCTGGTCAGGA | GGGCTCAGGAAGTCCAGA | 391 & 392 |
| ADCY9 | CGAGCAGTTCTGCCAGGA | ACCTCCTCATGCCCAGGA | 393 & 394 |
| ADCYAP1 | GAGATGTCGCCCACGGGA | GGGCCACGAGCGACTGCA | 395 & 396 |
| ADCYAP1R1 | GAGGCAATGAGTCCAGCA | AGCCCTGGAAGGAGCCCA | 397 & 398 |
| ADD1 | CGACGAAGCTTCCGAGGA | TGGCACGCAGACACCGGA | 399 & 400 |
| ADD2 | CCGAAGCCCGTCTACAGA | GGCTGAAGGGGTTGGGCA | 401 & 402 |
| ADD3 | GAGAGAAGCCTAGGCACA | TGAGAGGAGAGAGTGGCA | 403 & 404 |
| ADGRB1 | TCATCGGGCAGACCCAGA | AGAGGAAGCGCTTGCGGA | 405 & 406 |
| ADGRG1 | TGGCCATGCTAGCCACCA | CCCAGCAGTGTCAGCACA | 407 & 408 |
| ADH1A | CCCATCCAGGAGGTGCTA | GGTACCCCTACGATGACA | 409 & 410 |
| ADH1B | CATGTGGCACAAGCGTCA | GTCCAGTCAGTAGCAGCA | 411 & 412 |
| ADH4 | AGCCCTGGGAGCCACTGA | CCTGCACAGTCAAGGGCA | 413 & 414 |
| ADH5 | ACAAGGGCTGGGGCGTCA | ACCAGCTGGAATGGACGA | 415 & 416 |
| ADH7 | GGGCAAACCAGTCCACCA | CAGCTGACTTACAGCCCA | 417 & 418 |
| ADIPOQ | CCAGGCCGTGATGGCAGA | CCCGGAAAGCCTCGGGGA | 419 & 420 |
| ADIPOR1 | TACTGCTCCCCACAGCCA | ACGACGCCACTCAAGCCA | 421 & 422 |
| ADIPOR2 | GCCTAGGCCTGAGTGGAA | AGAGGCTGGCCATCAGCA | 423 & 424 |
| ADM | CATCCGAGTCAAGCGCTA | GCACGTCCCGAAGCGGCA | 425 & 426 |
| ADM2 | AGGCACCCCGCACCCCGA | GCACACAGCCCACTCGCA | 427 & 428 |
| ADORA1 | CCAAGTCGCTGGCCCTCA | CTTGTGGCAGGACGGGCA | 429 & 430 |
| ADORA2A | GCGACGACAGCTGAAGCA | GATGTGTAGGGGCAGCCA | 431 & 432 |
| ADORA2B | CTGGGATGGAACCACGAA | GAAGCTGCCTGCAGGCCA | 433 & 434 |
| ADPGK | GCACATGATGGAGGGACA | AGGAACACCGTTCCAGGA | 435 & 436 |
| ADPRHL2 | TCGGTGACCAGGGAGGAA | CATGCAGCGTAGGAAGCA | 437 & 438 |
| ADRA1A | CGCCAAGACCAAGACGCA | AAGGCAGCCAGCAGAGGA | 439 & 440 |
| ADRA1B | CCAAGGCCAAGGGCCACA | AGCCAAGCGGTAGAGCGA | 441 & 442 |
| ADRA1D | CGTTCCGGAGACCCACGA | GTGTGGGACGCCTAGGGA | 443 & 444 |
| ADRA2A | GGTGCTCCGTGCCACGCA | TCTTGAAGGCGCGGCGGA | 445 & 446 |
| ADRA2B | GCACTGCAAGGTGCCCCA | AGGATCCTCCGGAAGGCA | 447 & 448 |
| ADRA2C | CATCAGCCTGGACCGCTA | GACGGCCGAGATGAGCCA | 449 & 450 |
| ADRB1 | GAAGGCCTTCCACCGCGA | GATGGGGTTGAAGGCCGA | 451 & 452 |
| ADRB2 | CCACCCACCAGGAAGCCA | AGACCCTGGAGTAGACGA | 453 & 454 |
| ADRBK1 | CCGGCAGCACAAGACCAA | CATCTGCCAGTCCAGGGA | 455 & 456 |
| ADRM1 | TACCCTGACCTCGCCCCA | AGGCAGACCGAACTGGCA | 457 & 458 |
| ADSL | CCACTGGCACTCAGGCCA | GTGCACTGATGCCCCCAA | 459 & 460 |
| AEBP1 | TCCCCATTGCCAACGCCA | TCCAGTTGGAGCGAGCCA | 461 & 462 |
| AEN | GATCCAGGTGGGCCAGCA | CCTCGGGGCAGGTCCAGA | 463 & 464 |
| AFAP1L2 | AGCCACCCCTGTTGCAGA | GCAGGACAACGTCGGGGA | 465 & 466 |
| AFF1 | TCAGCACCCCAGTCACCA | TGAGGGCCAAGGTGCACA | 467 & 468 |
| AFF2 | CCCAGCGCATTCACCACA | CCCATCAGCGTGTCCAGA | 469 & 470 |
| AFF3 | GGGCCAGTGGAAAGAGCA | GACGATGGTCGACGGGGA | 471 & 472 |
| AFF4 | GACGAGTGGCAGCAGCAA | TGGAGGACAGTTAGAGGA | 473 & 474 |
| AFG3L2 | CGCTGCTAGCTAAGGCCA | GGACTCTAGCAGGGCCCA | 475 & 476 |
| AFM | GGGGCTGCCACAAAAGCA | CGGGATCCAGGGTAGGGA | 477 & 478 |
| AFP | TATGCCAACAGGAGGCCA | CACCCTGAGCTTGGCACA | 479 & 480 |
| AGA | GGAGAGTCAGCCACCACA | GGCTGGCAATTCCGAGCA | 481 & 482 |
| AGAP2 | GCTGGATTGAGCACCCCA | TCGGAGTCACTACCCCGA | 483 & 484 |
| AGER | GGCCACCCATTCCAGCCA | AGCCCTGATCCTCCCACA | 485 & 486 |
| AGFG1 | CCAGTAGCACAAGCAGCA | ACGACCTACAACTGGGGA | 487 & 488 |
| AGGF1 | AGGGCAGGTTAGAGCCCA | TGAACAGATGCAGGAGCA | 489 & 490 |
| AGK | CTGGGCACAACCACAGGA | CAATGGTGGACAGCTGCA | 491 & 492 |
| AGL | GGAATGCTGGTCCCCAGA | AGGCCCACAATTTCCACA | 493 & 494 |
| AGMAT | GCGCCAGGGACAGGGACA | ACAGCAGGTTAGCCGCCA | 495 & 496 |
| AGPAT3 | GCGGAAGTGGGAGGAGGA | TCCCCTCGCAGTACAGGA | 497 & 498 |
| AGPAT4 | CGGGCACCTTCCCAGAGA | CCATCGAACTCCCACGGA | 499 & 500 |
| AGPAT6 | GCCTCCCATGACTAGAGA | TCCCACAGCAGGTCCACA | 501 & 502 |
| AGPS | GAGTGGGCAAGTTACGGA | ACAGACTTCAGCATCCCA | 503 & 504 |
| AGR2 | CTGGCCAGAGATACCACA | TGGAGAGGGTCTGGGGCA | 505 & 506 |
| AGR3 | CAACAAGAGCACTGGCCAA | GCAATGGCAAGGTTGGA | 507 & 508 |
| AGRN | GGGTCTCACTGGAGCGAA | ATGGCACCGTCGAAGCCA | 509 & 510 |
| AGRP | AGACCTGCAGGACCGCGA | CGGCAGTAGCAGAAGGCA | 511 & 512 |
| AGT | GCCCACAGAGTCTACCCA | CCCAGGAAGTGCAGGGCA | 513 & 514 |
| AGTPBP1 | CCAACACTCCATGACCCA | GGAGGCGGAATGTGACCA | 515 & 516 |
| AGTR1 | CCCGCCTTCGACGCACA | GGCCCAGCCCTATCGGGA | 517 & 518 |
| AGTRAP | ACATCGTGCACATCAGCA | AACCAGTGTGGACCAGGA | 519 & 520 |
| AGXT | GGCTTCCCACAGTCACCA | TCCGTCACGCGGTCCACA | 521 & 522 |
| AGXT2L2 | GCCACAAGGACACCAGCA | TGTCCAGGCTGAAGCACA | 523 & 524 |
| AHCTF1 | AGGGAAGTGGAATCCCGA | GCATGCAGACTAGCAGGA | 525 & 526 |

FIG. 1 Cont.

| | | | |
|---|---|---|---|
| AHCY | GGCAGTGGCTGAAGCCCA | GAAGGGGCCATCACAGGA | 527 & 528 |
| AHCYL2 | GAACTGACCTGGGAGCGA | TAGCGACCCTCAGGAGCA | 529 & 530 |
| AHNAK | CCCCAAATCACTGGGCCA | ACTTCCACACTGGGGCCA | 531 & 532 |
| AHNAK2 | GTCCCTAGCCGACAAGGA | CCACCTTCAGCGCAGACA | 533 & 534 |
| AHR | AACCATCCCCATACCCCA | GGCACTGATACATCGACA | 535 & 536 |
| AHSG | AGCTGGCTCACCCCCAGA | CTCCTGAGGGTGACCCCA | 537 & 538 |
| AHSP | GCTGAACACTCTGGCCAA | GCGGTGGGTGACTCGGGA | 539 & 540 |
| AICDA | CAATAAGAACGGCTGCCA | TCGGGCACAGTCGTAGCA | 541 & 542 |
| AIF1 | GCAGGAAGAGAGGCTGGA | CCCCGGAGCCACTGGACA | 543 & 544 |
| AIFM1 | TCCCCGAATACCTCAGCA | CATTGGGCTCCAGGCCCA | 545 & 546 |
| AIFM2 | GGTGGAGGGCCACAGCAA | AGAGGCCGCTGCTTCACA | 547 & 548 |
| AIFM3 | CACAGGCTTCCTGAGGCA | AGGGGGAAGGTGACAGCA | 549 & 550 |
| AIG1 | GCAGCGGACTTACCGCCA | GGGTACACCCACATGCCA | 551 & 552 |
| AIM1 | CTGGCCCAAGGAGACGAA | CGGGCATCCCATTGCAGA | 553 & 554 |
| AIM2 | AAGAAGGCAAGCAGGAGA | AACACACGTGAGGCGCTA | 555 & 556 |
| AIMP2 | GACATCGTGATCAACGCA | AGGCACGCTCTTGACCGA | 557 & 558 |
| AIRE | TCAGGAGACGTGACCCCA | GTGCTCGCTCAGAAGGGA | 559 & 560 |
| AJUBA | CTGAGGGCTGTGAGGACA | GGCAACCATGGCAGAGCA | 561 & 562 |
| AK1 | CGGATTGGACAGCCCACA | CTGTCCACGGAGCCCTCA | 563 & 564 |
| AK2 | ACCCTCCAAAAGAGCCCA | GGTAGGCTTGCAGGCGGA | 565 & 566 |
| AK3 | GCACCTCTCCAGCGGGGA | TCATGAAGGGCCAGCCGA | 567 & 568 |
| AKAP1 | GAGCGAGATGACGGGGAA | CAAGGCCTCGCTCCACCA | 569 & 570 |
| AKAP10 | TGCAGGGAAGGTGGGCCA | GACTCATCAGGAGGGCCA | 571 & 572 |
| AKAP11 | CGGTGCCCTTGGCAGGAA | ACTTGGGCAGAATCACCA | 573 & 574 |
| AKAP12 | GCAGAGAGCAGAGGCAGA | GGGTGGTCTGCCCCACCA | 575 & 576 |
| AKAP13 | TTGGACACCAGAGCCCGA | GGGTGCTGCACTCAGCCA | 577 & 578 |
| AKAP2 | CTGAAGAGGCTGCCGGAA | CGTGTGGCCTCGAGGACA | 579 & 580 |
| AKAP4 | GAACAAGCAGCCTCGGCA | CTGGGAGGCTGCAATCCA | 581 & 582 |
| AKAP6 | GAAGGAGCTGCAGAGGCA | CCTCATCCTCCACAGACA | 583 & 584 |
| AKAP7 | TGAAAAGAACGGAGGGGA | GCACCGCGTTCTCCACCA | 585 & 586 |
| AKAP8 | CGAGGAGCCAGACACCAA | GCCTCCCAGAGTCGCAGA | 587 & 588 |
| AKAP9 | GCATCAGAAGGCCGAGGA | GGGAGACTCAGTGAGAGA | 589 & 590 |
| AKR1A1 | CAGGTGGAATGCCACCCA | GGTTCCTCCAGCAGGACA | 591 & 592 |
| AKR1B1 | TCAACAACGGCGCCAAGA | CTGGTACACATGGGCACA | 593 & 594 |
| AKR1B10 | CTGTGACACCAGCACGCA | CACGTTACAGGCCCTCCA | 595 & 596 |
| AKR1C1 | AAGCACAAGCGAACCCCA | AGCTCTTGGCCAGGACCA | 597 & 598 |
| AKR1C2 | GTCTGCAACCAGGTGGAA | CTGGGTCCTCCAAGAGCA | 599 & 600 |
| AKR1C3 | ACCGCAGGCAGCTGGAGA | CTCCAAGAGCACCGGGGA | 601 & 602 |
| AKR1D1 | CCCTGGAGAGGACACTCA | ATCGCCTCCCAAGTGGCA | 603 & 604 |
| AKT1 | GCTGCACAAACGAGGGGA | TAGCCAATGAAGGTGCCA | 605 & 606 |
| AKT1S1 | CAACGAGGAGGACGAGGA | CGGGGTCTGACTCACAGA | 607 & 608 |
| AKT2 | ACGTCCGAGGTCGACACA | TGCTGGCCGAGTAGGAGA | 609 & 610 |
| AKT3 | GCAGCCACCATGAAGACA | GACAACCCCTAGGCCCCA | 611 & 612 |
| AKTIP | GTCAACAAATGGCACGCA | TCGAACACCAAGCGTGGA | 613 & 614 |
| ALAD | CGGGATGTACGGGAAGGA | AGACGTGGTACACGGCGA | 615 & 616 |
| ALAS1 | GTGAACCGGCGAGCACA | CCACCTGCCCCAGCACCA | 617 & 618 |
| ALAS2 | AAGGGAGAGGAGGGCCAA | AGGGTGCCAAGCGCAGGA | 619 & 620 |
| ALB | TTGGTGAACAGGCGACCA | ACGAGCTCAACAAGTGCA | 621 & 622 |
| ALCAM | ACGATGAGGCAGACGAGA | ACACCAGCAACAAGGGCA | 623 & 624 |
| ALDH16A1 | TGGCCTCGAGGCTGGAGA | AGCAGGGACACGAAGGCA | 625 & 626 |
| ALDH18A1 | CTGCACACAGCAACCGGA | ACCAGCTGGGAAGAGCCA | 627 & 628 |
| ALDH1A1 | GCGCATTGCCAAAGAGGA | GGCACTGGGCACTTACCA | 629 & 630 |
| ALDH1A2 | CTGAGCAGGGTCCCCAGA | GCGCCCTCAGCCACACCA | 631 & 632 |
| ALDH1A3 | CGGACGCTGACTTGGA | GACCTGCTCCTCCACGAA | 633 & 634 |
| ALDH1L1 | GTGAAGGAAGGGGCCACA | ACACCAGAAGCCAGGCCA | 635 & 636 |
| ALDH2 | GAGGAGATCTTCGGGCCA | TGAAGACAGCTGCGGCCA | 637 & 638 |
| ALDH3A1 | GACGGCTGCTGCCAAGCA | GGATGTAGTCAGGGGCCA | 639 & 640 |
| ALDH3A2 | TGGAGGTGTCACAGGCAA | ACAGGGACGCTGATGAGA | 641 & 642 |
| ALDH6A1 | GCCAGAGCTGGTGGAGCA | GGAGTGATCAGAGGGCCA | 643 & 644 |
| ALDH7A1 | GCCTGATGGTGCAGGAGA | CCAGCTGTTCCCACAGCA | 645 & 646 |
| ALDH8A1 | GGGGCAAGAATCCTGCCA | GAGCACCTATGCTCACCA | 647 & 648 |
| ALDH9A1 | GGACATCCAACGGGCTCA | CACCCATCTCCACACACA | 649 & 650 |
| ALDOA | GGCTCTGAGTGACCACCA | TGACGGTCGCCATGGCAA | 651 & 652 |
| ALDOB | CAAGGCCCTGAATGACCA | CCAGGAACAGCTGCAGGA | 653 & 654 |
| ALDOC | CCATTCTGGAGAACGCCA | AGGGCCTTGTACACAGCA | 655 & 656 |
| ALG1 | CCAGAAGCACTTCCAGCA | CCACCACCTTCATGGGCA | 657 & 658 |
| ALG10B | GCGCTACTGTGAGGGCCA | CCACTCCAACTGACACCA | 659 & 660 |
| ALG5 | GTGGAAAAGGTGGAGCGA | ATGAGCTCGAGATCCACA | 661 & 662 |
| ALG9 | ACGATATCGCCTGGAGCA | CCTCTGAACAGTGCCACA | 663 & 664 |
| ALK | ATGGAAGGCCACGGGGAA | AGGGCAGAGGTCACCACA | 665 & 666 |
| ALKBH1 | CGCCTCTTGAACCACGCA | GCTGGCACACACCTGCCA | 667 & 668 |
| ALKBH5 | ATCAAGGAGCGCCGAGCA | GACAGGCGATCTGAAGCA | 669 & 670 |
| ALLC | CTCACGCCAGGCTCACCA | GGCAGATGGAGCTGGGGA | 671 & 672 |
| ALMS1 | TCAACTGGCCCTGGACCA | GGTCAGCTGGTCCAGGGA | 673 & 674 |
| ALOX12 | ACAATGCGGATGCCCCCA | AGACAGGCCTGCCGGACA | 675 & 676 |
| ALOX12B | CACCTGCTCTGCCAAGCA | ACGCTGGGAAGTTGGGCA | 677 & 678 |
| ALOX15 | GGGCCAGCATGAGGAGGA | GCAGGTACTCGTAGGGCA | 679 & 680 |
| ALOX15B | GCATCGCCACCTTCCAGA | GGTAGGTGTAGGGCAGCA | 681 & 682 |
| ALOX5 | CGGCCGAGGTGGTAGACA | CGCATTGGGGATCCAGGA | 683 & 684 |
| ALOX5AP | GCTTCCAGAGGACCGGAA | CGGACATGAGGAACAGGA | 685 & 686 |
| ALPI | CCCCGATTACCAGCAGCA | GACAGGCAGCGAAGGCCA | 687 & 688 |
| ALPK3 | AGCCCAAAGGAGAGGCCA | CCGGAAGTGCTAACCCCA | 689 & 690 |

FIG. 1 Cont.

| | | | |
|---|---|---|---|
| ALPL | TGCATGAGGCGGTGGAGA | CTCGTTCACCGCCCACCA | 691 & 692 |
| ALPP | ACAGCCAAGGTGGGACCA | CACAGACGGGTCCAGGGA | 693 & 694 |
| ALPPL2 | ACGGCGTGCAGGAGCAGA | CTGCCAGCAGAGGAAGCA | 695 & 696 |
| ALS2 | CCCAGTGACAAAGCCGCA | ATCCTGGGAAGGGAGGCA | 697 & 698 |
| ALS2CL | CTTAGAGCGCAAGGGCCA | CCTCCCGCTCATGAAGCA | 699 & 700 |
| AMACR | CTGGCAAGGGTCAGGTCA | CGAGGTGCTTCCCACAGA | 701 & 702 |
| AMBN | GCGGGAGAGAAGACCCAA | GGTGGCAGCCACTGGGGA | 703 & 704 |
| AMBP | CTGCCAGGGCAACGGGAA | CATCACCATCACCAGGGA | 705 & 706 |
| AMD1 | AGTGAGCTTGACCCAGCA | CCACTCTCACGAGTGACA | 707 & 708 |
| AMER1 | GCCCAGAAACAGGGGAGA | TAGGTCACCAGGCAGGAA | 709 & 710 |
| AMFR | CCTCCAGCAAGCTCGCAA | CCAGCATCCTTCGACGCA | 711 & 712 |
| AMH | CCGAGACCTACCAGGCCA | GGCGGTGGGCACGCAGCA | 713 & 714 |
| AMHR2 | CCAGGTATTGCCCACCGA | TGAGTAGGGGTCCAGGCA | 715 & 716 |
| AMICA1 | GCCCGGAAGAGCCTCGAA | TCAGAACAGGGAGCAGCA | 717 & 718 |
| AMIGO1 | GCAGGTGCAGGTCGAGGA | CCAGGACCACACTAAGGA | 719 & 720 |
| AMIGO2 | GACTCCATGCCCCTGCAA | CGTTCATCAGCGGAGGCA | 721 & 722 |
| AMMECR1 | CGCCACCTACCTACCGGA | GATGCTGGCGATGAGCAA | 723 & 724 |
| AMOT | CAAGACAGGCAGCCGAGA | GCTGGAGCAGCAGCAGCA | 725 & 726 |
| AMOTL2 | TGGAGGCCGACATGACCA | TGGCCACCAGTGAGCAGA | 727 & 728 |
| AMPD1 | AGCTGGAGCCCTCACCCA | GGTGACATGGCGATGGGA | 729 & 730 |
| AMPD3 | GGAGCTGGAGGAGAGCAA | CCAGCGCATGTTGGGAGA | 731 & 732 |
| AMPH | CAAGGAGACCACCGAGGA | AGAGGCCTCCCTTGCAGA | 733 & 734 |
| AMTN | ACCCAGGGAACCCCAGCA | GCAGGGGTGGTCACTGCA | 735 & 736 |
| AMY2A | GTATGATAATGGGAGCAACCA | GTGCCAGCAGGAAGACCA | 737 & 738 |
| ANAPC10 | CCAAGCAGTTGGAAAGGA | GCAAGATGAGAGTGACCA | 739 & 740 |
| ANAPC5 | ACATGGCCATCGAGCCCA | TCGATGGCAGCCTCCAGA | 741 & 742 |
| ANG | TGCCAGTACCGAGCCACA | GACTGATCCAAGTGGACA | 743 & 744 |
| ANGEL1 | GTGGCGAGAATGGGAGGA | GCATCAGGTCCTGAGCCA | 745 & 746 |
| ANGPT1 | CTGGAGCTGATGGACACA | CAACCTCCCCCATTGACA | 747 & 748 |
| ANGPT2 | GGAAGAGCATGGACAGCA | GGACACGTAGGGGCTGGA | 749 & 750 |
| ANGPT4 | ACTACCACGCTCCCGACA | TCATGCGAGAGGCACGCA | 751 & 752 |
| ANGPTL1 | AGCAAAAGAAGCTGGGCA | ATAACAGTCCAACCCCCA | 753 & 754 |
| ANGPTL2 | CACCACCCTGGACAGAGA | TCCTCGGAACTCAGCCCA | 755 & 756 |
| ANGPTL4 | GGGACAAGAACTGCGCCA | CCCGCCAGGTCTTCCAGA | 757 & 758 |
| ANGPTL6 | CAACGGTGTGTGGCACCA | GAATATGCCCCACCACGA | 759 & 760 |
| ANGPTL7 | CTACCGGGACTGGAAGCA | GTCTGGAGAGCCGGTGGA | 761 & 762 |
| ANK1 | GGACAAGACCCTGGAGCA | AGGCACCAGGTTCCCAGA | 763 & 764 |
| ANK2 | TCAGCAGGGTCACACGCA | CCACGGAGATGTAGCCCA | 765 & 766 |
| ANK3 | TGACCGGGGACACAGACA | CCGAACTGAAGGAGCGGA | 767 & 768 |
| ANKDD1A | CTATCAGGAGCACGGCCA | TCCTGCCAATGGCCACGA | 769 & 770 |
| ANKH | AGCCCCTGCTCATCCCGA | GCCACCAGAAGCTCAGCA | 771 & 772 |
| ANKIB1 | CCAGACCCTGATGAGCCA | TCATCGAGGGCCAGCCCA | 773 & 774 |
| ANKLE2 | CTCGAGGTCACCAGGGAA | GTCCGAGGGTGAGTAGCA | 775 & 776 |
| ANKRA2 | AAAGTGGGGCTGATCCAA | AGCCTAGGGCTACAGCTA | 777 & 778 |
| ANKRD2 | AGCCGACACGTGCGACCA | GCTGTGCAGTCCAGCCGA | 779 & 780 |
| ANKRD20A4 | CTGGACAAGCAGCACAGA | GCGCCATGTTCCAGCAGA | 781 & 782 |
| ANKRD26 | GCCTACCTCAGATGACGA | GGAAGGCTTTCAACCACA | 783 & 784 |
| ANKRD54 | GCAACATGAGCAGCGAGA | AAGCTGGCCAGGAGGTCA | 785 & 786 |
| ANKRD55 | CAGCCTCCCATAGGGCCA | CAGGCCGGACACTGAGCA | 787 & 788 |
| ANKRD57 | ACGACGCCGATGTGGACA | CGTCCAGGGCTCCCACCA | 789 & 790 |
| ANKZF1 | GGAGGAGCGTGAACGAGA | AGTCAGGCCTTGGAGGGA | 791 & 792 |
| ANLN | AGCCAATGCAGGGACACA | TCAGGTTGCCAGAGGCGA | 793 & 794 |
| ANO1 | GGGTCACAGTCACAGCCA | CATCGGGCTATGCAGCCA | 795 & 796 |
| ANO4 | CAGAGTCTGAGTGGGAGA | GCATCCACTAGGGTGGCA | 797 & 798 |
| ANO7 | GCAGGTACTTCGGGGAGA | ACACCAGGAAGCAGCCCA | 799 & 800 |
| ANP32E | GAACAGATCCCCGGAGGA | GGGAAGCCGGGCCAGCGA | 801 & 802 |
| ANPEP | CTACACCCTGAACCCGGA | GAGAACGAGCCACCACCA | 803 & 804 |
| ANTXR1 | GGAGAAAAGGGCTCCACA | AGTAGGACCCACAAGGCA | 805 & 806 |
| ANTXR2 | AAGGATCCTCCACCACCA | CCTCCAACCCCTCGACCA | 807 & 808 |
| ANXA1 | CACCAGAAGCTATCCACA | CACGATAGCTGTGAGGCA | 809 & 810 |
| ANXA10 | GGGACCAGAGAGGAAGGA | GACAGGCTTCCCATAGGA | 811 & 812 |
| ANXA13 | CATCAGGCGACTTGCAGA | CCCCGCACCCTTCATCGA | 813 & 814 |
| ANXA2 | CCCGCAGTGAAGTGGACA | ATCTCCACCACACAGGTA | 815 & 816 |
| ANXA3 | GTCAAATGCACAGCGGCA | GAGTCACTAGGGCCACCA | 817 & 818 |
| ANXA4 | CCAAACCTACCAGCAGCA | ATCCCTCCCACCAGCTGA | 819 & 820 |
| ANXA5 | CCGCGAGACTTCTGGCAA | CTGCAAGGTAGGCAGGTA | 821 & 822 |
| ANXA9 | TCCAGGAAACTGAGCCCA | CAGCCCTGCACAAGGCCA | 823 & 824 |
| AOAH | CAGTCCCAGCCATGACCA | CCTGGAGGCAGTTCAGGA | 825 & 826 |
| AOC2 | GGGAACGGTGCACACACA | TTCCAGGGGGCAGCCACA | 827 & 828 |
| AOC3 | GGAAGGAGGAGGAGCCCA | CTGTCACCCAGGCCACCA | 829 & 830 |
| AOX1 | GGAGAAAGGCGAAGGCCA | GGACCACGAGTGTGCAGA | 831 & 832 |
| AP1G1 | GCGCCTACAAGCAAACCA | GGGACTGAGGCAGGGGCA | 833 & 834 |
| AP1M1 | CCAACAACGTGGAGATCCA | AAGGACTTGATGGACCACA | 835 & 836 |
| AP1M2 | CAGTGTGGGCAGCGCCAA | TGTAGCGAACCCAGGGCA | 837 & 838 |
| AP2B1 | GCACTACCACTGCAACGA | CAAGGTCACTGCCAAGCA | 839 & 840 |
| AP2M1 | TCAAGCGCATGGCAGGCA | TAGCGCACCTTGAGGCCA | 841 & 842 |
| AP2S1 | ACACGGTCGTGGACGAGA | GGGACTGTAGCATCAGCA | 843 & 844 |
| AP3B1 | GCCTTGATCCAGAGCAGA | GCCATCACAACACTGCCA | 845 & 846 |
| AP3S1 | GGCTTAGCAGGAGCTCCA | AAGAGGGCAGGTTTGGCA | 847 & 848 |
| AP4B1 | GCAAAGCCCACTGGGCAA | GGGCTCCAGAATCAGGGA | 849 & 850 |
| APAF1 | GGAGCTGCTACCCATGGA | AGTGACAACGTTCCACCA | 851 & 852 |
| APBB1 | AGTGGAGCCACAGAGCCA | CATGCAGGCTGGTGGCGA | 853 & 854 |

FIG. 1 Cont.

| | | | |
|---|---|---|---|
| APBB2 | CATGGACACGGGGAACCA | CGGCCTGGCTACCAAGCA | 855 & 856 |
| APC | AGGTCAAGGAGTGGGAGA | AGCTGGATGAGGAGAGGA | 857 & 858 |
| APC2 | GGCAGACCACCTGAGCAA | AAGGGAGCTGCATCGGGA | 859 & 860 |
| APCDD1 | TCAACGGTCAGAGGCCCA | AGGAGGCACACTGGACCA | 861 & 862 |
| APCS | CCTGGGGCAGGAACAGGA | TTGGCAGGGAGAGGGGTA | 863 & 864 |
| APEX1 | TGACCTTCGCAACCCCAA | CCAGTGGCACAGCCTGCA | 865 & 866 |
| APH1A | CTGACATCGGGACTGACA | AGCTGTGATGAAGGCCCA | 867 & 868 |
| APLNR | GTTACGCACCACCGGGGA | CCACGGTGGTGGACGAGA | 869 & 870 |
| APLP1 | CCGAGAAGGCACAGCAGA | TCTGGTCAAGCAGGCCCA | 871 & 872 |
| APLP2 | CTCGAGGAAGAGCGGGAA | TCACCAGGCTGATGACGA | 873 & 874 |
| APOA1 | GCTCAGCGAGAAGGCCAA | GAGCGCTCAGGAAGCTGA | 875 & 876 |
| APOA1BP | GGGAACCGTTCCACAGCA | ACGTCCCATCCTGAGGGA | 877 & 878 |
| APOA2 | GCTTCAGGCCGAGGCCA | ACACTTCACTGGGTGGCA | 879 & 880 |
| APOA5 | CGACCAGGAGACTGAGGA | CATCCAGACGGGCCTGCA | 881 & 882 |
| APOB | CTGACCTGCGCAACGAGA | GAATCTGGGGCAGGCCCA | 883 & 884 |
| APOBEC2 | GGTTGAAGCACAGGGCAA | ACCGCAGGGCTGGGTCGA | 885 & 886 |
| APOBEC3A | AGCGCCTGGACAATGGCA | CCCGGCACAGCCCCAGGA | 887 & 888 |
| APOBEC3F | CCTGGCCAGGCACAGCAA | GCCCATGATCTCCACGGA | 889 & 890 |
| APOBEC3G | GCTGGACCTGGACCAGGA | GCGGGCAGTGAAGATGCA | 891 & 892 |
| APOC1 | AAGGTCCTGCGGGCAGGA | CAAGACGATCGACAGAACCA | 893 & 894 |
| APOC2 | CTCACCCAGGTGAAGGAA | ATCTACAGCGGGCAGGTA | 895 & 896 |
| APOC3 | GCAGGGTTACATGAAGCA | CTGCTGGGCCACCTGGGA | 897 & 898 |
| APOC4 | TGACGACCACCTGAGGGA | ACAGACAAGCCTGGGGCA | 899 & 900 |
| APOD | ACCCCAGTTAACCTCACA | GATCCAGTACGGTGCCGA | 901 & 902 |
| APOE | AGGAGCAGGCCCAGCAGA | CTTCCACCAGGGGCTCGA | 903 & 904 |
| APOF | GGCAAGGCCAGGGAACGA | CACTGATCGCTAGACCCA | 905 & 906 |
| APOH | GAGCCGTACGCTATACGA | GGAGGGCAGATGATGGGA | 907 & 908 |
| APOL1 | CCCGGGTCACTGAGCCAA | AGAAGCTTACAGGGGCCA | 909 & 910 |
| APOL2 | TGCAGAGGAGGTTGAGCA | GCTCCCAGACCCATGCCA | 911 & 912 |
| APOL3 | GAACGATTGCAGGCACCA | CCACATCCAGTGCAAGGA | 913 & 914 |
| APOL6 | TGGGACCTGCGAAACCGA | CACACAGACACACAGACA | 915 & 916 |
| APOM | AGCTCCCACCAAGGAGGA | ATGCGGATGGTAGCACGA | 917 & 918 |
| APOOL | TACTGCACCACCGCTCCA | AACCAGTTGCAGTGCGGA | 919 & 920 |
| APP | GGCCGAGGAGATTCAGGA | CGGGCATCAACAGGCTCA | 921 & 922 |
| APPBP2 | CGGTTGCGAGATCGGCAA | TCAGGAAGGACTGCACCA | 923 & 924 |
| APRT | CCCTGGAGCCAGGACAGA | TCAGCTCCACCAGGCTCA | 925 & 926 |
| AQP3 | CCAATGGCACAGCCGGCA | GTTGACGGCATAGCCGGA | 927 & 928 |
| AQP7 | CGTATGAAGACCACGGGA | GTTGGCAGGGCTCACAGA | 929 & 930 |
| AQP9 | ACCCAGCTCGAGACCTGA | AAGGGCCCACTACAGGAA | 931 & 932 |
| AQPEP | GGCACTGGGAACGCCACA | CCTTCACCAGGCCCGAGA | 933 & 934 |
| AQR | CCCACCTGGTACAGGCAA | CTCCATGACCAAGACGCA | 935 & 936 |

| | | | |
|---|---|---|---|
| AR | ACAGCGCAGGCAAGAGCA | GAGACAGGGTAGACGGCA | 937 & 938 |
| ARAF | GCAACGGTCACTCCCCAA | GCGCTGAGTAGGCAGGCA | 939 & 940 |
| ARAP2 | GCCCACCGCAGTTGGAGA | CGCGTTTAGGAGGAGACA | 941 & 942 |
| ARAP3 | CAGCTGTGGCAAGACCCA | CGGGACTGCAGTACAGGA | 943 & 944 |
| ARCN1 | CGACATGACAGTCGACGA | CATTGGGCTGCCCAGCAA | 945 & 946 |
| AREG | GGTGTGGGGAAAAGTCCA | AACAGCTGTGAGGATCACA | 947 & 948 |
| ARF1 | CAGAGAGCGTGTGAACGA | GGAGGACAGCATCCCGGA | 949 & 950 |
| ARF4 | TAGGGGAGATAGTCACCA | TTGACCACCAACATCCCA | 951 & 952 |
| ARF6 | GGGAGATGAGGGACGCCA | GCACAGGAGGGCTGCACA | 953 & 954 |
| ARFGAP1 | GCTTCACCACTGGAGCCA | GCCAACTGAGAGACCCCA | 955 & 956 |
| ARFGAP3 | GCATGCAAGTCGGAGGAA | TGCTTGAGAGGCGAGCGA | 957 & 958 |
| ARFGEF1 | GGGAGGAGGTCCAGCAGA | ACAGCACGAAGTTCAGGA | 959 & 960 |
| ARFGEF2 | GTGAGACCAGCTCGCAGA | GGACACAGCACACAGCCA | 961 & 962 |
| ARFIP1 | GGTCTCTCAGAAACCCAA | GCCAGTCGACTAGCTGCA | 963 & 964 |
| ARFIP2 | TGAGAAGCTGCGGGGAGA | AAGTAGGCGGACACAGCA | 965 & 966 |
| ARG1 | GGCTGGCAAGGTGGCAGA | AGTGTGAGCATCCACCCA | 967 & 968 |
| ARG2 | GGGGGACTAACCTATCGA | GAGGTGGCCAACTGAGGA | 969 & 970 |
| ARHGAP10 | ATCCCAGGCCAGACCCGA | CACGGATACACGGCTCGA | 971 & 972 |
| ARHGAP15 | CGCCAAATCGTGACACCA | CGCAGAAGGGTAGGTCCAA | 973 & 974 |
| ARHGAP22 | AGGAGGTCACCAGGGACA | GATGGGCACCTCCAGGGA | 975 & 976 |
| ARHGAP25 | TAAGGCAGGGGAAGGGCA | ACCCTGGCAGGGAAGGGA | 977 & 978 |
| ARHGAP26 | TCAGGAGGCAGACAGCCA | TGCAGGAAGGCCAGCAGA | 979 & 980 |
| ARHGAP27 | GTGGAAACCTGGCCACCA | CCGCAATGAACTGGCGGA | 981 & 982 |
| ARHGAP28 | TCGAGCGGGAGACTGCAA | GTGGAGCATGGACCCGTA | 983 & 984 |
| ARHGAP29 | CCCAGTGCACTCCAGGAA | GACAGGAGCGAGAGGGTA | 985 & 986 |
| ARHGAP35 | GTGGAGACCTCAGCGAGA | TCACAATGCGACTCACCA | 987 & 988 |
| ARHGAP36 | GACGCAGGAACTTGAGGA | TCGTCATGGGAACGGGCA | 989 & 990 |
| ARHGAP4 | CCCTCTGGACACAGACGA | AAGGCCCTGGCGGACAGA | 991 & 992 |
| ARHGAP5 | GAGCCCAATTCCTGCCAA | AGCTTGAGCAGCACTGCA | 993 & 994 |
| ARHGAP6 | CAGACCCCCTTCTCACCA | GCCTGGCCACGATGGAGA | 995 & 996 |
| ARHGDIA | GAGAGATAGTGTCCGGCA | CCTCCTCCACGGGGGTCA | 997 & 998 |
| ARHGDIB | AGATCCGAAAGCCCCCAA | CGAGGTCCATAGCTGCCA | 999 & 1000 |
| ARHGDIG | CGGTGGAGGAAGCGCCGA | CCAGTCCTGGCAGATGCA | 1001 & 1002 |
| ARHGEF10 | GCACTTCCGAGTGGAGGA | AGCTGGAGCCGTGAGACA | 1003 & 1004 |
| ARHGEF11 | GGGCTCCTCAGACAGCAA | CCAGCTTGGAGGTGCAGA | 1005 & 1006 |
| ARHGEF12 | CACTTACCCTGCAGCCCA | CAGCGCTGCTGGACCAGA | 1007 & 1008 |
| ARHGEF2 | AGGCTTACCTGCGGCGAA | GACCCTCCACCTCACGGA | 1009 & 1010 |
| ARHGEF3 | CACCACCGGGAGCAGAGA | GCTCACAGTCGAGGCTGA | 1011 & 1012 |
| ARHGEF6 | CCAAAAGCCGTCAAAGGA | ACCTCCACAGTACTCAGA | 1013 & 1014 |
| ARHGEF7 | GCAGGAATGGGTGGAGCA | GGAGGGGAGGGTATGAGA | 1015 & 1016 |
| ARHGEF9 | ACCCCCACCTCAGCGAGA | ATCTGCTGCAAGAGGCGA | 1017 & 1018 |

FIG. 1 Cont.

| | | | |
|---|---|---|---|
| ARID1A | GCAGCCAAGGAGAGCAGA | CCTGAGCGAGACTGAGCA | 1019 & 1020 |
| ARID1B | TGAGCAGCATGACCCCCA | AGGGAGAGCTGGAAGCCA | 1021 & 1022 |
| ARID2 | GCTCACGGAAATGGGAGA | GCTAGTGCATCAGGGCCA | 1023 & 1024 |
| ARID4A | ACGAACAGAGGAAGGAGA | TCCGTTGCAGACACCACA | 1025 & 1026 |
| ARID4B | AGAAGGCAGCCGGCAGCA | CCCCAGCAACACTATCCA | 1027 & 1028 |
| ARID5B | CGCACAAACCTACCGGCA | AGACCTGGAACTGGGAGA | 1029 & 1030 |
| ARL16 | GCCCACGGTGGGCACCAA | GAGAGCTGGGTGGGGTCA | 1031 & 1032 |
| ARL3 | CCGAGTCTGGCAGATCCA | CAGACCCAGTTCATGCCA | 1033 & 1034 |
| ARL6IP1 | GAAGAACAGCTGCAAGGA | AACGCCGGACAGAACAGA | 1035 & 1036 |
| ARL8A | CTGGGACATTGGGGGACA | CCTGGTCAGCAGCATCCA | 1037 & 1038 |
| ARL8B | GGGCTTCAACATGAGGAA | TGCAATACCGCTCCCACA | 1039 & 1040 |
| ARMC5 | TAGCCCAACCTCCCAGCA | TCCTCACCAGCCTCACCA | 1041 & 1042 |
| ARNT | ACAGTGGCAGGGCCAGCA | GATCTCCCAGCATGGACA | 1043 & 1044 |
| ARNT2 | CAGCAGGAACCCAGCAGA | GCCCGTGGAAGAAGAGGA | 1045 & 1046 |
| ARNTL | CAGGCTCAGGAGAACCCA | AGTCAACAGGGCCACCCA | 1047 & 1048 |
| ARPC1A | GCCATGACTGCTGCCCAA | CGGAAGCGTTCCATGGCA | 1049 & 1050 |
| ARPC3 | CCAAAAGCCAAGGTGAGA | AACCAGGCTCTCCAGGAA | 1051 & 1052 |
| ARPC5L | TGTGGACGAGCAGGAGGA | GAGTTCCGCAAGGCTGCA | 1053 & 1054 |
| ARPP21 | AAGGGTCACTCCCAGCCA | GCTGACATCACTGGGACA | 1055 & 1056 |
| ARRB1 | GACCCCCTTCCTAGCCAA | ACAGGGTGCTAGAGGCCA | 1057 & 1058 |
| ARRB2 | CGTGAAGGAGGGTGCCAA | CGCCTCGAGACACCACCA | 1059 & 1060 |
| ARSA | CCCGTCCTACCCAGACGA | CACCAGGGTCCTTGGACA | 1061 & 1062 |
| ARSB | ACCGGGAGCTCATCCACA | TTCCACACGTCGAAGCCA | 1063 & 1064 |
| ARSD | GAGTCCTGTGCCCCAGCA | CCTCGTGGCATGAACAGA | 1065 & 1066 |
| ARSE | TGATTGGCGAGCCCACGA | TCCCCAGGAGCAAGGGCA | 1067 & 1068 |
| ARSG | GGGAAGTCCAGCCAAGCA | TGGGCCAGGGCTACCACA | 1069 & 1070 |
| ARSI | GGTGGTACCACCTCAGCA | GCACGGCGGTGTTCCAGA | 1071 & 1072 |
| ARSK | GCATGGCTACCGAACACA | GTCCACGCTTCCACACGA | 1073 & 1074 |
| ART3 | GAGGGCTAAACCAAGCCA | GCCAGCCCCCTCCTGTGA | 1075 & 1076 |
| ART4 | CCTACACAGGGGCCACCA | GTGCACCCAGGCAGGTGA | 1077 & 1078 |
| ART5 | AAGGCAGTGGCCCACAGA | CCCACCCAGATAGGCGCA | 1079 & 1080 |
| ARTN | CTCAGCCTGGCCAGCCTA | TGACGTCCATGAAGGAGA | 1081 & 1082 |
| ARVCF | GCTGCAGTCTGAGACCGA | TGTTGAGCACCGCCACCA | 1083 & 1084 |
| ASAH1 | CTCAACAAGCTGACCGTA | TATACAAGGGTCAGGGCA | 1085 & 1086 |
| ASAH2 | CCTGAGCAGAGGTCCAGA | ACACACTATCTGCCACGA | 1087 & 1088 |
| ASB13 | ACTACACGTGGAGCAGCA | TCCAGCCCTCGGACGCCA | 1089 & 1090 |
| ASB15 | TGCTGAAACATGGAGGCA | AACAGCACCGACGCCCCA | 1091 & 1092 |
| ASB7 | CACTACGGCAGGGACTCA | GATCACGGCGTATCGCAA | 1093 & 1094 |
| ASB9 | CAGTGGCCAGGACAGCCA | CTGGAGGCACCAGCTCCA | 1095 & 1096 |
| ASCL1 | CAACGAGCGCGAGCGCAA | GATGTACTCGACCGCCGA | 1097 & 1098 |
| ASCL2 | CGCCTACTCGTCGGACGA | ACCAGCTGGAGAAGTCGA | 1099 & 1100 |
| ASF1B | GGCCATAGAGACCCAGGA | TGCAGCCAGGGAGCCCCA | 1101 & 1102 |
| ASGR1 | ACGGGACGGACTACGAGA | GGTAGGGCCTCTGGCAGA | 1103 & 1104 |
| ASGR2 | GGCTGTCACTCAGCCAGA | CTCACACACCCAGCGGTA | 1105 & 1106 |
| ASH1L | CAAAGGCAGGCCAGGACA | ACGACAGCCTGAAGGGGA | 1107 & 1108 |
| ASL | ACCTGGTCCGCAAAGGGA | ACAGCTGGTTGAGGGCGA | 1109 & 1110 |
| ASNS | TGCTAGAAAGGTGGCAGA | GGAGAAGGAGCCTTGTGA | 1111 & 1112 |
| ASPM | TGGCCCAGAGTGGAGCAA | AGCAAGACTTGCACAGCA | 1113 & 1114 |
| ASPSCR1 | CAGTCCTGGACGACCACA | GCAGATGGGGAGATGGCA | 1115 & 1116 |
| ASS1 | CCGCCACTGCATCGCCAA | ACACCTGGCCCTTGAGGA | 1117 & 1118 |
| ASTL | GGTCCCATGCCCACAGCA | CCTCCCGCACTGGAACCA | 1119 & 1120 |
| ASTN1 | GCCTGGAACCTGACACCA | ATCATCCACCACGGGGCA | 1121 & 1122 |
| ASXL1 | CCCTGGGTGATCAGAGCA | GGAGTCTGTACCCCACCA | 1123 & 1124 |
| ATAD1 | AGTTGCCCAGGAAACTGA | GCTGTTGAACAGGCCGAA | 1125 & 1126 |
| ATAD2 | GTACGGTCAAGCAGGCAA | TCGTAGCACCAATGACCA | 1127 & 1128 |
| ATAD2B | GGAGGCGTTATCCCCAGA | GTGCATGCCCTGAAGACA | 1129 & 1130 |
| ATAD5 | GAAAGCTGCTGCGCTGGA | GTCCTCATGAACACAGCA | 1131 & 1132 |
| ATAT1 | CCCAAGAGAGCAGAGGGA | GGGGCAGAGGCGCAAGGA | 1133 & 1134 |
| ATF1 | CCTCTGATGGACAGCAGA | TGAGAGGTGAGAGTCACA | 1135 & 1136 |
| ATF2 | AGGCAGAAGCTGTAGCCA | AGGAAGGAGCCATAACGA | 1137 & 1138 |
| ATF3 | CAAGAACGAGAAGCAGCA | CCATTCTGAGCCCGGACA | 1139 & 1140 |
| ATF4 | CCCAGACGGTGAACCCAA | GGACAGGACCCCTGGGGA | 1141 & 1142 |
| ATF5 | GAGGTACCGCCAGCGGAA | GATCTCGCGCTCCACGGA | 1143 & 1144 |
| ATF6 | GCCATTGGCAAAGCAGCA | GTGTGACTCCCCCAGCAA | 1145 & 1146 |
| ATF7IP | GTGCCAACAAGTGGACCA | ACCTGCCGAACAGCAGGA | 1147 & 1148 |
| ATF7IP2 | CCAGAACCACCAGCACCA | CAAGTCAGGGCAATGCCA | 1149 & 1150 |
| ATG10 | CGCAACAGGAACATCCAA | AGAGGTAGATTCAGCCCA | 1151 & 1152 |
| ATG12 | GAACCATCCAAGGACTCA | GGTCTGGGGAAGGAGCAA | 1153 & 1154 |
| ATG16L1 | CTGGAGGCATGGACCGCA | CCTGAGACAATCCGCGCA | 1155 & 1156 |
| ATG4B | CCGCATGAGCATCGCGGA | CTAGGGACAGGTTCAGGA | 1157 & 1158 |
| ATG5 | GTTGCACACACTAGGAGA | TCACTCAGCCACTGCAGA | 1159 & 1160 |
| ATG7 | TGCCAGCAGCAGTGACGA | AATGCCAGGCTGACGGGA | 1161 & 1162 |
| ATHL1 | CCGCCATGACCTGGAGCA | CCGTGCACCCGAAGACCA | 1163 & 1164 |
| ATIC | GTACACACTGCAGCCCAA | GGAATTCCAACAGCAGCA | 1165 & 1166 |
| ATL2 | GGACCAGCTTGAAGCTGA | GGCCAATGAAGCCAGTCA | 1167 & 1168 |
| ATM | CCGATGGCAAGGAGAGGA | CTTCGCTGAGAGAGGGGA | 1169 & 1170 |
| ATMIN | CCCAGAGGCCCTGAGAGA | GGCGTAGGGACAGCCGCA | 1171 & 1172 |
| ATN1 | CCCTCTGCACGAGAACGA | TGCTGACATCGGGGCAGA | 1173 & 1174 |
| ATOH8 | AACTGGCCATCCTGAGGA | TGCGGGTGCAGCGCTGCA | 1175 & 1176 |
| ATOX1 | CTGAGCACAGCATGGACA | TGGAAGCCAGCGGGAGGA | 1177 & 1178 |
| ATP10A | GAGGAATACCGGCCACGA | CAATGCCCAGGTGGAGCA | 1179 & 1180 |
| ATP11A | CAGCCTCATGGAGCAGCA | TGAACACGCGCCAGCGCA | 1181 & 1182 |

FIG. 1 Cont.

| | | | |
|---|---|---|---|
| ATP13A1 | GATGCCAGCATCGCAGCA | TAGGCCAGGATGAGGGCA | 1183 & 1184 |
| ATP13A5 | ATCCCTCCAGGCAGCCAA | CAGCTGCCAGGTCACAGA | 1185 & 1186 |
| ATP1A1 | AGACAGCTACGGGCAGCA | GATGACCAAGTCGGCCCA | 1187 & 1188 |
| ATP1A3 | CGCTCTGAAGAAGGCCGA | CCTGTGACGATGGAGGCA | 1189 & 1190 |
| ATP1B1 | GTGCACTGGCAAGCGAGA | CGGCCAGCAGGGGCTGCA | 1191 & 1192 |
| ATP1B3 | GAGCCTGGCCGAGTGGAA | ATGAGAAGAGTGCAGCCA | 1193 & 1194 |
| ATP2A1 | GGGCTTCAACCCACCAGA | ACGGTGGCTGCACCCACA | 1195 & 1196 |
| ATP2A2 | CCCCGGAACCCAAAGGAA | CTTGGACCACCGTCAGCA | 1197 & 1198 |
| ATP2B1 | TGTCTCAGACCAACGCCA | CAGTTCCAGCAATACCCA | 1199 & 1200 |
| ATP2B4 | GGCTCATCCGCAACGAGA | TGGGAGAAGATCGCGCCA | 1201 & 1202 |
| ATP2C1 | ACCTCCTCGCAACTGGAA | CTCGTAGCTCACGCCAGA | 1203 & 1204 |
| ATP2C2 | CCCTCAACGCCATGCAGA | AGGATGGTGTCCCGCACA | 1205 & 1206 |
| ATP4A | CCAAGGCCATTGCAGCCA | ACCTGGTCTACGGGCACA | 1207 & 1208 |
| ATP4B | CCAGCCCCACTACAGCAA | CCGCCATGACCTTGCACA | 1209 & 1210 |
| ATP5A1 | AACCAGGGCTATGAAGCA | TCAGTTAGACGCACGCCA | 1211 & 1212 |
| ATP5B | GAGGACCCGTGAAGGCAA | GCAGACACCTCTGAACCA | 1213 & 1214 |
| ATP5D | CAACGTCCGGCAGGTGGA | ATGGAACCGCTGCTCACA | 1215 & 1216 |
| ATP5E | GCCCGGCTGAGCCGACA | CAGATCTGGGAGTATCGGA | 1217 & 1218 |
| ATP5F1 | TCATACAGGGCAGCCACA | AGATAAGCCCAGTTCCGA | 1219 & 1220 |
| ATP5G1 | GACGGGAGTTCCAGACCA | AGAGACGGGTTCCTGGCA | 1221 & 1222 |
| ATP5G2 | GCCGCAGCTTCCAAACCA | CCAGAACCAGCCACCCCA | 1223 & 1224 |
| ATP5G3 | GGAGAGGGCTCTACGGTA | CAGAACCAGCCACTCCTA | 1225 & 1226 |
| ATP5H | CAAGGCCAATGTGGCCAA | TCGGCATCCACCTGGGCA | 1227 & 1228 |
| ATP5I | CGGTGCGGAGGTCAGGGA | GTGGCTCCGTAGGCCACA | 1229 & 1230 |
| ATP5J | GGCCGGAAGTAGAGCGGA | ACTGAGACGGCTGACCGA | 1231 & 1232 |
| ATP5J2 | CCCAGTACCAGTGAAGGA | TAGGACTGAAGTCCCGCA | 1233 & 1234 |
| ATP5L | CTCCCACCCCTGCTGAGA | TCAACACCTCAGTGGCCA | 1235 & 1236 |
| ATP5O | GGAGAGGTACCTTGCACA | GCACAATCATTCCACCCA | 1237 & 1238 |
| ATP5S | GGCGTAAAGAAACTCCCA | CCTGGCCATGGTAGCGCA | 1239 & 1240 |
| ATP6AP1 | AGGTCACAGGGCCCAGCA | TGAGCAGCCCCATCCAGA | 1241 & 1242 |
| ATP6AP2 | AAGCGAAGAACCCAGCAA | TAATCACAGCCAAGGCCA | 1243 & 1244 |
| ATP6V0A1 | GTGAAGAGCTTGGCGGGA | CAACCCAGTGTAAGCGCA | 1245 & 1246 |
| ATP6V0A4 | GACCCAGCCATACCAGGA | GGCTGAGGATGACACCGA | 1247 & 1248 |
| ATP6V0B | CCGATGCTCAGAACCCCA | ATTGCGACGATGACCCCA | 1249 & 1250 |
| ATP6V0C | GGCAGTCCTCATCGCCAA | CCCACGATGCCGATGGCA | 1251 & 1252 |
| ATP6V0D1 | GGTCAAGAACGTGGCCGA | ACTGGTTCAGGAAGGCCA | 1253 & 1254 |
| ATP6V1B1 | GGAAGGACGTGCAGGCCA | GCAGCAGCTTCCAGCCCA | 1255 & 1256 |
| ATP6V1C1 | GGAGAAAACCTGTCAGCA | CATCTGACAAGCCAACCA | 1257 & 1258 |
| ATP6V1F | ACCAGTACATCGCAGAGA | TCTCCAGGACAGCGGGGA | 1259 & 1260 |
| ATP6V1G1 | ACCGCCTGCAGAGGGAGA | GCTGCAACTGCCACGGGA | 1261 & 1262 |
| ATP6V1H | GAACACTGCGTGGCCCTA | CCGGCCACGCACTGCACA | 1263 & 1264 |
| ATP7A | GGATGGGATCTGCAGCAA | TCTGGCTCCGGGCAGGCA | 1265 & 1266 |
| ATP8B1 | GTTGAAGGCGGAGGAGCA | GATGGCATCAAGCGGCGA | 1267 & 1268 |
| ATP8B4 | CCAGGATGTGAGTGACCA | CACTGACCACAATGACCA | 1269 & 1270 |
| ATP9A | TGGCGCTGACCATCCAGA | AGAACACCAGGGAGGCGA | 1271 & 1272 |
| ATPAF1 | GCATTCCAGGCAAGGTGA | GGACTGAGCCCGGTTCCA | 1273 & 1274 |
| ATR | GAATGGGAGGATGGGCA | ACACGATCGGAGCGGCCA | 1275 & 1276 |
| ATRN | GAGATTGCACCAGCGGCA | AAGGAGGCCACGTAGGCA | 1277 & 1278 |
| ATRNL1 | GGAAGATGATCGCCACCA | CCAGCTGTTGAACCGACA | 1279 & 1280 |
| ATRX | CAGAAGGCTCCAGCAGCA | GCATCATGAGGTGACCCA | 1281 & 1282 |
| ATXN1 | CCCTTCCCAAGAGCGAGA | AGGCCACGGACTGCACCA | 1283 & 1284 |
| ATXN2 | CCCACTGGACAGCAGCAA | GAGGGTGGAGTTGGCGCA | 1285 & 1286 |
| ATXN3L | CAGAAGGAGGAGTCACCA | CCCCAGAACTTCAAGGCA | 1287 & 1288 |
| AUH | GATGAAGACGGAGGACGA | TTAAGGTCAGCACCAGCA | 1289 & 1290 |
| AURKA | CATCTTCCAGGAGGACCA | GAACTCCAAGGCTCCAGA | 1291 & 1292 |
| AURKB | AGCAGCGAACAGCCACGA | GCACTCCAATGCACCACA | 1293 & 1294 |
| AURKC | AACAGCGCACAGCCACGA | GTGTGCACAGACCAGCCA | 1295 & 1296 |
| AUTS2 | GGAGCGGAAGGAAGACCA | GAATGCCCGTCACCCCCA | 1297 & 1298 |
| AVL9 | TGGGAGGGAGGTGACGAA | GCAGTGTGGCAGCCAGCA | 1299 & 1300 |
| AVP | CGACCTGGAGCTGAGACA | GCCGGACTGGCAGGGCGA | 1301 & 1302 |
| AVPI1 | CTTTAGGCAAGCAGCCCA | GGAAGGACTGTGGCAGGA | 1303 & 1304 |
| AVPR1A | AGCAAGGGTGCAGAGCAA | CGGACATGGGATCCCAGA | 1305 & 1306 |
| AVPR1B | CCACCTTAGCTGCCACCA | GAAGAAGGGAGCCCAGCA | 1307 & 1308 |
| AVPR2 | GCCTCAACAGCTGCACCA | GTCCTTGGCCAGGGAGGA | 1309 & 1310 |
| AXIN1 | GACCAAGCCAGCCACCAA | GGTCGGCAGGTATCCAGA | 1311 & 1312 |
| AXIN2 | CCAAGGCTCCGGAAACCA | TGGAGACGAGCGGGCAGA | 1313 & 1314 |
| AXL | CCAGCCAGACCCTAAGGA | AGGGGTTGTGGAAGGGCA | 1315 & 1316 |
| AZGP1 | CACTGGGCTGTCCAAGCA | CAGAGTCCCATGGGCTGA | 1317 & 1318 |
| AZI1 | GGACAAGTACGAGGCCGA | GCCCTTCAGCTCCGAGCA | 1319 & 1320 |
| AZU1 | TGTGACCCCCGAGGACCA | GAGAACACCATCGATCCA | 1321 & 1322 |
| B2M | CATCCAGCAGAGAATGGA | TGGTTCACACGGCAGGCA | 1323 & 1324 |
| B3GALNT1 | CCCAATGCCAAGTACGTA | ATAACCCAACCCACTGCA | 1325 & 1326 |
| B3GALNT2 | AACCGGAAAGTGGCAGGA | CTATGGCAGCCATCCAGA | 1327 & 1328 |
| B3GALT4 | CCGCGTATCAGAGGAGCA | GGGTAGTGGGTGGCACCA | 1329 & 1330 |
| B3GALT5 | AGCTCCACTCCCAGCCGA | GAGCCTGCCAGTAGTCCA | 1331 & 1332 |
| B3GALT6 | AGCAGAGCCTGGAGGACA | ACACGTAGGACAGGCGCA | 1333 & 1334 |
| B3GALTL | TCACGGGAGGAGGAGGAA | AGCACATTCCCAGGACCA | 1335 & 1336 |
| B3GAT1 | AGATGCGCAGCACCAGGA | ACACCGTCTTCCAGCCGA | 1337 & 1338 |
| B3GAT2 | GATGCGAACCACCCGCAA | CAGCCGGTGTACCAGCCA | 1339 & 1340 |
| B3GAT3 | CAACACCTACAGCCGGGA | ACAGCAAGGGCAGGGCCA | 1341 & 1342 |
| B3GNT1 | AGCGAGGGGCTGTGGAGA | TTTCGAAGGCAGGCACCA | 1343 & 1344 |
| B3GNT2 | CCACCCTATGCAGGGGGA | TCTCTGGAACGAGGCCGA | 1345 & 1346 |

FIG. 1 Cont.

| | | | |
|---|---|---|---|
| B3GNT3 | GGAGACAAGGTGCGCCAA | CGGGACAGCAAGAAGCCA | 1347 & 1348 |
| B3GNT4 | GCTGAGCCCTATGCACCA | TATGGGGCCAGCTGCACA | 1349 & 1350 |
| B3GNT7 | GCTCTACCCGATCGACGA | GGTTCCGGGAGATGCCGA | 1351 & 1352 |
| B3GNT8 | CTTGCGAGCTCAGGACGA | CCGGCAATGACGTAGCCA | 1353 & 1354 |
| B3GNT9 | GCTCACGCCCGAGCCTCA | AAGGGGCCTGCAGCGACA | 1355 & 1356 |
| B3GNTL1 | GAAAGACCCAAGCCCCGA | GCTTCACGCAGATGACGA | 1357 & 1358 |
| B4GALNT1 | GACTGACAAGGTGCGCGA | CACCACGACGTCGGAGCA | 1359 & 1360 |
| B4GALNT3 | GCTGCTTCCAGAGCAGGA | GCCAGCCTCGTGCAGACA | 1361 & 1362 |
| B4GALNT4 | CCTGAGACGAACCGGGAA | GGATGTGCAGGTCGCAGA | 1363 & 1364 |
| B4GALT1 | GGTGGCGACTCCAGCCCA | GCCCACAAGCAGCGGGGA | 1365 & 1366 |
| B4GALT2 | CCGCATGATCAAGCACGA | TGGTACCGCACTGACCCA | 1367 & 1368 |
| B4GALT4 | CGTCATCCACCAGGCTGA | TCGGGTACCAGGTCCACA | 1369 & 1370 |
| B4GALT5 | TGAAGGGCCCAATAGACA | GGCGGTTCCGGAAGGGGA | 1371 & 1372 |
| B4GALT7 | GCTCAACCAGGTGGACCA | AAGGGCCCAGCCTCAGGA | 1373 & 1374 |
| B9D1 | CCTACGGCTGGCCACAGA | GGCCTTCACCCTGAGCCA | 1375 & 1376 |
| BAAT | GCTGAAGAGACATGGGAA | GGTCGTTGAGGCACAGCA | 1377 & 1378 |
| BACE2 | GGGTGGGCTTCGCAGCGA | AAGGAGGATGGCTCCACA | 1379 & 1380 |
| BACH1 | CGGACACCGAAGGAGACA | CGACAGCGCTGTGCAGCA | 1381 & 1382 |
| BACH2 | AGACATCCAGAGCCCCGA | GCTCCAAGCAGCAGGGCA | 1383 & 1384 |
| BAG1 | GACTGTCACCCACAGCAA | CTTCAACAACCTGGGCCA | 1385 & 1386 |
| BAG3 | GCCCATGACCCATCGAGA | GGGACAGCAGAAGGGCCA | 1387 & 1388 |
| BAG4 | GGACCGACTGTACGACCA | AGAGCCACTGCTAGGCCA | 1389 & 1390 |
| BAHD1 | TGTGCCACCTGCAGCAGA | AGCCCCAACAGGTACCCA | 1391 & 1392 |
| BAI2 | GCAGATGCCAGCTCAGGA | CTGCACAGCCGATCACCA | 1393 & 1394 |
| BAI3 | CTTGCTAAGGGGCAGCGA | CACCATCAGATGCAGGGA | 1395 & 1396 |
| BAIAP2 | GTATGCGGGTGAAGGCCA | TCAGGCACCAGCAGGGTA | 1397 & 1398 |
| BAK1 | CCCGGTGGATTGCACAGA | GAACCACACCCAGAACCA | 1399 & 1400 |
| BANF1 | CCGAGACTTCGTGGCAGA | TGCCCAGGACTTCACCAA | 1401 & 1402 |
| BANK1 | CCCACACCCCGACCCACA | CAGTTAGACAGCCCCTGA | 1403 & 1404 |
| BAP1 | GCAGAGAGAAGACGGGGA | CCACTAGGTTGGCCAGCA | 1405 & 1406 |
| BARD1 | TGCAGCCAAGAATGGGCA | GCAGTGGCTAGCTGAGGA | 1407 & 1408 |
| BARX2 | GCACAGGAACCGAAAGCA | GGGGTTCCGAAGAGGGTA | 1409 & 1410 |
| BASP1 | CAGCAAGGAGGAAGGGGA | AGAGGGGGCAGCCTCCGA | 1411 & 1412 |
| BAT3 | GCTGGCACCACCAACACA | ACACCAGGCATCGCCACA | 1413 & 1414 |
| BATF | GACAGAGGCAGACACAGAA | GTTCAGCACCGACGTGAA | 1415 & 1416 |
| BATF2 | CCAAACTGCCCCTCCACA | GCAGACGTGCAAGCCCCA | 1417 & 1418 |
| BATF3 | CGGGAAGCTGACAGAGGA | GCAGAGCAGCAGCGGGCA | 1419 & 1420 |
| BAX | GGGCTGGATCCAAGACCA | TGAGTGAGGCGGTGAGCA | 1421 & 1422 |
| BAZ1A | GTGCAGCTGCCAAAACCA | ACGGGCTAGCTGTGCACA | 1423 & 1424 |
| BAZ1B | CGAGGGCTCAGACACAGA | TGAGGATCCGGTGGCACA | 1425 & 1426 |
| BAZ2A | GGTAGAGGAGCTGGAGCA | GGTGCTCACAGTAGGCCA | 1427 & 1428 |
| BAZ2B | CCTCAGTCTCAGCCACCA | AACCACACCAGTGGGCCA | 1429 & 1430 |
| BBOX1 | CAGAGCTCCAGCTACCCA | CTTGAGGGTGGAGAGCCA | 1431 & 1432 |
| BCAM | GGATTACGACGCGGCAGA | GCACGGAGCAGTTCACGA | 1433 & 1434 |
| BCAN | CACACCCGAGGAACAGGA | GGACGCCATCCGACCACA | 1435 & 1436 |
| BCAP29 | AATGGGCTGCAGTGGCAA | GCCATCTCTGAGGAGGAA | 1437 & 1438 |
| BCAP31 | GGCGGAGAGTGCTAGTGA | ACCTCAGCATTCCCGACA | 1439 & 1440 |
| BCAR1 | GGCAATGCTGCCCACACA | CCTGACCATGTGCCACCA | 1441 & 1442 |
| BCAR3 | CGCTGAGGGGATCAGACA | TTGAGCCAGGCAGAGGGA | 1443 & 1444 |
| BCAT1 | GGCACATCAGTGGGGTGA | ACAACACAGGCTGTACCA | 1445 & 1446 |
| BCAT2 | TCACCGAGGTGGGAACCA | GTCTGACCACTCCAGGCA | 1447 & 1448 |
| BCHE | TCCTGAGGCTCCAGGGAA | GATGTTACCGCCCAAGGA | 1449 & 1450 |
| BCKDHA | CCACAGCACCAGTGACGA | ACCAGCCTTGGCTCAGCA | 1451 & 1452 |
| BCL10 | GAAGGAGAATCCAGCACGA | GAGCCCCTGGGTCCCCA | 1453 & 1454 |
| BCL11A | CAGGGACACTTGCGACGA | AGAGAAGGGGCTCAGCGA | 1455 & 1456 |
| BCL11B | TGAACCCCTTCCAGCCCA | GCCGCAGAACTCGCACGA | 1457 & 1458 |
| BCL2 | TGAACCGGCACCTGCACA | AAGCTCCCACCAGGGCCA | 1459 & 1460 |
| BCL2L1 | AGCCGAAAGGGCCAGGAA | GACTGAAGAGTGAGCCCA | 1461 & 1462 |
| BCL2L10 | CCGCCAGGTTACGGCAGA | GCGTCCCTGCGAAGGTCA | 1463 & 1464 |
| BCL2L11 | CCAAGCAGCCGAAGACCA | TTCTCCACACCAGGCGGA | 1465 & 1466 |
| BCL2L13 | GCACTTCCTGAAGCCCCA | GTTCCAGTGCGGGGACCA | 1467 & 1468 |
| BCL2L2 | GGTGGGACAAGTGCAGGA | AACTCCGCCCAGCCCCCA | 1469 & 1470 |
| BCL3 | GGTGCCGACATCGACGCA | GGACCAGCGTGCGCACCA | 1471 & 1472 |
| BCL6 | GTTCAACCGGCCAGCCAA | TAAGCACATGGGCACGGA | 1473 & 1474 |
| BCL7A | CGACGGCACCGAGGCCAA | CTCTGCGGCCAGACCCGA | 1475 & 1476 |
| BCL9 | GCCCACCCTGATGAGCAA | TCATGCCTGGAGAGCCCA | 1477 & 1478 |
| BCLAF1 | TTCAGAGAGGAAAGCCCA | CAAGAGGAACAGGTGCCA | 1479 & 1480 |
| BCOR | CACTGAGCATGGACCGCA | CTCTGAGCCCAGTCCACA | 1481 & 1482 |
| BCR | GCAGCAAGGCTACGGAGA | TGTGCACCCTGAAGGCCA | 1483 & 1484 |
| BDH2 | CAACCAAGGCAGCCGTGA | TGGGCACACACAGTTGCA | 1485 & 1486 |
| BDKRB1 | GGTGGCCATCAGCCAGGA | AGGCCTCATGGGGGAGGA | 1487 & 1488 |
| BDKRB2 | CTCCAGCTGCCAGGACGA | GGAAGCGCTTGCCCACGA | 1489 & 1490 |
| BDNF | CCAGAAAGTTCGGCCCAA | GCCGGACCCTCATGGACA | 1491 & 1492 |
| BEND5 | GCTGGTACAACAGGCCAA | ATGGCGGGACCGCTGCCA | 1493 & 1494 |
| BEST1 | CTCGGATGGAGCCGGACA | AGGCCTAGGAAGCGGCCA | 1495 & 1496 |
| BFSP1 | AAGAGCCTGAGACCCCCA | ACTCAGGAGAGGGCTCCA | 1497 & 1498 |
| BGLAP | CAGGAGGGAGGTGTGTGA | GGGCCGTAGAAGCGCCGA | 1499 & 1500 |
| BGN | GGGCCTACTACAACGGCA | CAGGCGGTCAGTGACGCA | 1501 & 1502 |
| BHLHE40 | CTCAACGCCTCTGCCGCA | GACAGAAGAGTCGACGGA | 1503 & 1504 |
| BHLHE41 | CGCGCTGCTGAGACCCGA | GGATGCCGGGGTATAGCA | 1505 & 1506 |
| BID | GGAGGACCGGAACAGGGA | AGCAAGGACGGCGTGTGA | 1507 & 1508 |
| BIK | CATCGGGGACGAGATGGA | GGGATCTCCAGAACCTCA | 1509 & 1510 |

FIG. 1 Cont.

| | | | |
|---|---|---|---|
| BIN1 | CCCATCTCAGCCAGCAGA | CTGGGAAGGTCTCCACCA | 1511 & 1512 |
| BIN2 | CAGCCCAAGGGGAAGACA | CAGGCTGGTAGAGGCTCA | 1513 & 1514 |
| BIRC2 | GAAAATGCTGACCCACCA | AAGCCCATTTCCAAGGCA | 1515 & 1516 |
| BIRC3 | CATCAGACAGCCCAGGAGA | CACGGCAGCATTAATCACA | 1517 & 1518 |
| BIRC5 | TTCTCAAGGACCACCGCA | GGGCAGTGGATGAAGCCA | 1519 & 1520 |
| BIRC7 | CCACACAGGCCATCAGGA | CCGGAGCAGGAACTGACA | 1521 & 1522 |
| BLK | AGGGATGAGCAACCCCGA | CCAGCACCGACTGCAGGA | 1523 & 1524 |
| BLM | GGCGAGAATGTGACACCA | CAGATAACCTGACAGCCA | 1525 & 1526 |
| BLMH | CACTTATGACCCACGCCA | GCTCTAACACAGCTAGCA | 1527 & 1528 |
| BLNK | CCACCCTTCAGCAAGACA | TCTTCCACGGGGACCACA | 1529 & 1530 |
| BLVRA | AGTCTTGCACGAGGAGCA | TGCCGCTGAATGCAGGGA | 1531 & 1532 |
| BLVRB | GGAACATTGTGGCAGCCA | TGGTAGGGTCCCAGAGCA | 1533 & 1534 |
| BMF | CCAGCCTCCCCCAGCCAA | TGGGCAAGACTGCTGGGA | 1535 & 1536 |
| BMI1 | TGGGAGTGACAAGGCCAA | GAGTACTGGGGCTAGGCA | 1537 & 1538 |
| BMP1 | CATTGCCCAAGCCCGCAA | GCCTTCCTCCAGAAGCCA | 1539 & 1540 |
| BMP10 | CTGCCCGAATCAGAAGGA | CGTATCCAGGCGGAGCGA | 1541 & 1542 |
| BMP15 | GAGAACCCGACAAGCAGA | GCGTAGTACTCGGAGACA | 1543 & 1544 |
| BMP2K | GACAAAGACCAAAGGCCA | CCGAATTCACCAGGAGCA | 1545 & 1546 |
| BMP3 | GCCAGCTGCCAAAGAGGA | AGAGGCAGCAAGACCCCA | 1547 & 1548 |
| BMP4 | GGGCACCTCATCACACGA | ACCTCAATGGCTAGCCCA | 1549 & 1550 |
| BMP5 | TGGGATGGCAGGACTGGA | CACATGAGCGTACTACCA | 1551 & 1552 |
| BMP6 | AGACCTGGGATGGCAGGA | CACAGCACGGTTTGGGGA | 1553 & 1554 |
| BMP7 | GACGCCCAAGAACCAGGA | GAGTTCAGAGGGAAGGCA | 1555 & 1556 |
| BMP8A | TGGCGACGACGACGAGGA | CCGCCTCCCCAGCCGGGA | 1557 & 1558 |
| BMP8B | ATGCCACCAACCACGCCA | CACAGCACGCCTTGGGGA | 1559 & 1560 |
| BMPER | CCTGCCAGAGAGAGGGCA | GTGGCACCCAGCAACGCA | 1561 & 1562 |
| BMPR1A | CCCAAGGAAAGCCCGCAA | ACAGCAAGGCCCAGGTCA | 1563 & 1564 |
| BMPR1B | CCACCACCCTAGACGCTA | ATTTAACAGCCAGGCCCA | 1565 & 1566 |
| BMPR2 | TCACTGCAGATGGACGCA | CAGTCAGCCTCATGGACA | 1567 & 1568 |
| BNC1 | CAGCAAGCCTCCCAGACA | CTCGCTCAAGGGGCCAGA | 1569 & 1570 |
| BNC2 | TGGCCACCCATGAGCCCA | TTGACCACAGCTCCACCA | 1571 & 1572 |
| BNIP3 | CTCAGCATGAGGAACACGA | CAATCCGATGGCCAGCAA | 1573 & 1574 |
| BNIP3L | GCACACCAGCAGGGACCA | GGACCAGTCTGATACCCA | 1575 & 1576 |
| BOC | CGACGACTCCACTCACCA | CAACTGGCACAAGGCCCA | 1577 & 1578 |
| BOD1 | CTGGCGCTACTGGGGCCA | AGCTGCTCCACGATGAGA | 1579 & 1580 |
| BOK | TGCGCAAGACCCTGGCAA | AGAAGGCAGCCTTCAGGA | 1581 & 1582 |
| BOLA1 | GCCTGGCAGTGAGACTCA | GCCAGCGCATGGACCGGA | 1583 & 1584 |
| BOLA2 | TGGAGGACACGACCCTCA | CTAGGCACGCGTTCACCA | 1585 & 1586 |
| BPGM | CCCGCCTCCCATTGAGGA | GCAGTTGATCCAAGGGCA | 1587 & 1588 |
| BPHL | AGCTGCATTACCAGCAGA | CCCAGGCGACCACCGTGA | 1589 & 1590 |
| BPI | TGGCACCTCCAGCAACCA | AGTAGTCTGAGAGGCCCA | 1591 & 1592 |
| BPNT1 | TCCCTGCTGGGAAACACA | TGGAGCACAAGTATCCCA | 1593 & 1594 |
| BPTF | GGAAGACGACGACGACGA | ATAGGAGAACGAGGCCGA | 1595 & 1596 |
| BRAF | ACCTCAGCGAGAAAGGAA | TGCCACATCACCATGCCA | 1597 & 1598 |
| BRCA1 | GAGCAGGGAGAAGCCAGA | GGGTCAGGCCAGACACCA | 1599 & 1600 |
| BRCA2 | ACCTCTTGAAGCCCCAGA | AGCGATGATAAGGGCAGA | 1601 & 1602 |
| BRD1 | GCCTGCAGTCTCAGCGAA | GCAGCAGCTCGATCAGCA | 1603 & 1604 |
| BRD2 | AGGAAGAGAGCAGGCCCA | TATGCACAACTCGGCCCA | 1605 & 1606 |
| BRD3 | CGTTCTCAGCAAGCGGGA | GCTCCCAGACTCGGAGGA | 1607 & 1608 |
| BRD4 | GTTCCAGAGCCTGACCCA | GGCCTCCCGACATCCACA | 1609 & 1610 |
| BRD7 | GCCTGAAGATGAAGGCCA | ACTTCAACTGGAACGCCA | 1611 & 1612 |
| BRD8 | AGCGGCCAGCCTAGAGGA | AAGCAGGGCTGCTGGGGA | 1613 & 1614 |
| BRD9 | GGACCCTGACGACAGCCA | CGTTGGACAGGGAGCTGA | 1615 & 1616 |
| BRE | CCCAGAACTGCCTCCCGA | GGCGGGAGCTCTCCCGGA | 1617 & 1618 |
| BRF1 | GTCATACCACGCCGACGA | TCATCGCCATCACAGCCA | 1619 & 1620 |
| BRF2 | GCAGAAGTGGAGACCCGA | GGTGGCAAGAGAAGGGCA | 1621 & 1622 |
| BRMS1 | TGAGCGACGCCGCAGCGA | CCTCCAGCCGCAACCGCA | 1623 & 1624 |
| BRP44 | GAGGCCGTTGTACAACCA | ATCAGCCAATCCAGCACA | 1625 & 1626 |
| BRP44L | ATCAGTGGGCGGATGACA | AACAGAAGCCAGTTCCGA | 1627 & 1628 |
| BRPF1 | TCACCAACCGCCTGACCA | CGTAGCAATGGGACCCCA | 1629 & 1630 |
| BRPF3 | GCAGTGGCTTCCAAGGGA | TCGCACGGTCATAGGCCA | 1631 & 1632 |
| BRS3 | CAAGGCGGAGCGGCCTGA | ACTACACCCAGTGAACGA | 1633 & 1634 |
| BRSK1 | CCGACGTCCTAGAGAGCA | TCCCGTGACGGCTCAGCA | 1635 & 1636 |
| BRSK2 | ACCAGAGTCGTCCCCAGA | GACTGGGAATCGACAGGA | 1637 & 1638 |
| BRWD1 | CAGAACACAAGCACAGGCA | TCCACCTGCGCAGCCCA | 1639 & 1640 |
| BRWD3 | ATACCCCGACGTTCCCCA | CACAGTGTGGGTGGGCCA | 1641 & 1642 |
| BSCL2 | AGCTGTCCGAGGAGGAGA | GTCTCTAGGACAGGGGCA | 1643 & 1644 |
| BSG | CCTGAACATGGAGGCCGA | GATGCCCAGGAAGGGCCA | 1645 & 1646 |
| BST1 | CGTGGACCACAGCACCCA | CTGGAAGCCAGCACCAGA | 1647 & 1648 |
| BST2 | GCAACAAGAGCTGACCGA | GGGAAGCCATTAGGGCCA | 1649 & 1650 |
| BTBD3 | CCAACTCCAGCAGCACCA | GGCAACCGTTGAGTCCCA | 1651 & 1652 |
| BTBD9 | GGGACACACAACACAGCA | CGAGCTGCTGACCGGCCA | 1653 & 1654 |
| BTC | CCACACAATCAAAGCGGA | GGCCACCACGAAGCGGCA | 1655 & 1656 |
| BTD | TGGCTGGGAGAATGACCA | CTCTCATACAAGCGCCCA | 1657 & 1658 |
| BTG1 | AGCGGATTGGACTGAGCA | AGCACACAGATGGAGCCA | 1659 & 1660 |
| BTG2 | CGGACTCAGCCAGCCCCA | ATGCGGTAGGACACCTCA | 1661 & 1662 |
| BTG3 | CGGTGACTGCAGCCGCAA | GAGGAGGTACCCATGTCA | 1663 & 1664 |
| BTK | ATGGAGAGGCCAGTACGA | GTAGTTCAGGAGGCAGCCA | 1665 & 1666 |
| BTLA | CGACCCTCCAAGGACGAA | CAGGCAGCAGAACAGGCA | 1667 & 1668 |
| BTN2A1 | CTAGAGGGTGGTACCCAA | TCACAGCCGTGGTGACCA | 1669 & 1670 |
| BTN2A2 | AGACACCGCTCATCCCGA | AGACCCCCACAGTCCACA | 1671 & 1672 |
| BTN3A1 | GGACTCTAACTGAGCCCA | TGCGATCCATCCACAGCA | 1673 & 1674 |

FIG. 1 Cont.

| | | | |
|---|---|---|---|
| BTN3A2 | GAGAGGCGGCTCCGGGGA | GCAGCAGCAAGATAGGCA | 1675 & 1676 |
| BTN3A3 | AGCCCACTGCCCTGACCA | GGTGGGCAGGGAGAAGCA | 1677 & 1678 |
| BTNL2 | GTGGTTCCCACAGCCCCA | AGTGACGTCCACAGCGGA | 1679 & 1680 |
| BTNL8 | AGAGACGGCTCACCCGAA | GTCCACATCATCCCGGCA | 1681 & 1682 |
| BUB1 | AACCCACAGGAGCCAGGA | GACGCAAGTTGTGCAGCA | 1683 & 1684 |
| BUB1B | GCCCTTGGAACACAGGCA | TGGGAAGCACAGCGGGTA | 1685 & 1686 |
| BUB3 | GGAACAGCAGGCCGCAGA | AACGCTCGTATGCAGCGA | 1687 & 1688 |
| BYSL | ACAGCGGTGCCAACAGCA | GGAGGCACTGGTGCCACA | 1689 & 1690 |
| BZRAP1 | TTGGTGGAAGCAGCCGGA | GGCCCTCAATTACGGGGA | 1691 & 1692 |
| C10orf10 | CTGCGAGACATCACCGCA | CAGTCCAGGGGGTCCACA | 1693 & 1694 |
| C10orf137 | CGAGGGGCTAGAGAAGCA | TCATGGCAGCATCGGACA | 1695 & 1696 |
| C10orf2 | CGACCAGGAGACCAGCAA | ACTTGTGCCAGGCAGGCA | 1697 & 1698 |
| C10orf25 | AGCTCCTGCAAGATGGGA | GGCCAGGATGGCTGAGGA | 1699 & 1700 |
| C10orf54 | CGAGGCCAAAGTCAGGCA | AGGGACAGGGTCCAGGGA | 1701 & 1702 |
| C11orf10 | ACCAGCCCAGTGAACCCA | AGCAGGAAGAGGACTCCA | 1703 & 1704 |
| C11orf24 | CACCGGAGCAGGTAGAGA | GGGGCTCAGTGGTGACCA | 1705 & 1706 |
| C11orf30 | GCCAGGTGGAGCAGCCAA | AGAGGCCTGAATGGGAGA | 1707 & 1708 |
| C11orf45 | GGCAGGATGTGCATGCCA | TGTGGCAGACCTCACACA | 1709 & 1710 |
| C11orf80 | CAGGGCACTGAGGACGCA | GCCCTGGCAGAGCGCAGA | 1711 & 1712 |
| C11orf82 | CACCTCAGCTGCACCCTA | GGTGACCAAGCACTTCGA | 1713 & 1714 |
| C12orf10 | CACTGACCAGGCTGGACA | TGGACGAAGATGCAGCCA | 1715 & 1716 |
| C12orf35 | CAGTGTGACCTGCAGGCA | CCAATGCACAGCAGTGGA | 1717 & 1718 |
| C12orf39 | CTACCTGAAAGGGGCACA | CGGCAGTGGCCGGTCGGA | 1719 & 1720 |
| C12orf49 | CGTCCCTAGCACGAAGCA | CGGCTGCCCGGTTGAGGA | 1721 & 1722 |
| C12orf51 | GTACGACGAGGAGACGCA | AGGGTCACTTCGGCCACA | 1723 & 1724 |
| C12orf63 | TGATGGAAGCTGAGGACA | GCAGAGCAACTGCAGCCA | 1725 & 1726 |
| C12orf73 | CAGGTACTACCGACCGGA | CGGCTAAACATCCACTGAGCA | 1727 & 1728 |
| C12orf76 | GGCCCATCCTACCTGCAA | GGCTGTCACCGACGCCGA | 1729 & 1730 |
| C13orf26 | AGATGACCCCAACTGGGA | GGCGAATTAAGGCAGGCA | 1731 & 1732 |
| C14orf102 | GCTCCCAGAGTTGGACCA | GAGAGTGCCTCTCGCAGA | 1733 & 1734 |
| C14orf159 | AGGCTGTGAGGAGGCACA | TGTAGAGTGCGCAGGCCA | 1735 & 1736 |
| C14orf49 | TCAGGGAAGAGGACCGCA | GGCCATTGTAGCGCAGCA | 1737 & 1738 |
| C14orf80 | CGAGAGGATGGGGCAGCA | TAGCACCGCCTCCAGGCA | 1739 & 1740 |
| C14orf93 | CCCAGAGACAGGACCAGA | AAGGCACTGTCCAGCGCA | 1741 & 1742 |
| C15orf2 | CCCAACCTGTGCAGACCA | GGTCAGCAGGAAGAGCCA | 1743 & 1744 |
| C15orf52 | CAGTGGCTTCCACAGCCA | AGCCCTCTGGCCAAGACA | 1745 & 1746 |
| C15orf55 | GCAGACAGGGCCAAAGGA | CCTGAGGCATGGTGAGGA | 1747 & 1748 |
| C15orf57 | GCTGACTCTACAGCCACA | ACAGCTGGCTGGACAGCA | 1749 & 1750 |
| C16orf89 | CCTACCCTACCCGGGACA | GCCTGAGCAACAGAGCGA | 1751 & 1752 |
| C16orf90 | CCCGATTGCCCAGGGACA | GGCCTGAGCCTAGAAGGA | 1753 & 1754 |
| C17orf67 | GCGGGAATACATGCACCA | GCAGTGAGGGTTCAGCCA | 1755 & 1756 |

| | | | |
|---|---|---|---|
| C18orf1 | TCAGCCGCTTCCAGCCCA | TTCACCGTCGGACAGGGA | 1757 & 1758 |
| C18orf34 | GCTCTCAGAGAGAAGGCA | GCACAGCTGTGACGTCGA | 1759 & 1760 |
| C18orf54 | CAAGGGCAAAGAGTGCTA | AGGGCTTCAACAGGACCA | 1761 & 1762 |
| C19orf10 | AGGAGGGACCAATGAGCAA | AGGCCATGGCGTACTCAA | 1763 & 1764 |
| C19orf26 | CGGTACCAGGAGCACCAA | CGGGTGAGGAACTGCAGA | 1765 & 1766 |
| C19orf33 | TCCCAAGCTCAGTCCCCA | GCAGCGTGGGACTTCACA | 1767 & 1768 |
| C19orf47 | CCAGGTCACCAGCACCAA | ACCAAGGCCCTCGCTGGA | 1769 & 1770 |
| C19orf70 | CAGATACCCCAGCTCCCA | GAGCTGACATCACCGTCA | 1771 & 1772 |
| C1GALT1 | AGCAGGAGATTCCAGAGA | TGCAAGATCAGAGCAGCA | 1773 & 1774 |
| C1orf162 | CCGACACTGAAAGACAAGGCA | CAGTAGAACCCCAGCACA | 1775 & 1776 |
| C1QA | GCTGCAGCAGGGTGACCA | AGATGAGGAAGCCGCTGA | 1777 & 1778 |
| C1QB | AGCTGGAGCAGGGGGAGA | AAGAGCAGGAACCCGGAA | 1779 & 1780 |
| C1QBP | ACGAGGCTGAGAGTGACA | CCACCCCTCGGTCGGCAA | 1781 & 1782 |
| C1QC | GTTGCAGGTGGGCGAGGA | GAAGAGCAGGAAGCCGGA | 1783 & 1784 |
| C1QL1 | CGTGCAACATTCCCGGCA | GCGTCCTGGGCAATAGCA | 1785 & 1786 |
| C1QL2 | CAGCGCCATTGCACAGGA | CCGTGAGCCTTCCCGCCA | 1787 & 1788 |
| C1QL3 | ACCACTACGACCCCACCA | TGCCGTCCCCTCCGCGCA | 1789 & 1790 |
| C1QL4 | CAGCGCCATTGCTCAGGA | CCCACGTCCAGGTGCAGA | 1791 & 1792 |
| C1QTNF1 | CGTGCACACCTGGAACCA | TGTAGAGGCGTACCCACA | 1793 & 1794 |
| C1QTNF2 | ACAACGGCCAGTACCGCA | CACCCTGCTTGAGAGCCA | 1795 & 1796 |
| C1QTNF3 | CGGAGGACTACCCCCAGA | GCTCCCCTCGAGGCCCCA | 1797 & 1798 |
| C1QTNF4 | GCGAGATGCAGAGCCAGA | GGAAGCCGGAGAAGGTGA | 1799 & 1800 |
| C1QTNF5 | CGACGCCGTCACCGGCAA | CCTCAGGCTCCAGCCTCA | 1801 & 1802 |
| C1QTNF7 | CCAGAGGGAGAGAAAGGA | GAGCACGATGCTTCCACA | 1803 & 1804 |
| C1QTNF8 | GGAGCTGGTGAACCTGGA | GCACGTTGAGGCTGAGGA | 1805 & 1806 |
| C1QTNF9 | AAGGAGAAGCTGGACCCA | TCAGCACCGTGAGCCCCA | 1807 & 1808 |
| C1QTNF9B | ACCAGGCCTCTGGCAGCA | ACAGAAGGAACCCTGTGA | 1809 & 1810 |
| C1R | CCCGGACTACCGTCAGGA | GCTACGGGCAGACGGACA | 1811 & 1812 |
| C1RL | TGGAGCTGCAGCACAGCA | CCCTGGGAGCTACAGGCA | 1813 & 1814 |
| C1S | CTGGAGGAGAGAAGGGCA | ACCCGTGTGTAGAGCCCA | 1815 & 1816 |
| C2 | GGAGGTGGTGACAGACCA | GTCAGCAGAGCCAAGGCA | 1817 & 1818 |
| C21orf33 | AAGGTGGTCACGACCCCA | CCAGCACCTTCCTCACCA | 1819 & 1820 |
| C22orf15 | GAGAGGACATGGCCTCCA | CACAGAGGAGAGGCCTGA | 1821 & 1822 |
| C22orf46 | CACCCATGTCCAGGCCCA | CAGGCTCCAGTGACACCA | 1823 & 1824 |
| C2CD2 | AGCCTTCTGGGCCACAGA | ATCAGAGCTCAGCGGGGA | 1825 & 1826 |
| C2CD3 | GGGAGGAGAGGCTAGAGA | AGTCTGGCCAGGTCCACA | 1827 & 1828 |
| C2orf40 | GGCAGCTGTGGGACCGGA | CTCCGGGGACCAATTGCA | 1829 & 1830 |
| C2orf44 | GCCCTATGGAGTCAAGCA | ACCACCAGCCTCAGGCCA | 1831 & 1832 |
| C2orf69 | GGACCCAGCGAAGGAGGA | TCTGCACATCCCCAGGGA | 1833 & 1834 |
| C2orf78 | CCCAACCCAGTTCAGCCA | CGGAGACTGGTCACAGCA | 1835 & 1836 |
| C3 | CCATCACCACGTGGGAGA | CAGAGTAGGGTAGCCGCA | 1837 & 1838 |

FIG. 1 Cont.

| | | | |
|---|---|---|---|
| C3AR1 | CAACACCCCTCGTGGCAA | AGACAGCCACCACCACCA | 1839 & 1840 |
| C3orf58 | AGACCAAGGACTCGGGCA | GCTCGGGGTTGAAGGCCA | 1841 & 1842 |
| C4A | GATGAGGGTGCAGAGCCA | ACCAGTGACTGAGCCCCA | 1843 & 1844 |
| C4B | TCCCGAGACCAAGGACCA | CGTGACAACCAAGCCGCA | 1845 & 1846 |
| C4BPA | TAGGCCGACAAAAGAGGA | GGGCAACATAACGCCTCA | 1847 & 1848 |
| C4BPB | GAGGACCACACCTGGGCA | CCACTCCCCATCAACGCA | 1849 & 1850 |
| C4orf48 | TGCGGAAGACAGCCTGCA | CAGCAGGCACACAGGGCA | 1851 & 1852 |
| C4orf50 | GAGTGGCCAGCACAGACA | GGGAGACCTGGTTCCACA | 1853 & 1854 |
| C5 | CCTAACACTGGTACGGCA | GTCAGGCCCTCAATGGCA | 1855 & 1856 |
| C5AR1 | TCGAGGCCAAGCGGACCA | ACCCCAAGCCACGGCACA | 1857 & 1858 |
| C5AR2 | GGCCGCTGGGCACAGCCA | TACAGGAAGAGCATGGGA | 1859 & 1860 |
| C5orf42 | GGCTTGCACCTCAAACCA | TCAGACACGCTGTCCACA | 1861 & 1862 |
| C5orf46 | AGACGACAAGCCAGACGA | AGGATGAACTCGACTGCA | 1863 & 1864 |
| C6 | GACCCACCCTCTCAGGGA | GGTACTCCAGGAAGACCA | 1865 & 1866 |
| C6orf103 | ATCAACTCGGCGCACGGA | CACTCCACTCTGGCCAGA | 1867 & 1868 |
| C6orf120 | ACCCCTCCCACCTGGAGA | CGAACGGGTGCTGCTCGA | 1869 & 1870 |
| C6orf15 | ATCGGTATCCAGGAGGCA | AAGAGCCAGGAGGGCGGA | 1871 & 1872 |
| C6orf170 | CCAGCGAGGACCAGGCGA | CACTCCAGGGAAGGGGCA | 1873 & 1874 |
| C6orf25 | ACCTGGACCAGGAACCGA | GCATAGATGGTGGAGGCA | 1875 & 1876 |
| C6orf58 | GACAGGCAGATTAGCTGA | ACACCAGAATCAACCGCA | 1877 & 1878 |
| C7 | AATGTCAGCGCTGGGAGA | TCTCAGCTGAGGCAGGCA | 1879 & 1880 |
| C7orf43 | GCAGCCTTCCCGAAGCCA | GGCCAACAGGAGAGGCCA | 1881 & 1882 |
| C7orf57 | CTGCCTGGGACTCGGAGA | CTGGCAGGGAGTAGGCCA | 1883 & 1884 |
| C7orf69 | CTGAGGCCTCCCAAGTCA | GCTCTGGCAGGCCTCCAA | 1885 & 1886 |
| C8A | GATGCAGCCTATCCACGA | GGAGCTCCAGCAACTCCA | 1887 & 1888 |
| C8B | GGCGGACCTGATGCAGGA | GGGAGCACAGTGGCAGGA | 1889 & 1890 |
| C8G | TGAGCAGCGGGTCCAGGA | AGCCTCGCAGAAGCCGTA | 1891 & 1892 |
| C8orf4 | GCAAAGCGAAGCCACCAA | CGAAGTGGTAGCCATGGA | 1893 & 1894 |
| C8orf46 | ATGGGCACAGAGAAGGGA | CCGGGGACGCCGCAGGAA | 1895 & 1896 |
| C9 | CACAGAGCCCTGTGAGGA | CATTACACCGAAGTCGCA | 1897 & 1898 |
| C9orf3 | GAAGCGCAGGGAGAAGGA | TCACACCACCGATGGCGA | 1899 & 1900 |
| C9orf47 | CGACCGAGCAGGACCCCA | GGGGCCACCGGCATCCTA | 1901 & 1902 |
| CA1 | TTGGTGAGGCCAACCCAA | AGTCAGAGAGCCAGGGTA | 1903 & 1904 |
| CA10 | CCTGCTCAGCCAGAACCA | GTGGCTGGACAGGCCTGA | 1905 & 1906 |
| CA11 | GCGACACCATCACTCGCA | GCTCAGGAGTCTCAGGGA | 1907 & 1908 |
| CA12 | CTGCACACACATGGACGA | GAATGCCAGCCAGGGCCA | 1909 & 1910 |
| CA14 | TGCACAACAATGGCCACA | TGCAGGTGGAGCTGGGCA | 1911 & 1912 |
| CA2 | CAAGGGAGGACCCCTGGA | CCTAGAACGGCCAGTCCA | 1913 & 1914 |
| CA4 | CTACGATGGCAGAGAGCA | GCTGAATGGGCTCCCGGA | 1915 & 1916 |
| CA6 | TCAGCGGCTCTGAGCACA | CCTCAACGAAGGCTGCCA | 1917 & 1918 |
| CA8 | GAGTGGGGCTACGAGGAA | AATTTGGGGAGAGGCGGA | 1919 & 1920 |
| CA9 | GAACTTCCGAGCGACGCA | ACCAGCAGCCAGGCAGGA | 1921 & 1922 |
| CAB39L | GACAGATAGGCACTCGGA | ATCCCACAACGTAAGGCA | 1923 & 1924 |
| CABLES1 | GAAGCTTGCGCAGGAGGA | GGCTGCTAACAGCACACA | 1925 & 1926 |
| CABP1 | GCTACATGCCCACCGAGA | GCCCCATTAGCTCCACGA | 1927 & 1928 |
| CACNA1A | TGGCATCGACGTGGAGGA | GTGGCACTCCGGAAGAGA | 1929 & 1930 |
| CACNA1B | AACGCCCTGCTGCAGAGA | GAGGCCTCACTGTCCAGA | 1931 & 1932 |
| CACNA1C | GGCCATCAACAGGGCCAA | TGAAGAGCTGGACCCCGA | 1933 & 1934 |
| CACNA1D | AGCAGAGGAGTGCGGACA | GGTCACAGGCATCAGCGA | 1935 & 1936 |
| CACNA1F | TGGGAAGCTGTGCCCACA | TCAGGGATGTCCGGACCA | 1937 & 1938 |
| CACNA1G | ACGAGGGCAACCTGAGCA | CGGAACCTGGACTGAGGA | 1939 & 1940 |
| CACNA1H | GCACCTGGAGGAGAGCAA | GCGAGAGCATCCTGGACA | 1941 & 1942 |
| CACNA1I | AGCAGTCAAGCACCCCCA | ACCCTTGGTGACCGCAGA | 1943 & 1944 |
| CACNA1S | CTGGCAGATGCCTGCCAA | GTTCAGGCATCCCAGGGA | 1945 & 1946 |
| CACNA2D1 | GCAGGACATCGCTCAGCA | AGGGAGGCCGTGAAGTCA | 1947 & 1948 |
| CACNA2D2 | CTAGTGCAGAGACCGCGA | GAGCAGCAGTTGCAGGGA | 1949 & 1950 |
| CACNA2D4 | TGACCCAGCTGCTCAGCA | TACCAGGAGCCCCAGACA | 1951 & 1952 |
| CACNB1 | TACCCCAGCAGCCACCCA | CCCAGCTCCGTGTAGGCA | 1953 & 1954 |
| CACNB2 | CCACAGAGACGAGACCCA | TCGATCCACGTCCCGGGA | 1955 & 1956 |
| CACNB3 | CTGATGAGGCCAGCGAGA | GCCCGTTAGCACTAGGCA | 1957 & 1958 |
| CACNB4 | TTCCGAGCAACTCCCACA | ACGGCCCCACTAACACCA | 1959 & 1960 |
| CACNG1 | GGACACCGTCTGGATCGA | TCCGGGGCATTCGAGGCA | 1961 & 1962 |
| CAD | GGCCTACACGGATGGAGA | CCACACCATCAGAGGCCA | 1963 & 1964 |
| CADM1 | AGCCATCGGGAAGCCCCA | ATGAACAGGTTGGGCCCA | 1965 & 1966 |
| CADM2 | CCAGAATGGCCCTGACCA | CCAGATATCGACCAAGCA | 1967 & 1968 |
| CADM3 | GGCACCTACGGCTGCACA | GCATGATGAGCAGCAGGA | 1969 & 1970 |
| CALB2 | GCTCCAGGAATACACCCA | GACAGGCAGGAGTCGGGA | 1971 & 1972 |
| CALCA | GCAGGCTTGCTGAGCAGA | AAGGCTTTGGAACCCACA | 1973 & 1974 |
| CALCB | CCTGGAGAGCAGCCCAGA | GCACATAGTCCTGCACCA | 1975 & 1976 |
| CALCR | AAGCGCCAATGGGCCCAA | GGCTGCAGCGCGAGCAGA | 1977 & 1978 |
| CALCRL | GCCTAAGTTGCCAAAGGA | GCCTTCACAGAGCATCCA | 1979 & 1980 |
| CALD1 | GCGTGAGGAAAGACGCCA | CTGCTTGGGAGCGACAGA | 1981 & 1982 |
| CALM1 | TCACTGGGTCAGAACCCA | CTCGGAATGCCTCACGGA | 1983 & 1984 |
| CALM2 | GGGCAGAATCCCACAGA | GCGAAGTTCTGCAGCA | 1985 & 1986 |
| CALM3 | TGAAGCAGAGCTGCAGGA | GGCCATCATGGTCAGGAA | 1987 & 1988 |
| CALML5 | CTCCGAGGTTGACAGCGA | CGCGGAAGGCGACCTGCA | 1989 & 1990 |
| CALR | CACTTGGATCCACCCAGA | GCCAGACTTGACCTGCCA | 1991 & 1992 |
| CALR3 | ACCACTCAGAATGGCCGA | AATGTAGCCCCCTCCACA | 1993 & 1994 |
| CALU | TGGGTAAAGACAGAGCGA | GTCTGAGGGAAGGATCCA | 1995 & 1996 |
| CALY | GAACTGCAGCCACCCAGA | CAGGAAGCCGTCGGGGCA | 1997 & 1998 |
| CAMK1D | AGTCCGTCAGCGCCCAGA | AGAGCGTGGAAGGTGCCA | 1999 & 2000 |
| CAMK2A | CCCTTAAGCACCCCTGGA | CCAGCATCGTGGTGAGAA | 2001 & 2002 |

FIG. 1 Cont.

| | | | |
|---|---|---|---|
| CAMK2B | AAGCCCGGAAGCAGGAGA | TCAGCCCTGGGTCACAGA | 2003 & 2004 |
| CAMK2D | GATGCCGCCTGCATAGCA | CGGCGGTGCCACACACGA | 2005 & 2006 |
| CAMK2N1 | GCTGAGCCCCTACGGCGA | GTTCTGCCCGGCGCCGAA | 2007 & 2008 |
| CAMK4 | CGCAGTTAAGGGGGCACA | CCACTGCCTTGGGCACCA | 2009 & 2010 |
| CAMKK2 | GCTGGACAAGAACCCCGA | CCCATGCCTCGTGACCCA | 2011 & 2012 |
| CAMP | TGACCCTCAACCAGGCCA | AATCACCCAGCAGGGCAA | 2013 & 2014 |
| CAMTA1 | GTAGCCTGCAGCTGAGCA | GGGAGTAGTCGGTCACCA | 2015 & 2016 |
| CANT1 | CCAACACCGACGACCAGA | CGTCCAGCGTGAAGGCCA | 2017 & 2018 |
| CANX | CGCAGAGAAACCTGAGGA | AATCACAGGTCGCTGCCA | 2019 & 2020 |
| CAP1 | GAAGAACCGAGGCAGCAA | TAAGGGCCAGGCTTGGGA | 2021 & 2022 |
| CAP2 | CGGCCGTCAGCGAAAGCA | CCCAATCCACATGACGCA | 2023 & 2024 |
| CAPG | GGAAGGGGCGAAAAGCGA | GGCGTACTGCATGCGCGA | 2025 & 2026 |
| CAPN1 | GGACAAGTCGGGCAGCA | TAGCCGCACCAGGCAGCA | 2027 & 2028 |
| CAPN2 | GCCCTGTCAACTCCACCA | GCGTTTCCAGCCGAACCA | 2029 & 2030 |
| CAPN3 | CCATGCGGTACGCAGACA | CATGGTGAGCTGCAGCCA | 2031 & 2032 |
| CAPN5 | CCCACAACCTTCGAGCCA | GGGGAGTCCTTGAGGCCA | 2033 & 2034 |
| CAPN7 | CTACGAGGACCAAGGCAA | AAGCCATGGGGACCAGGA | 2035 & 2036 |
| CAPN9 | CTGACAAGTCCGGCACCA | CATTCTCCAGCCGGACCA | 2037 & 2038 |
| CAPNS1 | CAGTTCGACACTGACCGA | CACGGAACATGGCGTCCA | 2039 & 2040 |
| CARD10 | CCGCCAGGATGGAACCAA | TAGGGCCTCGTGGAAGGA | 2041 & 2042 |
| CARD11 | ACCACGAAGGGTACCGGA | GTAGAACGAGTCCCCCGA | 2043 & 2044 |
| CARD6 | TCCGATCAGTCCAACCCA | GAAGGCTTAGACTGGGGA | 2045 & 2046 |
| CARD9 | CATCGACCCCTCACGCA | GTCCAGGAGCACACCCA | 2047 & 2048 |
| CARKD | CCTCTCCAACGGCCAGCA | GCGCCCAGTGTACCAGGA | 2049 & 2050 |
| CARM1 | GAGCTACCTCCACGCCAA | CAGACTTGGCCATCAGGA | 2051 & 2052 |
| CARNS1 | GGTAGAGGATGCGCCACA | GGGCCATTGTCGGAGACA | 2053 & 2054 |
| CARS | GAAGCGCTCTCCCAACGA | CATGGTGGGGGAACCGGA | 2055 & 2056 |
| CARTPT | CGAGAAGGAGCTGATCGA | CGGCGTCACACATGGGGA | 2057 & 2058 |
| CASC5 | GAGCAATCTCCCAGGCAA | TTGGCGACGAGCCTCACA | 2059 & 2060 |
| CASD1 | TGGAAAGGCTGGATGCAA | GCAGCAACCAGAACTCGA | 2061 & 2062 |
| CASP1 | CACACCGCCCAGAGCACA | CACCACGGCAGGCCTGGA | 2063 & 2064 |
| CASP10 | ACCCTGAGCAGGCACCCA | CCTGGGACAGTGGCCAGA | 2065 & 2066 |
| CASP2 | AATGAGGGAGCTCATCCA | TAGGCAGCAAGTTGAGGA | 2067 & 2068 |
| CASP3 | AATACCAGTGGAGGCCGA | AAGCGACTGGATGAACCA | 2069 & 2070 |
| CASP4 | GACCCACGTGGAGAAGGA | CTCTAGGTGGCAGCACCA | 2071 & 2072 |
| CASP5 | AAGAGAGAGGACCGCAGA | CAACCACAGTGTAGCCCA | 2073 & 2074 |
| CASP7 | CGTTCGAAACGGAACAGA | TTAAGAGGATGCAGGCGA | 2075 & 2076 |
| CASP8 | CCCCACGATGACTGCACA | AGCAGATGAAGCAGTCCA | 2077 & 2078 |
| CASP9 | TCGACCAGCTGGACGCCA | GGTCTCAACGTACCAGGA | 2079 & 2080 |
| CASQ1 | GGAGATCAACCCTGAGGA | ACCAGCAGGGGGAAGTCA | 2081 & 2082 |
| CASQ2 | ACAACCCCGATCTGAGCA | GTGACATTCACCACCCCA | 2083 & 2084 |
| CASR | AGGCCAAGATCCCCACCA | AGCCGATCAGGAAGCCCA | 2085 & 2086 |
| CAST | AGGAACAGCTTCCACCCA | ACCACTTCAGAGATGGCA | 2087 & 2088 |
| CAT | CACTGAGGTCCACCCTGA | AGTGAGATCCGGACTGCA | 2089 & 2090 |
| CATSPERG | GAGGAGTGGACACGAGCA | ACAGGAGGCAGAAGGCGA | 2091 & 2092 |
| CAV1 | GCATCCCGATGGCACTCA | ACAGACGGTGTGGACGTA | 2093 & 2094 |
| CAV2 | CCAGGACCGGGATCCCCA | AGGCAGAACCATTAGGCA | 2095 & 2096 |
| CAV3 | ACGGCGTGTGGAAGGTGA | AGAAGGAGATGCAGGCGA | 2097 & 2098 |
| CBFA2T3 | AGGAGGACTCCAGCGAGA | TGGCAGCACCCACAGGCA | 2099 & 2100 |
| CBFB | AGAGAAGCAGGCAAGGTA | TCCAGACAGCCCATACCA | 2101 & 2102 |
| CBL | GGCGCCATCTATCACCGA | TCCAGAGACAACCAGCCA | 2103 & 2104 |
| CBLB | GCCATTACCACCTGCCA | GATGGAGGGAGGGCATCAA | 2105 & 2106 |
| CBLC | AGCACTCGGACAGCCAGA | GGGCAATGGAGGAGCCGA | 2107 & 2108 |
| CBLN1 | CAGGAGCACCAACCACGA | CCGGCCACCCGTTTAGCA | 2109 & 2110 |
| CBLN2 | AGAATGGCTACCCAGTGA | ATGAGCAGCAGCACGCCA | 2111 & 2112 |
| CBLN3 | TGACCCGGGAGGCAGCCA | CCCAGTAGATTCCCCCGA | 2113 & 2114 |
| CBR1 | CGCATACGGGGTGACGAA | GGCAGCAGGCATTCAGGA | 2115 & 2116 |
| CBR3 | GCGTGCTGCCCAGGACCA | TCAGCCCCCTCCTCCACA | 2117 & 2118 |
| CBS | GGAGAAGGGCTTCGACCA | GCACCTTCCCGGCAAGCA | 2119 & 2120 |
| CBX1 | CCCTGCCAAGGAAGCCAA | CGAGGGGTAGGAATGCCA | 2121 & 2122 |
| CBX2 | AGAGGCAAGAGGCCGAGA | CCTGGCAGCAGAAGCTGA | 2123 & 2124 |
| CBX4 | CCTGCAGCTCACCACCAA | CGCCGTGGGTCTCGGAGA | 2125 & 2126 |
| CBX5 | GGTTAAGGGACAAGTGGA | TAGCTCAGGGCAATCCAA | 2127 & 2128 |
| CBX6 | CCCCTCGCCTACACCACA | AGCCTCGGGCTCGGAGGA | 2129 & 2130 |
| CBX7 | CCAACCTGGAGAGCCACA | AGCGCAGGTGTCCAGGGA | 2131 & 2132 |
| CBX8 | CTAGCTCAGCTGAGGCCA | CCACAGGGATCCTGGCGA | 2133 & 2134 |
| CC2D2A | GAAGCCGGCAGTGAGCAA | CCGAGGGGGTAGTCAGCA | 2135 & 2136 |
| CCAR1 | GCCCTGAGGAGACCCACA | ACTCTGAGCGGGTGGGAA | 2137 & 2138 |
| CCBE1 | AGGGGCACCAGGAAGAGA | TGCGGATGTCAGCCAGCA | 2139 & 2140 |
| CCBP2 | CGCACTCCAGGTAACAGA | TGCCATCCAAGCACGGCA | 2141 & 2142 |
| CCDC102B | GCCTCACCCCCCAGGGA | AGTCCGACCACCACCGCA | 2143 & 2144 |
| CCDC106 | TGGCCCTGGACGACGAGA | AGCGGTAGGTGATGGGCA | 2145 & 2146 |
| CCDC108 | GCACCATTCAAGGCCCCA | TGGAAGGAGGAAGGCCCA | 2147 & 2148 |
| CCDC129 | AGAGTCGGATGGGCCAGA | CCTCCATGGCCTCAAGCA | 2149 & 2150 |
| CCDC132 | GAAGGTGCCAAGTCCACA | ACTGCAGGCATCACAGCA | 2151 & 2152 |
| CCDC134 | AGATGGGCCCTTCCCCCA | AACTGATACCCCAGCGGA | 2153 & 2154 |
| CCDC149 | GCCAGGGTAAATCCAGCA | ACTGCGGAGTAGCTGGGA | 2155 & 2156 |
| CCDC28A | AAACGGAGCTGCGGAGGA | CCCCTTCCGCAACCCGCA | 2157 & 2158 |
| CCDC3 | CTGTTCGCAAGGGCAGCA | GAGGAGCACATGAGCCTA | 2159 & 2160 |
| CCDC41 | GAGGCTGAAGTAGCGGAA | AGCCTGCATCTCAGCCAA | 2161 & 2162 |
| CCDC6 | GTCGACAGCTCTCCGAGA | GTAAGGGATCGGGCTGGA | 2163 & 2164 |
| CCDC63 | GAGGCTGAGATCCCGCCA | TGAAGGGGTCAGCCCCCA | 2165 & 2166 |

FIG. 1 Cont.

| | | | |
|---|---|---|---|
| CCDC69 | TGAGGCCCTGGAGAAGGA | CAGAGGGAAGGCAGGCGA | 2167 & 2168 |
| CCDC80 | GGACCCAAGGAGAGCACA | TGAGGGAGGTTGGGGCAA | 2169 & 2170 |
| CCDC85A | CTGAACACGCCAGGCACA | CCCCTGGCTCTGGGGAGA | 2171 & 2172 |
| CCDC88A | GGCCACAAAGCCACAGCA | TCACTTCCAGGGGAACCA | 2173 & 2174 |
| CCDC88B | TCAGGGTCCAGGGACCAA | ACCAACTCGCCTTGGGGA | 2175 & 2176 |
| CCDC99 | GAAGATCGAAGGGCAGCA | GCTCCAACATGGCAAGCA | 2177 & 2178 |
| CCK | GCTGCAGCGGGCAGAGGA | GCCCAGGTGCGCTCGGGA | 2179 & 2180 |
| CCKAR | CAGCAGCAGCAGGGCCAA | AGGAGGAGGTGTAGGACA | 2181 & 2182 |
| CCKBR | AGAAGCGCGTGGTGCGAA | GCGACGGTGCATGAAGCA | 2183 & 2184 |
| CCL1 | GATGTGGACAGCAAGAGCA | GCCTCTGAACCCATCCAA | 2185 & 2186 |
| CCL11 | AGGAGAATCACCAGTGGCA | CATGGAATCCTGCACCCA | 2187 & 2188 |
| CCL13 | AGATGCACTCAACGTCCCA | GACAGCCTTCTGGGGACA | 2189 & 2190 |
| CCL14 | CTATGAGACCAACAGCCA | GGGGTTGGTACAGACGGA | 2191 & 2192 |
| CCL15 | CCTTGGATCCCAGGCCCA | TCATGAGTGAACACGGGA | 2193 & 2194 |
| CCL16 | CACCAACCCCAATGACGA | AGGAGCTGGGGTTGACCA | 2195 & 2196 |
| CCL17 | GAGTACTTCAAGGGAGCCA | GTTGGGGTCCGAACAGA | 2197 & 2198 |
| CCL18 | GTGAGTTTCCAAGCCCCA | CACAGGAGCAGAGGGCCA | 2199 & 2200 |
| CCL19 | CAACTCTGAGTGGCACCAA | GTGAACACTACAGCAGGCA | 2201 & 2202 |
| CCL2 | AGGGCTCGCTCAGCCAGA | GCTTGGGGTCAGCACAGA | 2203 & 2204 |
| CCL20 | GAATCAGAAGCAGCAAGCA | GGATTTGCGCACACAGACA | 2205 & 2206 |
| CCL21 | AAAGGAAGATTCCCGCCA | CTGGGATGGAGCAGCCTA | 2207 & 2208 |
| CCL22 | GCGCCAACATGGAAGACA | GTTAGCAACACCACGCCA | 2209 & 2210 |
| CCL23 | TCTCCTACACCCCACGAA | GATGACACCCGGCTTGGA | 2211 & 2212 |
| CCL24 | GGCAGGCCTGATGACCA | GAACATGCAGCAGGGAGA | 2213 & 2214 |
| CCL25 | CCCGCTGTCCACACCCAA | CGCAGCAGGCAGATTGCA | 2215 & 2216 |
| CCL26 | CACCTTGGAACTGCCACA | GCTTCGCACCCAGGTCCA | 2217 & 2218 |
| CCL27 | CCTACTGCCACCCAGCA | GCCAGGTGAAGCACGA | 2219 & 2220 |
| CCL28 | CCAGCTGTTGCACGGA | GAAGGATGACAGCAGCCAA | 2221 & 2222 |
| CCL3 | CTCCCGGCAGATTCCACA | GACACCGGGCTTGGAGCA | 2223 & 2224 |
| CCL3L3 | GCCAGTGCTCCAAGCCCA | CTCACTGGGGTCAGCACA | 2225 & 2226 |
| CCL4 | AGCGCTCTCAGCACCA | GCTGGCTGGGAGCAGA | 2227 & 2228 |
| CCL5 | CGTGCCCACATCAAGGA | GATGTACTCCCGAACCCA | 2229 & 2230 |
| CCL7 | GCAGAGGGGCTGAGACCA | ATCCCAACTGGCTGAGCA | 2231 & 2232 |
| CCL8 | GGGACTTGCTCAGCCAGA | CCTTGGGGTCAGCACAGA | 2233 & 2234 |
| CCM2 | AGACCATTGGCGTGAAGGA | CGAGATCATGCGGTCCCA | 2235 & 2236 |
| CCNA1 | GCACAGACCCAAAGCACA | CTTCCCCAACCTCCACCA | 2237 & 2238 |
| CCNA2 | AAGACGAGACGGGTTGCA | ACATGAATGGTGAACGCA | 2239 & 2240 |
| CCNB1 | CTGCCTCTCCAAGCCCAA | CAGTGACTTCCCGACCCA | 2241 & 2242 |
| CCNB1IP1 | CGCACAGAACTCAGTCCA | GAAGGCCAGCGCTCGGGA | 2243 & 2244 |
| CCNB2 | GCAGTCCATAAACCCACA | CCATAATGCCAACGCACA | 2245 & 2246 |
| CCNC | ACATGGGCCAAGAAGACA | GCTGTACAACACAGGCTA | 2247 & 2248 |
| CCND1 | TCCGCAAACACGCGCAGA | TGAGGCGGTAGTAGGACA | 2249 & 2250 |
| CCND2 | CACCGTCGATGATCGCAA | TTGAGGAGCACCGCCTCA | 2251 & 2252 |
| CCND3 | ACGCCCCTGACCATCGAA | AGAGAGAGCCGGTGCAGA | 2253 & 2254 |
| CCNDBP1 | GGGTTGCGTGCCAGCAGA | AGGCCAGAGTAAGGGTCA | 2255 & 2256 |
| CCNE1 | GGACCAGTGTGGGAGCCA | AGGTGTGGGGATCAGGGA | 2257 & 2258 |
| CCNF | GGAGCTGAGAACCCAGCA | ATCCGGTGAGGTCCCACA | 2259 & 2260 |
| CCNG1 | CACGATAATGGCCTCAGA | GCAGCTCAGTCCAACACA | 2261 & 2262 |
| CCNL1 | AGGGACAGGCGTGAACGA | CCTGAGCGACTGCCACCA | 2263 & 2264 |
| CCNL2 | CCGTGAACGGCTTGCCAA | CGCTGATCGGGATGGGGA | 2265 & 2266 |
| CCNO | GAAGCTCTGGAAGCGCAA | CTCCCAGTCGCAAGTCCA | 2267 & 2268 |
| CCNT1 | GGGCATAGCTCAGACACA | GGCTGAACACCCTGGGCA | 2269 & 2270 |
| CCR1 | GGTGATCGCCTACACGCA | CCACGGAGAGGAAGGGGA | 2271 & 2272 |
| CCR10 | CAGCGGGAAGGCCAACGA | CGGCAGTATCCAGCAGCA | 2273 & 2274 |
| CCR2 | CCAACGAGAGCGGTGAA | GATGAGGACGACCAGCA | 2275 & 2276 |
| CCR3 | GCTGCATGAACCCGGTGA | GCCCAGGTGCATGAGCAA | 2277 & 2278 |
| CCR4 | GACTATGCCATCCAGGCCA | CCACAGTATTGGCAGAGCA | 2279 & 2280 |
| CCR5 | AGAGGCACAGGGCTGTGA | AGGTGTTCAGGAGAAGGA | 2281 & 2282 |
| CCR6 | AACACTACCGCGCAGCAA | AGAGTAGCTCAAGCCCCA | 2283 & 2284 |
| CCR7 | GGCCCAGACGGTGGCCAA | TGCGGAACTTGACGCCGA | 2285 & 2286 |
| CCR8 | GCATAAGCCAACAGCTGA | CACAGCTCTCCCTAGGCA | 2287 & 2288 |
| CCR9 | CACCCTGATACAAGCCAA | GAGAACAGGGTTCAGGCA | 2289 & 2290 |
| CCRL2 | GTTCAGGGAGCAGAGGTA | CAGGAGAGGGTTGATGCA | 2291 & 2292 |
| CCRN4L | GACCCTGGAGTGCAAGGA | CATTGAAGTCCCCACACA | 2293 & 2294 |
| CCT2 | GCAGGTGTGGAACGCCTA | GTTGAGTGGCACCACGCA | 2295 & 2296 |
| CCT3 | GGCCCATGCCTTGACAGA | GTGCTTGGCCCGAAGGGA | 2297 & 2298 |
| CCT4 | GTGCTGCGAGAAGAGAGA | CTAACTCAGCAGAACCCA | 2299 & 2300 |
| CCT5 | CACTGGAGGTCATCCCCA | CAGTCGATGCCAAGAGCA | 2301 & 2302 |
| CCT6A | TGAACACAGGTGAGCCAA | GGTGGCAATCACAGTGCA | 2303 & 2304 |
| CCT7 | CAAGCTGCGGGCTCGGCA | ATCAGGCACGCAGCCTCA | 2305 & 2306 |
| CCT8 | GTGACAAACGATGCAGCA | AATTCCAGGAGAGCTCCA | 2307 & 2308 |
| CD109 | CTCCAAGCCTTCCAACCA | CCCCATCCTCACTGGGAA | 2309 & 2310 |
| CD14 | CTAAAGGACTGCCAGCCAA | CAGTTCCAGGGACCAGGAA | 2311 & 2312 |
| CD151 | GGCGAGACAGTGAGTGGA | CACCACCGTCTTGCAGCA | 2313 & 2314 |
| CD160 | GGAACTACACAGTGACGGGA | CAAGGCTGGTGACCAGCA | 2315 & 2316 |
| CD163 | GGGAAGGAACAGGGCCCA | GCCTGCACACCACACCCA | 2317 & 2318 |
| CD164 | AGCACCCGAACGTGACGA | GGTGACCAGCGGGAGGGA | 2319 & 2320 |
| CD164L2 | CAGTCCCTGAGGCCCACA | CCTTGAGGAAGTGCAGCA | 2321 & 2322 |
| CD180 | AGCCACAACAGCCTGACA | AGGGAGGAGACGGGGTGA | 2323 & 2324 |
| CD19 | ACCGTGGCAACCTGACCA | CACAAGGGAACACAGGCA | 2325 & 2326 |
| CD1A | CTGGGAATATGGCCAAGCA | CCTGCATCAAGAAGACCCA | 2327 & 2328 |
| CD1B | TGAGATCCAGGGCATAGCA | GGAAGGCACACATGAAGCA | 2329 & 2330 |

FIG. 1 Cont.

| | | | |
|---|---|---|---|
| CD1C | AACAGGAGCAACTGGGCA | ACTCGACAAGACAGGCCA | 2331 & 2332 |
| CD1D | TGCCCAATGCTGACGAGA | AAGCCCACAATGAGGAGGA | 2333 & 2334 |
| CD1E | CAGGGGAGTCAGAACTGAA | CGTCAGCATTAGGCAGGA | 2335 & 2336 |
| CD2 | GCAGGGAACAAAGTCAGCA | AACGAGCAGTGCCACAA | 2337 & 2338 |
| CD200 | CACCTTCAGCGAGAACCA | GCGGGCAGTGGCAGAGCA | 2339 & 2340 |
| CD200R1L | ACACCCGAAGTGAACCTA | CCTCTGGGATCCAGGAGA | 2341 & 2342 |
| CD207 | AGTGACGGCATGGAGGCA | TCAGGAACTGAGAACGCA | 2343 & 2344 |
| CD209 | CCAGCGGAACTGGCACGA | ACAGAGGTGAGCCGTCCA | 2345 & 2346 |
| CD22 | GCCGGTGAAGGTCCAGCA | CGCTGGAGCTTGAGCCCA | 2347 & 2348 |
| CD226 | GATCGGGACCCAGCAGGA | GAGCAGGAATAGTAGCCAACA | 2349 & 2350 |
| CD24 | GGGACATGGGCAGAGCA | GGCCAACCCAGAGTTGGA | 2351 & 2352 |
| CD244 | ATCACGAGCAGGAGCAGA | GGGAGCAGAAGACTGGGA | 2353 & 2354 |
| CD247 | CCATCCTGCAGGCACA | CAGGAACAAGGCAGTGAGA | 2355 & 2356 |
| CD248 | TTGCCGAGCACAGCCAGA | CCCAGCATGGATGACCCA | 2357 & 2358 |
| CD27 | ACCCACTGGCCACCCCAA | TCTGCAGGCTCCACAGGA | 2359 & 2360 |
| CD274 | CGGCTGTTGAAGGACCA | TGTAGTCGGCACCACCA | 2361 & 2362 |
| CD276 | GCAGATGGCCAACGAGCA | GACAGACAGACAGCCCCA | 2363 & 2364 |
| CD28 | GGTGAAGCAGTCGCCCA | CAACACAGACTTCCACAGCA | 2365 & 2366 |
| CD2AP | GGTGGAGTGGAACCCTGA | ATAGGTGAAGTAGGCCCA | 2367 & 2368 |
| CD300A | GCCAGCACCACCAAGGGA | TCCCGAGGCCTCTGAGCA | 2369 & 2370 |
| CD300LF | AGCAGAAAGCAGCCGGGA | CCTTCGGCAAGGAAGCCA | 2371 & 2372 |
| CD300LG | CCAGTCCAGCTCTCAGCA | AGGCCTGCGGCTGACAGA | 2373 & 2374 |
| CD302 | GCACATCAAGACAGGTGA | CCGTGCTAGCAATCACCA | 2375 & 2376 |
| CD320 | ACCAGTCTGGAAGCCCAA | TGGCCACCAGTAACCCCA | 2377 & 2378 |
| CD33 | AGACGCCAGGAGGAGGGA | GCTCACAGGCCCAGGACA | 2379 & 2380 |
| CD34 | GTTCACCACCCCAGCCAA | CACACAGCACTCGGGCCA | 2381 & 2382 |
| CD36 | AACCCAGGACGCTGAGGA | GCAGCTGCCACAGCCAGA | 2383 & 2384 |
| CD37 | GCGCGCAGGGCCTCCAGA | AGAGCGTCATGAACCCGA | 2385 & 2386 |
| CD38 | CACAGGTCCAGCGGGACA | GAGCATCACATGGACCACA | 2387 & 2388 |
| CD3D | TGGACCTGGGAAAACGCA | TGGATCCAGCTCCACACA | 2389 & 2390 |
| CD3E | CCCAGAGGAAGCAAACCA | GTAAACCAGCAGCAGCAA | 2391 & 2392 |
| CD3EAP | CAGCCTGAAGCCAGGGCA | GGAGCCTCCTCCCCAGA | 2393 & 2394 |
| CD3G | CCAAGGACCCTCGAGGGA | GAAGCTCTCGACTGGCGA | 2395 & 2396 |
| CD4 | GCTGAGTGACTCGGGACA | GCCGGCACCTGACACAGA | 2397 & 2398 |
| CD40 | GGACAAGCTGTGAGACCA | AGCACCAAGAGGATGGCA | 2399 & 2400 |
| CD40LG | GAGCTGCAAATACCCACA | GCCAAAGGACGTGAAGCCA | 2401 & 2402 |
| CD44 | AGTCACAGACCTGCCCAA | TGGACATAGCGGGTGCCA | 2403 & 2404 |
| CD46 | GGAGCGGTAAGCCCCCAA | TGGAGCAGCACGACTCCA | 2405 & 2406 |
| CD47 | CCAGAGAAGGTGAAACGA | CTCATCCATACCACCGGA | 2407 & 2408 |
| CD48 | GAGGACAACAGCACCTACA | AGACTCGCCAGGTATCACA | 2409 & 2410 |
| CD5 | GCAGCATCTGTGAAGGCA | CGTCCAGCACTCGATAGGA | 2411 & 2412 |
| CD52 | GACAAAACGACACCAGCCA | CTGAAGCAGAAGAGGTGGA | 2413 & 2414 |
| CD53 | AGCGTGGGACTCCATCCA | TCGCATAGCAACCCTCCA | 2415 & 2416 |
| CD55 | ATGCCCTAATCCGGGAGA | GGGTCACTCCACTGGACA | 2417 & 2418 |
| CD58 | GCTGGGCACTCGCGCAGA | CATTCCCATACACAACACCA | 2419 & 2420 |
| CD59 | ACAACCCGCTTGAGGGAA | AATGGAGTCACCAGCAGA | 2421 & 2422 |
| CD5L | CCTCCTTCAGAGACCGGA | CTGGCACTGCTCCAGGGA | 2423 & 2424 |
| CD6 | CCACCCTTGGAGGAAGGA | GGTGATACTGAGGGCCCA | 2425 & 2426 |
| CD63 | CAACGAGAAGGCGATCCA | CTGCTGCAGCTACCACCA | 2427 & 2428 |
| CD68 | CTTCCCCCACGCAGCACA | ACCAGGGCGAGGAGGCCA | 2429 & 2430 |
| CD69 | AATGCCATCAGACAGCCA | ACAGCAAGAGTAGCACCA | 2431 & 2432 |
| CD7 | CTCAGGGTCCCAGGACAA | CCTCTGTCACCAGGACCA | 2433 & 2434 |
| CD70 | ATGGACCAGAGCTGGACA | AGCAGATTCCCACGGCCA | 2435 & 2436 |
| CD72 | CATGCGGCTCAGCAGACA | AGAGCTGAGGCCAGTCCA | 2437 & 2438 |
| CD74 | CCCCGGAGAGCAAGTGCA | CCTGGCCAGCGAGGAGCA | 2439 & 2440 |
| CD79A | GCAACGAGTCATACCAGCA | GCGCAGAACAGGAGGA | 2441 & 2442 |
| CD79B | GGACGAGAATCCCCAGCA | ATGGTGAGGGTGGCGAGA | 2443 & 2444 |
| CD80 | AGCTGGCACAAACTCGCA | CGCAGAGCCAGGATCACA | 2445 & 2446 |
| CD81 | CCGGGAAGCTGTACCTCA | GTTCCGGATGCCACAGCA | 2447 & 2448 |
| CD82 | TGCAGGAGAACCTGGGCA | GGAATGGACGTGCCGGCA | 2449 & 2450 |
| CD83 | CCGGATGGGCAGAGAA | ATAACCAGAGCCAGCAGCA | 2451 & 2452 |
| CD84 | ACACGTGTACAGCCCAGA | ACATAGCCAGCACGCTCA | 2453 & 2454 |
| CD86 | ACGGTTACCCAGAACCTA | GCTCGTAACATCAGGGAA | 2455 & 2456 |
| CD8A | CCGAGAGAACGAGGGCTA | CTGGCAGGAAGACCGGCA | 2457 & 2458 |
| CD8B | GAGGTGGAACAGGAGAAGA | TCCCGACGATCATGCAGAA | 2459 & 2460 |
| CD9 | AACGCTGAAAGCCATCCA | GATGGCATCAGGACAGGA | 2461 & 2462 |
| CD93 | CCAGCATCCATCACGCCA | GGAGTAGGATGGCCACCA | 2463 & 2464 |
| CD96 | CCCACAACTGCCAATGGA | CAATCACTGGCCAGGACA | 2465 & 2466 |
| CD97 | GGCAGCACCACCTGCCAA | GGAGCCCACGAAGAGGCA | 2467 & 2468 |
| CD99 | AGAAGGGGAAGAGGCCGA | CTCCAGCCACGGCGACCA | 2469 & 2470 |
| CDA | ATCGCCAGTGACATGCAA | GGTCATGTACACGGGCCA | 2471 & 2472 |
| CDADC1 | GCAGCATGACCGGTCAGA | GCTCCATCCAGAGGCTGA | 2473 & 2474 |
| CDC14A | AGGCAGGCTTCACAGCCA | CGGTGTAGGAGGGTCGGA | 2475 & 2476 |
| CDC14B | GCACCCCTACTGATGCCA | CAGATCCTGACCCACGCA | 2477 & 2478 |
| CDC20 | GGAGCTCATCTCAGGCCA | GATGCCACTGTGGCCCCA | 2479 & 2480 |
| CDC23 | GAGAGTGGAGCTCAGCAA | ACCAGGCTCCCCAATGCA | 2481 & 2482 |
| CDC25A | AATACGAGGGAGGCCACA | CTCTCACATACCGGCACA | 2483 & 2484 |
| CDC25B | GGACAGTGACCACCGAGA | TGCCCGTCAATAGGGCCA | 2485 & 2486 |
| CDC25C | GTCTGCGTGAAGAGGACA | GGCTTCGACACCTCAGCA | 2487 & 2488 |
| CDC27 | GAGTTGAAGGCATGGAGA | ACACCAGGCCTCTGGCGA | 2489 & 2490 |
| CDC34 | GCGTGAAGGTGCCCACCA | CTCATCGTCCCCGAAGCA | 2491 & 2492 |
| CDC37 | GCAGGACGCCATCAGCAA | TAGAGTTGGGGACCCAGA | 2493 & 2494 |

FIG. 1 Cont.

| | | | |
|---|---|---|---|
| CDC42 | AGCCTATCACTCCAGAGA | AGTGCAGAACACTCCACA | 2495 & 2496 |
| CDC42BPA | TCAGCAAGGTCATCCGCA | AGAGCCCTCTGACGGGGA | 2497 & 2498 |
| CDC42BPB | TAGTTGCAGCCCCACCCA | GAGGCTCGCAGTTGAGGA | 2499 & 2500 |
| CDC42BPG | TGCCATCCTCGACCAGGA | CACACAGCACGACCAGCA | 2501 & 2502 |
| CDC42EP1 | CCGCTCGGAAAAGCCGCA | CTGAGGAGTGAGGGCCCA | 2503 & 2504 |
| CDC42EP2 | AGGGAGGGAGTGTGGACA | TGGAAGGCCCCAGGTCCA | 2505 & 2506 |
| CDC42EP4 | CCCCCTCCTCGATGAGCA | CAGGTCGATGTGGAAGGA | 2507 & 2508 |
| CDC42SE2 | GTGGATACGAAGGCGGGA | CAGCTGAAGGAAATGCAGGA | 2509 & 2510 |
| CDC45 | AGAAGCAGCTGCGAGCCA | CCGGCCTAGAGAACAGCA | 2511 & 2512 |
| CDC5L | CGAGGATGGAATGGCAGA | TAGGGGCAGGAAGGCCCA | 2513 & 2514 |
| CDC6 | CAGGATGACCTTGAGCCA | ACTGCCTGATCAAGAGCA | 2515 & 2516 |
| CDC7 | AGGGCAGGTACACCAGGA | CCTGCAGACCACATGTCA | 2517 & 2518 |
| CDCA3 | GAAGACCAGCAGTGGAGA | ACTGGGTACCCAGAGGCA | 2519 & 2520 |
| CDCA8 | CTCCAGGCCTGACACCCA | CTGCAAGTCACTGGCCAA | 2521 & 2522 |
| CDCP1 | CTAACTGCAGCCCCACGA | ATGATGAGCCCGAGGGCA | 2523 & 2524 |
| CDCP2 | CCGTGACCTCAAGCCACA | TCGCCCTCAGTGGACCCA | 2525 & 2526 |
| CDH1 | GATGCCCCCAATACCCCA | CCAGCACATCCACGGTGA | 2527 & 2528 |
| CDH10 | GCACAGGCACACTGACCA | TGCAGAGGAGGATGGCGA | 2529 & 2530 |
| CDH11 | GCACCAACACCCTCACCA | TGCAGGCGAGGATGGCGA | 2531 & 2532 |
| CDH12 | GCGGGGATTGAAACCCGA | ATCAACGCCCCAGTGCTA | 2533 & 2534 |
| CDH15 | CGCCTACGACATCAGCCA | GTGTCGTAAGGCGGCACA | 2535 & 2536 |
| CDH16 | CCTGGATTGGGAGCCAGA | CCCACCAGCTTCGCCACA | 2537 & 2538 |
| CDH17 | GTCTACCAGGCACACAGA | CCCACAGTGGGTATCCCA | 2539 & 2540 |
| CDH18 | CATCCACCCTGGAAAGCA | AGCGAGCTGATAGACCCA | 2541 & 2542 |
| CDH19 | CAAGCGCTGAGATCAGGA | AGCGTAGGTCTGGAGGGA | 2543 & 2544 |
| CDH2 | CTTGAGCCAGCTGCAGCA | GCTGCAGATCGGACCGGA | 2545 & 2546 |
| CDH20 | CATCGTCCGCTACGACGA | AGCACGTAGCTGTGGACA | 2547 & 2548 |
| CDH23 | CCCATCTTCAGCCAGCCA | CCTGCAGTGAAGCGGGGA | 2549 & 2550 |
| CDH24 | CTGAGCAGCACTGCCACA | GGGCCACGAAGAGCACCA | 2551 & 2552 |
| CDH3 | TGACGGTGATCAGGGCCA | GCAGCACCAGCAGGAGGA | 2553 & 2554 |
| CDH4 | GCTCATTGACCCCGAGGA | GCTCATCCACGCGACGCA | 2555 & 2556 |
| CDH5 | CTCCGAGTCCATAGCCGA | AGCCGTACAGCTCAGCCA | 2557 & 2558 |
| CDH6 | CTCCAACAGCTCGCGACA | GGTCACTGACTCCAGCGA | 2559 & 2560 |
| CDH8 | ATCCTCCACTGAGCAGCA | CCACGATGACTAACAGCA | 2561 & 2562 |
| CDH9 | GACGCAGACCCAAGTGCA | CCCCCAGTCACTGAGGTA | 2563 & 2564 |
| CDHR1 | GAGGATGCAGAGGAACCCA | GGGCATCCAGGGAGCGGA | 2565 & 2566 |
| CDHR2 | TCAGGACTCGCTGACGCA | GCACACACACGAAGGCCA | 2567 & 2568 |
| CDHR3 | GAGTCCAGCCACCAGGGA | ACCAGCATCCTCAGCCCA | 2569 & 2570 |
| CDHR4 | GATCCCTCAGGAGCCACA | GGTCACTGTGCACCAGGA | 2571 & 2572 |
| CDHR5 | CCTCCCACCAACCAACCA | ACAAGGACGGCGAGGCCA | 2573 & 2574 |
| CDK1 | CAGGTCAAGTGGTAGCCA | TGTACTGACCAGGAGGGA | 2575 & 2576 |
| CDK12 | CCAGCAGTTACCAGGGCA | GGAATGGTTGCCCGACCA | 2577 & 2578 |
| CDK13 | CCTGAGCTACCAGGAGGA | TCACCATAGCGAGGCCCA | 2579 & 2580 |
| CDK2 | GGCCATCAAGCTAGCAGA | CCTGGCCACACCACCTCA | 2581 & 2582 |
| CDK4 | AGCCGACCAGTTGGGCAA | CATCTCAGGTACCACCGA | 2583 & 2584 |
| CDK5 | GGGGAAGGCACCTACGGA | AGGGCGGAACTCGGCACA | 2585 & 2586 |
| CDK5R1 | GTGCTACCGCCTGAAGCA | GGTACAGGCATGTCAGCA | 2587 & 2588 |
| CDK5RAP2 | TACCAGGACAGCCCAGGA | AAGGTCATCAGGTGGGCA | 2589 & 2590 |
| CDK6 | GGTGACCAGCAGCGGACA | TATGCAGCCAACACTCCA | 2591 & 2592 |
| CDK7 | CAGTGCAGCAGGAGACGA | GGCCGTAATTCGAGCACA | 2593 & 2594 |
| CDK8 | GGCTATGCAGGACCCCTA | GGGATTTGACAACCGGCA | 2595 & 2596 |
| CDK9 | CAAGGGCCAGAAGCGGAA | GCATGGGGTCGGACCAGA | 2597 & 2598 |
| CDKN1A | GCTGAGCCGCGACTGTGA | AAGACAGTGACAGGTCCA | 2599 & 2600 |
| CDKN1B | GCGACCTGCAACCGACGA | AGAACCGGCATTTGGGGA | 2601 & 2602 |
| CDKN1C | TGAGAAGTCGTCGGGCGA | CGGGGTCTGCTCCACCGA | 2603 & 2604 |
| CDKN2A | GTTACGGTCGGAGGCCGA | AATCGAAGCGCTACCTGA | 2605 & 2606 |
| CDKN2AIP | CCAGCCAAAGCAGCAGCA | CCAACAAGGGCACCTCGA | 2607 & 2608 |
| CDKN2B | CCTGCCACTCTCACCCGA | GCCAAGTCCACGGGCAGA | 2609 & 2610 |
| CDKN2C | CATGATGCGGCCAGAGCA | GCTTCACCAGGAACTCCA | 2611 & 2612 |
| CDKN2D | CGGGGCACTTCCAATCCA | CTGCAGTGCCAGCTCCAA | 2613 & 2614 |
| CDKN3 | CAATCGCAGATGGAGGGA | CCCAAGTCCTCCATAGCA | 2615 & 2616 |
| CDNF | GCAGCCACAAAGATCCTA | CAACTGATGCCAAGTCCA | 2617 & 2618 |
| CDO1 | GAACATCAGCCATACGGA | GTTCTCCAGCGAGCCCGA | 2619 & 2620 |
| CDON | CGGTTCGAGTCCCAGGAA | GATGCCCACGGGTGGAGA | 2621 & 2622 |
| CDR2 | CTGCATCAGGAGGGCCAA | AGTTCCCAGCCGCTGGCA | 2623 & 2624 |
| CDS1 | ACGAAACCGAGAGCACCA | TCAGCATGAAGGATCCCA | 2625 & 2626 |
| CDSN | ATCCCCAGCCAGTCGGCA | CCACAGAGCTGGACCCCA | 2627 & 2628 |
| CDX2 | GCAGAGCAAAGGAGAGGA | TGCAGGGAAGACACCGGA | 2629 & 2630 |
| CDY1 | AGGGAAACTCCTCCGGGA | GAAGCAGTAACTGAGCCA | 2631 & 2632 |
| CDYL | GCAGGAGGCGTGTGGCAA | GCGCACGAGGGCTTTGGA | 2633 & 2634 |
| CDYL2 | TCCAGACGCCCTACGCCA | GCTGAACGTGGTGGGCCA | 2635 & 2636 |
| CEACAM1 | GCAACACCACCCTCAGCA | ACCAGGGCCACTACTCCA | 2637 & 2638 |
| CEACAM18 | GCTGAGATCGGCTCCCAA | TGCATCGGTAACGGCCCA | 2639 & 2640 |
| CEACAM19 | GCACATGGATGGCGACCA | GACACCAGGAGGACTGGA | 2641 & 2642 |
| CEACAM21 | CCCCATCAGGCAGGAGGA | GCCACCAGAAGACTCCCA | 2643 & 2644 |
| CEACAM3 | TGACCTCAAGGAGCAGCA | GGCAGTGGAGAGAGGGGA | 2645 & 2646 |
| CEACAM5 | GCAAACCGCAGTGACCCA | AGAGGCCGAGTGGCAGGA | 2647 & 2648 |
| CEACAM6 | GGCCTCAATAGGACCACA | GAGCCACCCTGGCCAGCA | 2649 & 2650 |
| CEACAM7 | AGCCACCCAAGCCCTCCA | GAGAGCAGCAGCCTGGGA | 2651 & 2652 |
| CEACAM8 | GCCCAGATGCCCCCACCA | GGTGGATTAGAGGCCGCA | 2653 & 2654 |
| CEBPB | AGAACGAGCGGCTGCAGA | CGAGCAGGGGCTCGGGCA | 2655 & 2656 |
| CEBPD | ACCAGGAGATGCAGCAGA | CGGCCAGGTCCCGCGTGA | 2657 & 2658 |

FIG. 1 Cont.

| | | | |
|---|---|---|---|
| CECR1 | AACACCCCGCAGTCAGGA | GACAAGCCTTTGGCACCA | 2659 & 2660 |
| CECR5 | GCGTCTACAATCCCAGGA | ACCAGCTGCACAGCCTCA | 2661 & 2662 |
| CEL | ACAGCGGCTACCTGGAGA | TGAGGGTCCAGTAGCGCA | 2663 & 2664 |
| CELA2A | CGGCACCATTCTACCCAA | ACGCCATCACCCCCAGCA | 2665 & 2666 |
| CELA2B | CAGCACCGTGAAGACGAA | GTGAGGCTGCCGATGCCA | 2667 & 2668 |
| CELA3A | AGGTCCACGGTGTGACCA | CCAGTCGATGAAGGCGGA | 2669 & 2670 |
| CELA3B | CCCAGACAAGCTGCAGGA | GGTCCTCCAGAGTCACCA | 2671 & 2672 |
| CELF2 | CGCCACAGGCTTGACGAA | GGCTGTACAGAGTGGGCA | 2673 & 2674 |
| CELF4 | ACCCCTACCCAGCACAGA | ATTGGAGGCGGCTGAGGA | 2675 & 2676 |
| CELSR1 | GTCCAGGAACCGGACACA | TCAGGAGGACGAAGGCCA | 2677 & 2678 |
| CELSR2 | TGAGCGGCTACAGCGGAA | TGTGTGGCAGACAGCCCA | 2679 & 2680 |
| CENPA | GGCTAAAGGAGATCCGAA | CCAGGCGGCTGAAGGGCA | 2681 & 2682 |
| CENPE | GGGAGAAAAGAGCAGGCA | TTGAGCCGCACACCTGCA | 2683 & 2684 |
| CENPF | GCTGACATCCCGACAGGA | GCCGAGACTCAGTGGGGA | 2685 & 2686 |
| CENPJ | GGGCATCAGCAGCAGAGA | GAGGATCTCGAGGGCTCA | 2687 & 2688 |
| CENPN | GTGAGGAAAAGCGTGCAA | CCAGGCAATTCGAATCCA | 2689 & 2690 |
| CEP152 | GGCCGAGCTCTCTAAGGA | GCATGGTGTCCAGCAGCA | 2691 & 2692 |
| CEP170 | AGCAGCAGAGCCTCCCGA | AGACGGATGACAGCAGCA | 2693 & 2694 |
| CEP192 | CGCATGCCACTGTGCCAA | CTGCTAGCCGAGTGACCA | 2695 & 2696 |
| CEP250 | TGGAGCGAGAACGGAGGA | GCTGAGCTTGCAGCAGGA | 2697 & 2698 |
| CEP57 | CCATGCCGTGGTAGCCAA | ATACCGTTGGAGGAGGGA | 2699 & 2700 |
| CEP72 | CTGCACAGCAACGAGGCA | AAGGCGGCTTTGCAGGGA | 2701 & 2702 |
| CER1 | CTGCCAAGTTCACCACGA | ACTGGCACTCCTCCACCA | 2703 & 2704 |
| CERCAM | CCAGCACCCCAACGAGCA | GCATAGTGGGTAGGGGCA | 2705 & 2706 |
| CES1 | ACCCAGGCTCTGTGACCA | GAAGTGAGGGCCACGCCA | 2707 & 2708 |
| CES3 | CTCGGACGCACAAGCCAA | TCAGCCTTCACCCAGGCA | 2709 & 2710 |
| CES4A | TGGCTGGATGCAACCACA | TCACCACACCATCCACCA | 2711 & 2712 |
| CES5A | CCCTTACCTGGAGGCCCA | TCCTCAGGCACCTCAGCA | 2713 & 2714 |
| CETP | GGGCTTCAACACCAACCA | GGCAGGAGATCTTGGGCA | 2715 & 2716 |
| CFB | GCAACCATGGCAGGCCAA | CAGACACCACAGCCCCCA | 2717 & 2718 |
| CFC1 | CACTCAGAAGCACCGACA | GAAGCTGCCCAGCACGCA | 2719 & 2720 |
| CFC1B | GACGCCTGACCGCTGTGA | GCAGGAGTGCGCAGGGCA | 2721 & 2722 |
| CFD | GGACAGCTGCAAGGGTGA | CTGTCGATCCAGGCCGCA | 2723 & 2724 |
| CFH | AGGCGGGTGAGCAAGTGA | GGGCGGATTCACACAGGA | 2725 & 2726 |
| CFHR1 | GATGGTCACCAACACCAA | GGGCGGATTCACACAGGA | 2727 & 2728 |
| CFHR3 | TGGTCACCAGCAGTACCA | GCATCTGGGAGTAGGAGA | 2729 & 2730 |
| CFHR4 | GAAACACCACAGGTTCCA | ATAGGTGGAGGAGGCCCA | 2731 & 2732 |
| CFHR5 | AGGGTCAACAGTGACGTA | CACACATGGATCTAGGCA | 2733 & 2734 |
| CFI | AGACTGGATACACCCCGA | ATGGAACGAGGCAGCTCA | 2735 & 2736 |
| CFL1 | GGGCCAGACTGTCGACGA | ATAGAGGGCATAGCGGCA | 2737 & 2738 |
| CFLAR | AAGCGAGGGCTGTGCACA | GCACTGCAGGTACAGGGA | 2739 & 2740 |
| CFP | GCTGCCACGGTGTGAGGA | AGCAGGCACGTGTAGACA | 2741 & 2742 |
| CFTR | GCCTTCTGGGAGGAGGGA | GCTCCAGTGGATCCAGCA | 2743 & 2744 |
| CGA | ACGTCACCTCAGAGTCCA | ACAAGTACTGCAGTGGCA | 2745 & 2746 |
| CGB | GGTGTGCAACTACCGCGA | GGAGGGGCCTTTGAGGAA | 2747 & 2748 |
| CGB2 | GCCGGCTACTGCCCCACCA | CCACGGCGTAGGAGACCA | 2749 & 2750 |
| CGB5 | GCTGGACCAGTGAGAGGA | GCAGCAGCAACAGCAGCA | 2751 & 2752 |
| CGB7 | GTGCCGGCTACTGCCCCA | AGGAAGAGGAGGCCTGGA | 2753 & 2754 |
| CGREF1 | AGTGCTCGAGACCCAGGA | TGAGGGCTACTCCCGGGA | 2755 & 2756 |
| CGRRF1 | TGAAGCTCTGCAGAAGCA | GCTACCAATGGATAGCGA | 2757 & 2758 |
| CH25H | GCCCTCCTGCCCCACGAA | TGCGGTACAGCCAGGGCA | 2759 & 2760 |
| CHAC1 | GATGCTCCTGACCAACCA | TGAAGTCTGCCAGACGCA | 2761 & 2762 |
| CHAD | CCTTCGACAGCCTGGAGA | AACTTGGCAGGTGAGGCA | 2763 & 2764 |
| CHADL | GCTGCACCTGGACAGGAA | GAAGAGGTGCTGCAGCGA | 2765 & 2766 |
| CHAF1A | CTTCCAGGCAGACACGGA | TCCGGAAGCGGCTCCACA | 2767 & 2768 |
| CHAMP1 | TCCCAAACCCCAGAAGCA | TGGAGATGCAGCTGGGGA | 2769 & 2770 |
| CHAT | CTACAACCCCCAGCCAGA | TCTCAGTAGGCGGCAGCA | 2771 & 2772 |
| CHCHD10 | CGCCTACGAGATCAGGCA | GGAGCTCAGACCATGGTA | 2773 & 2774 |
| CHD1 | GAACAAGAGCCCCAGGAA | GGCAACCTTGAACTGGGA | 2775 & 2776 |
| CHD1L | AGCGATCCGCTGAGCCAA | GACAGGACATTGGAACGA | 2777 & 2778 |
| CHD2 | TCCACCATGGGGAAGCGA | CTTCCGGAACGGTGGGCA | 2779 & 2780 |
| CHD3 | GGGAGAGGAAGAAGGGGA | GGAATGTCAGGCAGGGGA | 2781 & 2782 |
| CHD4 | GGCCTCCAGAAACGCCAA | CCAGGAGAAGCGCAACCA | 2783 & 2784 |
| CHD5 | GGGCTTCAATGCCCGACA | CTCGAAGGTCCCGCACCA | 2785 & 2786 |
| CHD6 | CACGTGGGAGCTAGAGGA | CCAGCTGGTACTCCCGGA | 2787 & 2788 |
| CHD7 | GGAGCGAGCAGAAGAGGA | AGCTGGAGCGACTGGAGA | 2789 & 2790 |
| CHD8 | CTCTGAGTGGCCCAAGGA | GGGACTGGAGAGTCACCA | 2791 & 2792 |
| CHD9 | GCGTCGCGTCACTGAGCA | AATACGAGGCTGCCAGCA | 2793 & 2794 |
| CHEK1 | GGGACCAACCCAGTGACA | CTCTGACACACCACCTGA | 2795 & 2796 |
| CHEK2 | GCAAGAGAGGCAGACCCA | GAAGGTACTGCACAGCCA | 2797 & 2798 |
| CHFR | CCCTCTGCAAGGAAGCCA | CCCAGTACAGGTGGCAGA | 2799 & 2800 |
| CHGA | GATGGACCAGCTGGCCAA | CCGGGAGGATGGCCTCCA | 2801 & 2802 |
| CHGB | AGGGAAGTGGCAGCAGCA | CCACTGGAGAGGGTCGTA | 2803 & 2804 |
| CHI3L1 | AGGATACGACGACCAGGA | TGGTGAGAGGGAAGCGCA | 2805 & 2806 |
| CHI3L2 | GTCATGGGCATCCCCACA | ATAGGCCAGGAAGCCTGA | 2807 & 2808 |
| CHIA | TGGGCCCTATGCCAAGGA | CCAGATCAATGGCCCAGA | 2809 & 2810 |
| CHIC2 | GGAAGAGGAGGACGAGGA | TACGGTGACGTGACCGGA | 2811 & 2812 |
| CHID1 | GCCAGGTACATCCAGACA | TAGAGACCCCAACGCCCA | 2813 & 2814 |
| CHIT1 | GCCCTCTGAACCTGAGCA | GGATTGGGATAGAGCCCA | 2815 & 2816 |
| CHKA | TTCAAGGGGCTGAGGCCA | CCAGTCGGCCTTGGGGAA | 2817 & 2818 |
| CHL1 | AAGCCACAGGGAGCCCCA | GACTGAGGGTCAGGCCCA | 2819 & 2820 |
| CHMP1A | CGCAGGAGCAGGTGGACA | CGGCCAACCTCCGTGACA | 2821 & 2822 |

FIG. 1 Cont.

| | | | |
|---|---|---|---|
| CHMP4A | GCACAAACTGACGGGACA | GCAGCAAGCTCCATGGTA | 2823 & 2824 |
| CHMP4C | CCTCCGAACTCCACAGCA | CTCCCGAAGTCGGACCA | 2825 & 2826 |
| CHN1 | GGGAGTGAAATGTGCAGA | ACGAGCGTCGTAAGGTCA | 2827 & 2828 |
| CHPF | AGTGTGCAGACAGCCGCA | GGAAGTCAGGCGTGAGCA | 2829 & 2830 |
| CHPF2 | GGCCAGGAAGAGGAGGAA | TGCAGTCTCGCAGGGAGA | 2831 & 2832 |
| CHRD | GGCACCTGGCAAAAGGCA | GGGAGACCAGGCACCACA | 2833 & 2834 |
| CHRDL1 | CCGGGTATGCAGAGGAGA | AAGCGGGACAGACCTCCA | 2835 & 2836 |
| CHRDL2 | CTCGCCACTTCAGACCCA | CTTCCCGCCATGCACACA | 2837 & 2838 |
| CHRFAM7A | CTGCCAGGACGAAAGCGA | CCGACATCAGGATGCCGA | 2839 & 2840 |
| CHRM1 | GCAGCTGGCCAAGCGGAA | AGCACAGCCAGTAGCCCA | 2841 & 2842 |
| CHRM2 | CCAGTCAAGCGGACCACA | GCTGCAATAGCCGTACCA | 2843 & 2844 |
| CHRM3 | CTCCGAGCAGATGGACCA | GACCCGGAAGCTTGAGCA | 2845 & 2846 |
| CHRM4 | CAGCATCGCTCGCAACCA | ACCACACCGTGTCAGGGA | 2847 & 2848 |
| CHRM5 | CAAGCGCCAATTGGGCCA | GAGCAGCTGCTGGAGACA | 2849 & 2850 |
| CHRNA1 | AAAGTGCCATCGAGGGCA | ACACGGCTAGGGTTCCGA | 2851 & 2852 |
| CHRNA10 | TGCACCACGTAGCCACCA | TGACCAGGGCCATGGAGA | 2853 & 2854 |
| CHRNA2 | GAGGAGGACAGATGGGCA | CAGCATCCTCAGACCGCA | 2855 & 2856 |
| CHRNA4 | CGTCCGTGGTCAAGGACA | TCCAGGGGCTGCTGAGGA | 2857 & 2858 |
| CHRNA7 | CTGCCAGGACGAAAGCGA | TGGACACGGCCTCCACGA | 2859 & 2860 |
| CHRNA9 | CGGTGCCACACTGGGCCA | GTGGTGCGGGCTGAGGCA | 2861 & 2862 |
| CHRNB1 | CGATGCGCTGAAGGAGGA | GGTACGTGGCGTCCAGGA | 2863 & 2864 |
| CHRNB2 | ACTGGAAGTACGTCGCCA | GGAAGAGAGGCTGCAGGA | 2865 & 2866 |
| CHRND | CCCAGCAAGCTCTGAGCA | CCATGACAGGCGTCACCA | 2867 & 2868 |
| CHRNG | TGCCCCAGCTGCTGAGGA | GATCGACCATCCCGAGGA | 2869 & 2870 |
| CHST1 | TGGGCATCCCGCTGGACA | TGTCGTAGGAGAGGCGGA | 2871 & 2872 |
| CHST10 | CGACTATCCCTCCGGGCA | GGGCATACAGGCGTCGGA | 2873 & 2874 |
| CHST11 | TCCGGGAGCCCTTCGAGA | ACCGCTTGTGGAAGGAGA | 2875 & 2876 |
| CHST12 | ACTCCAGGTGGACCGGCA | CCAGGGGGATCTTGGCGA | 2877 & 2878 |
| CHST13 | CTACGACGTCGTGGGCAA | AGGGGCTGATGTCCCGGA | 2879 & 2880 |
| CHST15 | GGCCAGCTCTGCAAAGGA | TAGAAGAACGTCCAGGCA | 2881 & 2882 |
| CHST2 | CCGTCAAGACACTACGGA | CTTGGAGGAGGAGCCCGA | 2883 & 2884 |
| CHST3 | CCGCGACGTGCTCAAGCA | TGACGAAGGGCGTACAGA | 2885 & 2886 |
| CHST4 | GCCAAAGCCAGCTGGAGA | CCAGGTCCTCATAGCGCA | 2887 & 2888 |
| CHST5 | CGGGGATCGGCAAGCCAA | TGGTCCGCAGAGTACACA | 2889 & 2890 |
| CHST6 | CGTCCAGGAATGCGCTCA | TCAGGCCTCGTGGCAGCA | 2891 & 2892 |
| CHST7 | ACACCGCCTGCGAGCGCA | GCAACAGGGGCACCAGCA | 2893 & 2894 |
| CHST8 | CATGGAGGACGATGCCAA | CGAAGTACTGGTGGGCGA | 2895 & 2896 |
| CHSY3 | CAGGAGGATGGTGCCACA | ACACACTGAGTCCCACCA | 2897 & 2898 |
| CHTF8 | TCGAGGCTCGCTACAGCA | CAGTCCTGATCCCCAGGA | 2899 & 2900 |
| CHUK | GGACCGTGTGCTCAAGGA | CCTACAAGGGACCGGGCA | 2901 & 2902 |
| CIC | GGGCAGAACGGCTACACA | GAGTACGATGCAGGGCCA | 2903 & 2904 |
| CIDEA | CGCCGAAGAGGTCGGGAA | GCACCGGATGTCGTAGGA | 2905 & 2906 |
| CIITA | GCAGCACGTGGTACAGGA | CACAGCTGAGTCCCACGA | 2907 & 2908 |
| CILP | TGGTGGGCAACCTGGAGA | AGGCCCTAGGGTTGGACA | 2909 & 2910 |
| CILP2 | GTCACTGACCAGAGCCCA | GGAGAAGCCGTCAGAGGA | 2911 & 2912 |
| CIR1 | TATGAAGCCCCACCAGGA | GCCATCAGTGGGAACCGA | 2913 & 2914 |
| CIRH1A | GTCATCCGGAGGCGCACA | GGTGGTGGGAGCTGAGCA | 2915 & 2916 |
| CISH | GCCCCACCAATGTACGCA | GGTATCAGCAGTGCAGGA | 2917 & 2918 |
| CIT | GGATGAAGGTGCCCAGGA | GCGAGTTCGGAAGCACCA | 2919 & 2920 |
| CITED2 | CCGGGGACTGTGAACGGA | GGGACCCATGAACTGGGA | 2921 & 2922 |
| CKAP4 | CAGTCAGGACCAAGCCCA | CCACAGCAGTCCTGAGCA | 2923 & 2924 |
| CKAP5 | AGGGACCAGCTGAGGACA | GGAATTCTCGGCGGACCA | 2925 & 2926 |
| CKB | GCACAGGCGGTGTGGACA | TCACTCCGTCCACCACCA | 2927 & 2928 |
| CKLF | GTGTGAAAGGCCACGTGA | TGGTAAGGACCGCTGGGA | 2929 & 2930 |
| CKM | ACAGGTGGCGTGGACACA | GCTTCACACCATCCACCA | 2931 & 2932 |
| CKMT1A | AAGCGTGGTACTGGAGGA | CGATGACCAGTTGCACCA | 2933 & 2934 |
| CKMT1B | ACTCGAGCAGAGCGACGA | TGCAGTCAGCAACGGGGA | 2935 & 2936 |
| CKMT2 | GGATCCCAAAGCTCAGCA | GCGGCAGTGTCCACACCA | 2937 & 2938 |
| CKS1B | GCTGGTCCCTAAAACCCA | CGGAACAGCAAGATGTGA | 2939 & 2940 |
| CLASP1 | AGCCGAGACCTTGAGGAA | TCATACTCAGCAGCACCA | 2941 & 2942 |
| CLASP2 | GAGCAGGAGGTGATGCTA | TCGAGAGCGTGGAGAGGA | 2943 & 2944 |
| CLC | GTGACAATCAAAGGGCGA | ATGACCACACGACGACCA | 2945 & 2946 |
| CLCA1 | GCACCGTGGGAAAGGACA | AGCATTGGACGCACGGGA | 2947 & 2948 |
| CLCA2 | CATAAGCACCCCAGCCCA | GGCCAGCTGGAACTCCCA | 2949 & 2950 |
| CLCC1 | GGATTGACCCCACAGACA | GCACATGACAAGTCAGGA | 2951 & 2952 |
| CLCF1 | TCAACCGTCAGGCTGCCA | CCTTGGCCGAGCGCCACA | 2953 & 2954 |
| CLCN2 | GGCACTGCACAGGACCAA | CCCCCAACAATGCCACCA | 2955 & 2956 |
| CLCN3 | CTGATCGTCCAGCAGGCA | GCAAGCTGCTCCACCGCA | 2957 & 2958 |
| CLCN4 | GAACGCCAGACAGAGGCA | ACGGGCTGAGGTTCAGGA | 2959 & 2960 |
| CLCN5 | GAAGCGAAAGACCACCCA | CAGCCGGTCTGTCAGGCA | 2961 & 2962 |
| CLCNKA | CCACACTGGCCAAGGACA | GCACGATGCCTACCAGGA | 2963 & 2964 |
| CLDN1 | CCTGCGTGTCGCAGAGCA | ATGCCAACGGTGGCCACA | 2965 & 2966 |
| CLDN11 | CCCACCGTGAGACCACCA | GGATGACACAGCCACCCA | 2967 & 2968 |
| CLDN14 | GCATCTACCAGTGCCAGA | AGACGGCCACCATGCACA | 2969 & 2970 |
| CLDN15 | CCCCGGAACCAAGTACGA | GTCCTCGTCAGAGCCGCA | 2971 & 2972 |
| CLDN16 | GCCACTTAAGTGGGGCCA | TGACGCATTCCCACCAGA | 2973 & 2974 |
| CLDN18 | CCCTGAAATGCATCCGCA | CCCACGAACAGAGCCGCA | 2975 & 2976 |
| CLDN19 | CACCCTGGTGACCCAGGA | CTCCGGGCATGTGCAGCA | 2977 & 2978 |
| CLDN3 | CCAAGGCCAAGATCACCA | TCTGCGCCTCGGGCACCA | 2979 & 2980 |
| CLDN4 | TGGAGGATGAAAGCGCCA | TGTGGGCCGTCCAGGACA | 2981 & 2982 |
| CLDN5 | CGTGTGGCCCTCACGGGA | TGTACAGCGCTGCGCCCA | 2983 & 2984 |
| CLDN6 | CAGGACCTGCAGGCTGCA | TCCCAGAGGTGAGCACCA | 2985 & 2986 |

FIG. 1 Cont.

| | | | |
|---|---|---|---|
| CLDN7 | TAGCCATGGGTGGAGGCA | AGAGCGGGGTACACGGTA | 2987 & 2988 |
| CLDN8 | AGGCAGCCAGAGGACTGA | GCACCACCATGCCCGTGA | 2989 & 2990 |
| CLDN9 | GCACGCCATCATCCAGGA | ATGGAGTAGCCCAGCCGA | 2991 & 2992 |
| CLDND1 | CCACCATTGCCACGGGCA | TGAAGAGAGCAGAAGCCA | 2993 & 2994 |
| CLEC10A | GAAGGCACACCTAGGCCA | CAGCCTCGGCCCAGGACA | 2995 & 2996 |
| CLEC11A | CGTGGTCGAGCTGACCCA | AGCTTCGAAGTCGCGCGA | 2997 & 2998 |
| CLEC16A | CTCCACCTCCACTCAGCA | CGAGCTGGTGCCTCCAGA | 2999 & 3000 |
| CLEC18A | CCTGAGGATCGACGGAGA | CCAGATAGAAGGCGAGGA | 3001 & 3002 |
| CLEC18B | CCCCGGAGGCAACTGGGA | GCCAGGGGGACAGTGGCA | 3003 & 3004 |
| CLEC18C | CTGTGAGGTCCCCAGGAA | CCGTAGCCGATGTCACAGA | 3005 & 3006 |
| CLEC1B | CCTGTGACACAAACTGGA | GCGAGATAATCCGACCCA | 3007 & 3008 |
| CLEC2D | CATGCCCAGAAAGCTGGA | ACCTGAGCAAGATCAGCA | 3009 & 3010 |
| CLEC3A | CAGCTCAGGGCAAGTGGA | AGGGATGGTGAACTCGCA | 3011 & 3012 |
| CLEC3B | GATCACCGCGCAACCCGA | ACTGGCAGATGTAGGGCA | 3013 & 3014 |
| CLEC4A | TGAGCCCAGTGATCCCAA | CCTTTGAGGACCAAGACA | 3015 & 3016 |
| CLEC4C | ACACCAGGGAAGAACAGGA | ATCGCACAACGCTCATCAA | 3017 & 3018 |
| CLEC4E | CACAATGCACAGAGAGAGGA | GATGCGAAATGTCACAACACA | 3019 & 3020 |
| CLEC5A | ACACGCCAGAGAAACTGA | TAGGCCAATGGTCGCACA | 3021 & 3022 |
| CLEC6A | GGGGCTTTCAGACCCACA | AACATCATTCCAGCCCCA | 3023 & 3024 |
| CLEC7A | GCTACCCAAGAAAACCCA | ATGAGGGCACACTACACA | 3025 & 3026 |
| CLGN | CTGGAATGAAGACACGGA | TCACCACACCCAATCCGA | 3027 & 3028 |
| CLIC2 | CTTAGCCCCAGGTACCAA | AAGAGGTTACAGCCCACA | 3029 & 3030 |
| CLIC3 | AGACAGACACGCTGCAGA | AGCTGTCCAGCCTGGCGA | 3031 & 3032 |
| CLIP1 | CAGCCAAAGCCAAGGCCA | CCTGGCGTAACGGGAGGA | 3033 & 3034 |
| CLIP2 | TGGAGGCAGAGCTGGAGA | GACGATTGGCCTCCAGCA | 3035 & 3036 |
| CLN5 | GGAGGTAGACACGGCACA | ACTGGGATAGGTGAGCCA | 3037 & 3038 |
| CLN6 | TGGTCACCGAGGGCCAGA | ACAGCCAGGCGACCCAGA | 3039 & 3040 |
| CLN8 | GGGACGGCCTGGTCAGCA | AAGTTCCAGTCCACCGGA | 3041 & 3042 |
| CLNS1A | GCAGCAGCCAGACACTGA | CAAGACAGGCGGCTCTCA | 3043 & 3044 |
| CLOCK | CTGACCCAGCCACCGCAA | GGGTCGGGCAAGCTGTCA | 3045 & 3046 |
| CLP1 | AAGTTGGGGCACCCACCA | TCTCGCCCAGGAGTGACA | 3047 & 3048 |
| CLPB | CGGTGGAGGACTCAGACA | CGATGATCTCCAGACGCA | 3049 & 3050 |
| CLPS | GGCCAGCGAGAACAGCGA | GCGTCATGGCAGATGCCA | 3051 & 3052 |
| CLPX | GAATCATCAGCAGGAGGA | TGCAATGGAACCACCACA | 3053 & 3054 |
| CLSPN | GGTGGAGGAAGGAGCGAA | ACCATAGGGCGACTGGCA | 3055 & 3056 |
| CLSTN1 | GCAGCTCTGAACTGGGCA | GCCAGTTCCGATAGCGCA | 3057 & 3058 |
| CLSTN2 | CTGGTGTGAGAGCCGAGA | AGGCGGCAGTTGTGCACA | 3059 & 3060 |
| CLSTN3 | CTGGACACAGCCTAGCCA | CCAGGACGACCATGAGCA | 3061 & 3062 |
| CLTA | GTCGTCCCCAGGCACTGA | AGATGAGGACTGAGCGCA | 3063 & 3064 |
| CLTC | GAAACTGCATGGAGGCACA | TGGGGAGGGACGGCAACA | 3065 & 3066 |
| CLTCL1 | CGCTGTTACGAGGAGGGA | ACAGCTGTGCGAAGCGGA | 3067 & 3068 |
| CLU | CATACGAGAAGGCGACGA | AGGAGGAGGTGTTGAGCA | 3069 & 3070 |
| CLUL1 | AAAGCTCCTGACCACGGA | GGTCAAGTTCCCCACACA | 3071 & 3072 |
| CLVS1 | AGGCAGATGATCCCGGCA | AATGACAGCAGGATGGCA | 3073 & 3074 |
| CMA1 | GAGACTCATGGATCCCCA | CCCTGGGCCACCCCAGCA | 3075 & 3076 |
| CMBL | CAGTTGCCCAATACCAGA | CACCCCAGCAGAATCCCA | 3077 & 3078 |
| CMKLR1 | ACAGCTGCATGAACCCCA | AGAGCATTGACCAGGCGA | 3079 & 3080 |
| CMPK2 | GACCAGGGAAGAAGCAGA | AGGGGCTGGCATCAACCA | 3081 & 3082 |
| CMYA5 | CGTCAGAGTGGCTACCCA | CTTCCTCCGGGAAGGACA | 3083 & 3084 |
| CNBP | AAGAGAGAGCGAGAGCAA | GCATGGTCGCAGTCACGA | 3085 & 3086 |
| CNDP1 | CCCAGTATCTCGCAGCAA | CCAGCGGAATTAGCACCA | 3087 & 3088 |
| CNDP2 | GCCAGACTTGACCAGGGA | CTGACCCCACAGGCAGCA | 3089 & 3090 |
| CNGB1 | GGCGCATGCTGAGAAGCA | CCTGTCATAGCGAGGGCA | 3091 & 3092 |
| CNIH2 | CAAGAACCCCATCGACCA | CATCTGCAGGACGGTGGA | 3093 & 3094 |
| CNN2 | CGACCATCAGCCTCCAGA | CGCCCTGCGTGTAGCCCA | 3095 & 3096 |
| CNN3 | CCGGTGGACAACTCGACA | ACTTGCCGCCCAAGCCCA | 3097 & 3098 |
| CNNM4 | CTCGGCAGCAGTACCAGA | TCTCGTCCACCACAGGCA | 3099 & 3100 |
| CNOT1 | GCCCAGCCCATGAAGCAA | CGCAGCAGAAGGTCAGCA | 3101 & 3102 |
| CNOT2 | CACTCAGTTACCGAGCCA | GGAGATGGAGGCGTGTGA | 3103 & 3104 |
| CNOT3 | AACGCTGCACCTGACCGA | AGTCAGAGGGGTGAGGCA | 3105 & 3106 |
| CNOT4 | ACCACACAGCAAACCCCA | TGTGAGGGCCTGAAGGGA | 3107 & 3108 |
| CNOT6 | AGCTGAACACCTTAGGCA | AAGGCAGTAAGAGCTCCA | 3109 & 3110 |
| CNP | AGGCCTTCACGCTGACCA | CGTCAGCTGCACAGCCGA | 3111 & 3112 |
| CNPY2 | ATGTGACCGGATGAAGGA | GCCCACTACACGTACGTA | 3113 & 3114 |
| CNPY3 | GCCTGCACAAGGAGAGGA | AACTCTTCCACCAGCACA | 3115 & 3116 |
| CNPY4 | GTTGAAGGAGGAGGACGA | GCACCTGCCCCAGCTCCA | 3117 & 3118 |
| CNR1 | CTGGAAGGCTCACAGCCA | TGCAAGCAGAGGGCCCCA | 3119 & 3120 |
| CNR2 | CGCTCAGTGACCAGGTCA | CAGGCAGTGATGGGCAGA | 3121 & 3122 |
| CNRIP1 | AACGGCAACCCATCCAGA | GGGGCTTCCCCACTGGCA | 3123 & 3124 |
| CNTF | GCAATGAGGCTGATGGGA | ACGAAGGTCATGGATGGA | 3125 & 3126 |
| CNTFR | AGACCACGACCAGCACCA | TGATGGGGACGCTGACCA | 3127 & 3128 |
| CNTN1 | CCGCGTGGTAGCAACCAA | ACATCTGAAGGAGCCACA | 3129 & 3130 |
| CNTN2 | TCAGGACTCAGCGGAGGA | AGGACAGCAGGTAGCCGA | 3131 & 3132 |
| CNTN3 | GGGGGTGGAAAGGAGGAA | CAGCCGTGTAATAGGCCA | 3133 & 3134 |
| CNTN4 | GAGGAGATGGCAGCAGCA | TTCGAAGTGGAAGCCCCA | 3135 & 3136 |
| CNTN6 | GAACCTCAACTGGCCCCA | AGACCTCATAGCCCAGCA | 3137 & 3138 |
| CNTNAP1 | TGAGCCGGCCAGTGCCA | CGGGCACAGGCCGACCA | 3139 & 3140 |
| CNTNAP2 | CCTGGAGCTCTACAGCCA | GCTGGTGCAATGGCCCGA | 3141 & 3142 |
| CNTNAP3 | CCTGCGGCATCACAGACA | GGAGAAGGTGTCCCACGA | 3143 & 3144 |
| COASY | AGCTGGCCCGAGAGGAGA | GCCAGCCGGCTTCAAGCA | 3145 & 3146 |
| COBRA1 | GCGGTTCGTGGACAGCAA | TGGCGAAGGGGTCACACA | 3147 & 3148 |
| COCH | GATGTCCAAGGCCCTGCA | CCAGAGGTGCCCAAGCCA | 3149 & 3150 |

FIG. 1 Cont.

| | | | |
|---|---|---|---|
| COG1 | GACAGCCAAGGGTGACGA | GTTCGCTGCACCAGGCGA | 3151 & 3152 |
| COG2 | GGACAAGCTTCAGGAGCA | GGAGGGCACACAGGCTGA | 3153 & 3154 |
| COG3 | CCTAGACCACAGACCACA | TGACGCTCCAAGTAAGGA | 3155 & 3156 |
| COIL | GCAGAGTCAGACGACCAA | TGAGCCAGAACGCCTCCA | 3157 & 3158 |
| COL10A1 | TGGGACCCCAAGGACCAA | ACAGGGCCTGGGAGACCA | 3159 & 3160 |
| COL11A1 | GCAGGCCAAGATGGACCA | CCAGGTGGACCTAAGGGA | 3161 & 3162 |
| COL11A2 | GGCTGCCAGACACAGCAA | TGAAGCAGACAGGCCCCA | 3163 & 3164 |
| COL12A1 | GAAGCCCCTACAGAGCCA | GTCCCCAATGCTCCAGGA | 3165 & 3166 |
| COL14A1 | CCAGGCGTTGGAACCCAA | CCAGGCTGGCCAGAAGGA | 3167 & 3168 |
| COL15A1 | GGCAGGAGCAGAAGCAGA | CTGGAGGACCTCTCAGCA | 3169 & 3170 |
| COL16A1 | TGCAGGACAGAAGGGCCA | ACAGGCCCCATGGAACCA | 3171 & 3172 |
| COL17A1 | CTCAGAGCTGGCAAGCCA | TCATCCCGCTGCAGCACA | 3173 & 3174 |
| COL19A1 | GGACCCTCAGGAAAGCCA | GTGGACCCATAGGACCGA | 3175 & 3176 |
| COL1A1 | CTGGCAAAGAAGGCGGCA | CCAGCAGGACCATCAGCA | 3177 & 3178 |
| COL1A2 | AGGTCCTAGTGGCCCACA | GACCAGCGATACCAGGCA | 3179 & 3180 |
| COL20A1 | CCCTACCTCCAGAGCACA | GCATCCAGCAGAACCCCA | 3181 & 3182 |
| COL22A1 | GGCAAAGCAGGAGAGCCA | CCTGACCAGGAAGCCCCA | 3183 & 3184 |
| COL24A1 | GGTCCTAAGGGTGCCAGA | GGTTCACCTCGAGGCCCA | 3185 & 3186 |
| COL25A1 | TGGAATGCCGGGTCCACA | CGTGGACCAGGGAAGCCA | 3187 & 3188 |
| COL27A1 | GGGCCTGGAATGGACAGA | CTGATGAGGCAGGAGGGA | 3189 & 3190 |
| COL28A1 | TCAGAAAGCGTGGGGCCA | GCCGTGGCAAGGTCCAGA | 3191 & 3192 |
| COL2A1 | GGACGAAGCAGCTGGCAA | CAGCCATCCTTCAGGGCA | 3193 & 3194 |
| COL3A1 | GGTCTTGCAGGACCACCA | CGATCACCCTTGCCACCA | 3195 & 3196 |
| COL4A1 | GCCTGCGCAAGTTCAGCA | GTAGCCGATCCACAGCGA | 3197 & 3198 |
| COL4A2 | GTACTTCGAGGGCCAGGA | CGCAGTGGTAGAGAGCCA | 3199 & 3200 |
| COL4A3 | GGAGACATGGGACCACCA | GGGTCTCCACGTACACCA | 3201 & 3202 |
| COL4A4 | GGACCAGGGTGCAAAGGA | AACCCTTTGGGCCCAGGA | 3203 & 3204 |
| COL4A5 | GGTCCAAAGGGCGAACCA | AGACCTGGTCTCCCAGGA | 3205 & 3206 |
| COL4A6 | GAATGCCTGGCCAGAGCA | AGCTGTACCCCACCCACA | 3207 & 3208 |
| COL5A1 | GGCCCTACTGGTGAACCA | GGGATCCCTCGAAGGCCA | 3209 & 3210 |
| COL5A2 | GGGCAACGTGGAGAGAGA | GGGTCTCCACGATCACCA | 3211 & 3212 |
| COL5A3 | AGGGGGAAAAGGGCCACA | CCAATGGGACCAGGGGGA | 3213 & 3214 |
| COL6A1 | CCAGGTGAATGAGCCCCA | GGTGGAAGACACCGCGGA | 3215 & 3216 |
| COL6A2 | GGTGCAGTACAGCCACGA | GCCCGTCCGTGATGACCA | 3217 & 3218 |
| COL6A3 | ACAGCGCTGAGACCACCA | CAACTGCCACTCTGGCGA | 3219 & 3220 |
| COL6A6 | GAATGCCCAGTGCACCCA | AGGCGTCTGAGAAGCGCA | 3221 & 3222 |
| COL7A1 | TCGAGGCGAGAAGGGAGA | TGAGAGACGCGGAGCACA | 3223 & 3224 |
| COL8A1 | GGACCAATAGGTGCCCCA | GGAGGCCCTACTTCACCA | 3225 & 3226 |
| COL8A2 | CACAGCGGCTACAACCCA | CTTGTACAGGGCCACCCA | 3227 & 3228 |
| COL9A1 | GGTCTCCCAGGTGACCCA | AGGAGGCTGGCTCACAGA | 3229 & 3230 |
| COL9A2 | CGTGGGTCAGATCGGCAA | GGCCGAAGCTCCAAGGCA | 3231 & 3232 |

| | | | |
|---|---|---|---|
| COL9A3 | GGTCGGACCCAAAGGAGA | TGCCAGGAACACCCGGGA | 3233 & 3234 |
| COLEC10 | GATGAAGCTGCCAACACA | ACACAGTCCTCATGACCA | 3235 & 3236 |
| COLEC11 | ACTCTGACCACTCCCCCA | GGCCACCATCTCCACGCA | 3237 & 3238 |
| COLEC12 | GGTAGGGAGAGAGAGCCA | CCCATGGCCATGACCCCA | 3239 & 3240 |
| COLQ | CCTTCCGCAGAGACCAGA | CCATCTCCACAGTAGGCA | 3241 & 3242 |
| COMP | TGATGCCTGCGACGACGA | CAGCGTTCTCCGGACACA | 3243 & 3244 |
| COMT | ACCGGTACCTGCCGGACA | GCTAGGAAGTCTGGCGCA | 3245 & 3246 |
| COPA | CCCAGCAGCTCATCACCA | TGAGGGCTGTACGCAGCA | 3247 & 3248 |
| COPB1 | GCAGCAGATCCCCTAGCA | GCGAAGTCATGAGGAGCA | 3249 & 3250 |
| COPB2 | GAGGACCAGAGTTGCACA | CACTCCTGGGCTAGGCCA | 3251 & 3252 |
| COPE | CTGACAAGTGCTCGCCCA | GGACGATGAGGTTGACCA | 3253 & 3254 |
| COPS2 | ACAGGAGGCCAAGCCGTA | ACCAGCAAGCTCTCCACA | 3255 & 3256 |
| COPS5 | TCGGGAGGCAACTTGGAA | TATGCAGCAGCCTGAGCA | 3257 & 3258 |
| COPS6 | GGCCTCTGAAGCGGGAGA | GGTAGGCCATGAGCCCCA | 3259 & 3260 |
| COPS7B | GCAGCAGGTAGAAGCAGA | TGCTCAGCGTGAGGGGGA | 3261 & 3262 |
| COQ3 | GGCTCACAAATGGTGGGA | CCACCACAGCCAACGTCA | 3263 & 3264 |
| COQ5 | GGCACTCCAGGAAGCTCA | GGACAGGGATGACCTGGA | 3265 & 3266 |
| COQ6 | GTGGATGCCAAAAGCCGA | CCCTGTCCTGCAAGCGGA | 3267 & 3268 |
| COQ9 | GCGGAGAAGAGGAAGACA | GTCCCCAGCGTAATGCCA | 3269 & 3270 |
| CORIN | CCCCGCTACAGTCGAGCA | CTCCGGGTTGGGCAAGCA | 3271 & 3272 |
| CORO1A | TGAGAAGGACCGTCCCCA | AAGGGGCCTCGGAAGTGA | 3273 & 3274 |
| CORT | GGTGGGAGAGAAGCTCCA | GGCCACCCTCCAGGGGCA | 3275 & 3276 |
| COX10 | CCACATGGACCTTCCCCA | GGTGCCACAGGCTGCAGA | 3277 & 3278 |
| COX11 | CCGCTGTCGCCGTGGGCA | CTGAGGCATGACCTGCAA | 3279 & 3280 |
| COX15 | AGCCGTGGCATGAAAGGA | GCAACTTGTGCGGAGGGA | 3281 & 3282 |
| COX17 | GACCAAGAAGGCGCGCGA | TCACACAGCAGACCACCA | 3283 & 3284 |
| COX4I1 | TAGTTGGCAAGCGAGCAA | GCAGACAGGTGCTTGACA | 3285 & 3286 |
| COX5A | GCGCTGTGGCCGCAACCA | TGACCCATGGGAATAGCA | 3287 & 3288 |
| COX5B | TTGGCTGCACAAAGGCGA | CCAGCTGCTGGGGCACCA | 3289 & 3290 |
| COX6A1 | CCGGGGTGGCAGTCAGCA | GGAGATGGGGGTAGGCGA | 3291 & 3292 |
| COX6A2 | GCCAGCGCTGCCAAAGGA | TGAAGGTGCAGAGGGCCA | 3293 & 3294 |
| COX6B1 | CTGGCAGAACTACCTGGA | GTACACACGCTGGTACCA | 3295 & 3296 |
| COX6C | GTTTTGCCAAAACCTCGGA | CTTTGATCAGCCACACGA | 3297 & 3298 |
| COX7A1 | AGAACCGAGTGCGCGAGA | CCTGGGGAAGGAGGCCCA | 3299 & 3300 |
| COX7A2 | GTCAGATTGGGCAGAGGA | AGGGCATCAGCTACCCCA | 3301 & 3302 |
| COX7B | AGAGCCACCAGAAACGTA | CTCTGCCAACAGGGGACA | 3303 & 3304 |
| CP | CGCCGGAAATGAGGCCGA | GGCCACATGTGGAGCGTA | 3305 & 3306 |
| CPA1 | GGACCTACAGCCAGGGCA | TGATGGTCAGAAGCGCCA | 3307 & 3308 |
| CPA2 | AAGCCAGTGGAGGAAGCA | CCTCGGCTGTGGGCAGGA | 3309 & 3310 |
| CPA3 | GCCACCTAACCATGAGGA | GCCCAGGTCATAAGCCCA | 3311 & 3312 |
| CPA4 | CAGCTAGCGGGAGCAGCA | GCTGGCAGGAGGAAGCCA | 3313 & 3314 |

FIG. 1 Cont.

| | | | |
|---|---|---|---|
| CPAMD8 | TGAGGGTTCCCGAGGAGA | AGACCCTGCATGCAGCCA | 3315 & 3316 |
| CPB1 | CTCACTGCACGGCACCAA | CCTCGCAGGTAGCCCGGA | 3317 & 3318 |
| CPB2 | GAGGTGGGGACGATTGGA | TGTAACGCTCCGGCAGCA | 3319 & 3320 |
| CPD | CCTGGGCAGCATGAAGGA | CTGCCCACAAGGAAGGGA | 3321 & 3322 |
| CPE | AGGAGACCTTGTGGCCAA | AGAGTATGCCCGGGCCAA | 3323 & 3324 |
| CPEB1 | GGCTTGACCCCAGCAGGA | CAATCCCGGCATACACCA | 3325 & 3326 |
| CPEB2 | GATGAATGCCAGGGCGCA | TGGAACTCACGTCCAGCA | 3327 & 3328 |
| CPEB3 | CACACGCTGTGGTGGGAA | CGGAACGGGACGTGACGA | 3329 & 3330 |
| CPM | AGCCGTCAAAAAGCCTGA | GGAGGTTTGCAGAGAGGA | 3331 & 3332 |
| CPN1 | CGAGCCCTTGGAACCAGA | TCCGGAACTCCTCGCACA | 3333 & 3334 |
| CPN2 | CCGGACGAAAGCAAGGCA | GAGCTGGACGTTCAGCCA | 3335 & 3336 |
| CPNE1 | AGGCTGCACATCAGGGGA | AAGTCAGCACCACCCACA | 3337 & 3338 |
| CPNE2 | CACAACAGCGGACGGCCA | GGAACTCCATGGCAGCGA | 3339 & 3340 |
| CPO | AAGCTCAGATCCAGCCCA | CCCAGCAGCATAGTGGCA | 3341 & 3342 |
| CPOX | TGACCAGCATGGTCCAGA | GGAACTACAGCCCTGGCA | 3343 & 3344 |
| CPS1 | CTGAAGGTGGCTCAGGCA | GGAAGGCCTCAACAAGCA | 3345 & 3346 |
| CPT1A | CCCAGACGGTGGAACAGA | AGGCAGAAGAGGTGACGA | 3347 & 3348 |
| CPT2 | CCATGGCCAGCTGACCAA | CCAGGTAGAGCTCAGGCA | 3349 & 3350 |
| CPVL | GGCATGGACTGGAAAGGA | GCCGGATGTAACCAGCCA | 3351 & 3352 |
| CPXM1 | CAGGAGTGGTGAGGGACA | CGGCACTGGCAGTCACCA | 3353 & 3354 |
| CPXM2 | GCTGCCGAGACCAGAGCA | ATAGGAGTAGGCCAGCCA | 3355 & 3356 |
| CPZ | ACAGCTTCACGGGAGGCA | GGTGCACCGTCTCCACGA | 3357 & 3358 |
| CR1 | ATGTGACCCCCACCCAGA | AGTTCACAGCGAGGGGCA | 3359 & 3360 |
| CR1L | CCCACCCAGACAGAGGGA | AGTTCACAGCGAGGGGCA | 3361 & 3362 |
| CR2 | CACTGTCACCCTCCACCA | GGGCAGCGAGTCACAGGA | 3363 & 3364 |
| CRABP1 | ACGGACGCAAGTGCAGGA | GGCCAGCTCACGGGTCCA | 3365 & 3366 |
| CRABP2 | CCAAGACCTCGTGGACCA | CGTAGACCCTGGTGCACA | 3367 & 3368 |
| CRAT | TGGACACCTCCTACGCCA | GTTGTAGGCCGACAGGGA | 3369 & 3370 |
| CRB1 | GGGCTGTACCCATCAGCA | AGGGACCCGGTGTAGCCA | 3371 & 3372 |
| CRB2 | TGCCTCGATGGCAGCCCA | GGTGCCCCCATTCAAGCA | 3373 & 3374 |
| CRB3 | CAGAAGCCATCACTGCTA | CCCGAAGCTTCCGCACCA | 3375 & 3376 |
| CREB1 | CCAGCAGAGTGGAGATGCA | GAGTTACGGTGGGAGCAGA | 3377 & 3378 |
| CREB3L2 | ACCCACAGCCCCTCCAGA | GGGATGGGATAGCCCTCA | 3379 & 3380 |
| CREB5 | CCAGCTTGCTCCCAGCAA | TACCACCTCGCTGACCGA | 3381 & 3382 |
| CREBBP | CAGATCAGCAGCCCCCAA | CCGGTGCTAGAAGGAGGA | 3383 & 3384 |
| CREG1 | CACCATCTCCACGCTGGA | GCAGGTTGCTCACGGAGA | 3385 & 3386 |
| CREG2 | GCCAGAATCAGAAGGGGA | GAGCGTTAACTGGACACA | 3387 & 3388 |
| CRELD1 | GCTGGCTGCTAAGGGCGA | ATGAAGCCCTCCAGCACA | 3389 & 3390 |
| CRELD2 | CTGCACAGCCTGTGACGA | GCCGCACACTCGTCCACA | 3391 & 3392 |
| CREM | AGCAACACGCAAACGAGA | TCAAGCACAGCCACACGA | 3393 & 3394 |
| CRH | CTCGGCGCTCGCTCGACA | CTTCCCGGAGGAGGTGGA | 3395 & 3396 |
| CRHBP | GGTAGTTCCACACCAGCA | CTCGCAACCTGCTGAGGA | 3397 & 3398 |
| CRHR2 | AAGGCTGCTACCTGCACA | AGGCGACGATGATGGGGA | 3399 & 3400 |
| CRIP2 | GAGCGCTGCGGGAAGACA | CCTTGGGTCCGAAGAGGA | 3401 & 3402 |
| CRISP1 | CAACAAGGATCACCTCGA | GGCAGGCTTCACATGGGA | 3403 & 3404 |
| CRISP2 | GGTGGGCAAACAAGTGCA | AGGCAATTCCACAGCCTA | 3405 & 3406 |
| CRISP3 | CCAAAGACTCCCAACGCA | GCCCAATTACCAGCAGGA | 3407 & 3408 |
| CRISPLD2 | CGTGCAGTCCCTCAGCAA | AACGGGCACAGCTGAGCA | 3409 & 3410 |
| CRK | GCGAAGGCAAGAGAGGGA | GGTTGGGCATAGGGCCCA | 3411 & 3412 |
| CRKL | CCACACGGAAAGCATGGAA | CCCCAGGAGAACCGGAA | 3413 & 3414 |
| CRLF1 | GCTACCGAGTGGAGGACA | TGCAGCGCACTTGCACGA | 3415 & 3416 |
| CRMP1 | CCAGCACCAATGCAGCCA | CGGGGTCCCAGATGACCA | 3417 & 3418 |
| CRNKL1 | TGAGGAGCAAGCCTGGCA | CATCAGGGTGCACGAGGA | 3419 & 3420 |
| CROCC | TCAACAGCACCCGGGACA | GCAGTTCCAGGTCAGCCA | 3421 & 3422 |
| CROT | ATCTCACGCGGGAAGGAA | TGAGCTGCAGGACCCGCA | 3423 & 3424 |
| CRP | CATCTTGGGGCAGGAGCA | GGACTGAAGGGCCCGCCA | 3425 & 3426 |
| CRTAC1 | CTGGAGTGTGGCCAAGGA | TGTCTCGAGGGCACACGA | 3427 & 3428 |
| CRTAM | GCCTAACGTAACCCTGCAA | GGTGGAGCACATGAGTACA | 3429 & 3430 |
| CRTAP | GCGAGGGTTCCAGGGAGA | CAGATAGCTGACTGCACA | 3431 & 3432 |
| CRTC1 | CTTCGACTCCGACAGCCA | CTGGGTCGGCCAGAACCA | 3433 & 3434 |
| CRTC3 | CCCAGCTGCTATGACCCA | GTGAGAGGGCTGACGGGA | 3435 & 3436 |
| CRY2 | TCAGCGTGAACGCAGGCA | GGCCGTGGGTAGTCCACA | 3437 & 3438 |
| CRYAB | CCATCCACCACCCCTGGA | CCAGGCGCATCTCTGAGA | 3439 & 3440 |
| CRYBB1 | ATCCAGGGGGACGACGCA | TGTCACGCAGGCGACGCA | 3441 & 3442 |
| CRYBB3 | GTGGCCGCAAGATGGAGA | CCGGGGAACTCATAGCCA | 3443 & 3444 |
| CRYZ | AAGGAGCTGCCATCGGCA | CACTTGCCCCATGAACCA | 3445 & 3446 |
| CS | GCAGCGGTATTGGGGCCA | GGACAGGTAAGGGTCGGA | 3447 & 3448 |
| CSAD | GGAGCGCATGGTGAAGGA | TGGCCACAACCACACGGA | 3449 & 3450 |
| CSDE1 | CTTCGTCAGCCAAGGGGA | TGACACCAGCTTGACGGA | 3451 & 3452 |
| CSE1L | GAACGCGGTTCAAACACA | CAACTGATTCAGGAGGCA | 3453 & 3454 |
| CSF1 | GAGCACCAGGGATCGGA | CAGCAAGACCAGGATGACA | 3455 & 3456 |
| CSF2 | TGATGGCCAGCCACTACAA | AAGGGGATGACAAGCAGAA | 3457 & 3458 |
| CSF2RA | GCTCCTGGAGTGAAGCCA | GCCGAGGACGATGCCACA | 3459 & 3460 |
| CSF2RB | TCCAGAACGCCCACAGCA | CACAGAAGCGGAGGGCCA | 3461 & 3462 |
| CSF3 | CACCTTGGACACACTGCA | GCGGTACGACACCTCCA | 3463 & 3464 |
| CSF3R | CACGCCACCCATCACCAA | ACCAGAGTGGGGAGGCCA | 3465 & 3466 |
| CSGALNACT1 | GACTGGCCTTACCCGCCA | GCCGTGTAAGGACGGTGA | 3467 & 3468 |
| CSH1 | GGCAGATCCTCAAGCAGA | GCAGTAGAGCAGCCCGTA | 3469 & 3470 |
| CSH2 | GACCACGCTATGCTCCAA | GCTCCAGCCACGACTCGA | 3471 & 3472 |
| CSHL1 | GGCAGACCCTCAAGCAGA | GCAGTGGAGCAGCCCGTA | 3473 & 3474 |
| CSK | CGTGGCCAAGGTCAGCGA | CCTTCTCCACCCGAGGGA | 3475 & 3476 |
| CSMD2 | GTTCTCCCCAGCCACACA | CCCTCCAGGAAGAAGCCA | 3477 & 3478 |

FIG. 1 Cont.

| | | | |
|---|---|---|---|
| CSMD3 | CGCAAAGGGGAAAGCCGA | GCGGCCACATTTAGCGCA | 3479 & 3480 |
| CSN1S1 | TTCCAGCAGCTCAACCAA | GAGCAGTGGGATTGGAGA | 3481 & 3482 |
| CSN2 | AGCAGGTCCCTCAGCCTA | TCTGAGGGTAGGGCACCA | 3483 & 3484 |
| CSNK1D | CTCCGGCATGGAGAGAGA | TGAGGTGGACATGCGAGA | 3485 & 3486 |
| CSNK1G3 | CAAAACGGGCTACACCAA | TGAACTGCACCCACTGGA | 3487 & 3488 |
| CSNK2A1 | TGAAGGACCAGGCTCGAA | ATCCCAAGGGGGTTGGCA | 3489 & 3490 |
| CSNK2A2 | AGGTACTTCAAGGGACCA | GTACCCAGAACCTTGGCA | 3491 & 3492 |
| CSNK2B | CAAGAGACCTGCCAACCA | GCTGCAGCTGGTAGGCCA | 3493 & 3494 |
| CSPP1 | TCCGTGCAGAAGAGGAGA | ACAGGAGCTTGCAACCGA | 3495 & 3496 |
| CSRNP2 | CCTGCAGAGTGCAGAGGA | GGCACAGCTCTTCGGGGA | 3497 & 3498 |
| CSRP1 | GGTTCAGTGCGAAGGCAA | GCCGTAGCAGGACTTGCA | 3499 & 3500 |
| CSRP2 | CCACGCAGAAGAGGTGCA | GCCCTGGCCATAACCGTA | 3501 & 3502 |
| CSRP3 | CAGTCCCCAAAGCCGGCA | CACAGATGGCACAGCGGA | 3503 & 3504 |
| CST1 | GGATAATCCCGGGTGGCA | CTTAGTACCCGCAGCGGA | 3505 & 3506 |
| CST2 | GCCGAACCATATGTACCA | GACACCTGGAATTCACCA | 3507 & 3508 |
| CST3 | ACGTGGAGCTGGGCCGAA | CTGGTCATGGAAGGGGCA | 3509 & 3510 |
| CST5 | CCACAGACCTCAATGACA | AGGCAGCCATCACCTGCA | 3511 & 3512 |
| CST6 | ACTTGCCCCCTGGCAGCA | GAGGAGTTCTGCCAGGGA | 3513 & 3514 |
| CST7 | ACCACACCTTGAAGCAGA | GGAGAACAGGCACCTCGA | 3515 & 3516 |
| CST9 | CGCAGAGGAGGAAGGCTA | ATGAACTCAGGACGCGCA | 3517 & 3518 |
| CST9L | CCTACAGACTGGGGCACA | TCCCCAGCAGTAGCTCCA | 3519 & 3520 |
| CSTA | TCCCGGACAAAATGAGGA | AGCCAGTTGAAGGAATCAGA | 3521 & 3522 |
| CSTB | ACATCGCCGACCAGGTGA | CCTCGTCGCCGACGTGCA | 3523 & 3524 |
| CSTF2 | ATGATCCACGGGGAGGCA | GGCTCTCATGGCCAGGGA | 3525 & 3526 |
| CTAG1B | TTCGCGACACCCATGGAA | GACAGGAGCTGATGGAGA | 3527 & 3528 |
| CTAGE1 | CTCCAGAGGCCCAGGGAA | AAGGCATTGACCCATCCA | 3529 & 3530 |
| CTBP1 | GGGAGATCCGCAGAGCCA | CTTCCACAGCAGCTGGGA | 3531 & 3532 |
| CTBP2 | GGCAGGATACGAGGGGCA | TACCAGGCAGTGTGAGGA | 3533 & 3534 |
| CTBS | TGACGCTGCAGGACGTCA | ACATGCCAATGCCCCGTA | 3535 & 3536 |
| CTCF | AGTGCCCAGACTGCGACA | CACTGGCGTAATCGCACA | 3537 & 3538 |
| CTCFL | GCCGCGAACGGAGACGAA | TCTCTGCAGGCGACAGGA | 3539 & 3540 |
| CTDNEP1 | GCCATCCAGACAATGCCA | ACCTGAGGGCATCCAGCA | 3541 & 3542 |
| CTF1 | CACCAAATACGCTGAGCA | GCCGCTCGTGCACTGGCA | 3543 & 3544 |
| CTGF | CGGGAAATGCTGCGAGGA | CTTGGAACAGGCGCTCCA | 3545 & 3546 |
| CTH | GCCGAGAGCTTGGGAGGA | ATCCTCTAAGCCCACAGA | 3547 & 3548 |
| CTHRC1 | TGCCTGGTCGAGACGGGA | ATCCATCCCGACCTGGGA | 3549 & 3550 |
| CTLA4 | CTGAACCTGGCTACCAGGA | CTGTCAGCCTGCCGAA | 3551 & 3552 |
| CTNNA1 | CCTGATCCAGGCAGCCAA | AGCAGGAAGGTTGAGGGA | 3553 & 3554 |
| CTNNA2 | ATGGGACGACAGCGGCAA | CAGGACACTGATCAGCCA | 3555 & 3556 |
| CTNNA3 | CAGAACCTCAGGCAGCAA | ATGAAGAATCCGCCAGCA | 3557 & 3558 |
| CTNNB1 | CGGGATGTTCACAACCGA | TCACAGAGGACCCCTGCA | 3559 & 3560 |
| CTNND1 | GCGGAAGCTCAAGGGCA | ACAAGGGCAGGCACACCA | 3561 & 3562 |
| CTNS | GTCCTACAACAACGACCA | CGTCGAAGACGATGGAGA | 3563 & 3564 |
| CTPS | CCCGTGCGCTACCACGAA | CAACTGCATCCCTAAGCA | 3565 & 3566 |
| CTRB1 | GTCTGCCAAAAGGATGGA | GTACACGCCAGGGCTGGA | 3567 & 3568 |
| CTRB2 | GGGCAGGAGGATCACCGA | AGGACACAATGCCCACCA | 3569 & 3570 |
| CTRC | CCGTGGTGGATCACGCCA | CCCCATTGCAGGCTGAGA | 3571 & 3572 |
| CTRL | CCTCAGTGGCGTGGGCAA | ACCTGCGCCACCTGCACA | 3573 & 3574 |
| CTSA | CCCTCAACCAGAAGATGGA | GGAGAACATGGTGAAGGCA | 3575 & 3576 |
| CTSB | GGATCTGCATCCACACCA | GCTTCAGCAGGATAGCCA | 3577 & 3578 |
| CTSC | CCACCACACTGGTCTAAGA | CGGATCCGGAAGTAGCCA | 3579 & 3580 |
| CTSD | GAGGCCATTGTGGACACA | CGCCCTGAATCAGCGGCA | 3581 & 3582 |
| CTSE | AACCGTGGTTGGCCAGCA | ACATCGGCAAGTCCACCA | 3583 & 3584 |
| CTSF | GCCTGGCTGGCCAAGAGA | CCCACAAGCAACACCGCA | 3585 & 3586 |
| CTSG | GCAGGGGAGATCATCGGA | CGCACCAGGAACCCTCCA | 3587 & 3588 |
| CTSH | TCTATGACGAGGAAGCGA | GGGTAGGAGGCGCAGGCA | 3589 & 3590 |
| CTSK | AGGGGGCTACATGACCAA | CCCACATATGGGTAGGCA | 3591 & 3592 |
| CTSL | AAGGCCCTGATGAAGGCA | TAGCCAACCACCAGCACA | 3593 & 3594 |
| CTSL1 | AGCAGGAGAAGGCCCTGA | ATCCGTAGCCAACCACCA | 3595 & 3596 |
| CTSL2 | GTTCCGGAAAACTGGGAA | GCGACCACTGTGAAGCCA | 3597 & 3598 |
| CTSO | TGACTGGAGGGACAAGCA | CTGCCCCCACCACGCTGA | 3599 & 3600 |
| CTSS | ACAAGGGCATCGACTCAGA | GCCAACCACAAGTACACCA | 3601 & 3602 |
| CTSV | GAAAGGCTACGTGACGCCA | CGCGAACAGTCCACCAGA | 3603 & 3604 |
| CTSW | CATGGCAGCGGCAGGCAA | TGAACGCGTCCCAGACGA | 3605 & 3606 |
| CTSZ | CCGTGCAGAACGTCATCGA | GCAGGTCTCGTCAGGGA | 3607 & 3608 |
| CTTN | GGAGCAAGCCAGAGCCAA | GCCTTGAAGGAAGCCGCA | 3609 & 3610 |
| CUBN | GCTTCAGGACTCACCGCA | ACTGGCACAGCCGAAGCA | 3611 & 3612 |
| CUL1 | CATCGAGGAAGACCGCAA | AACCTGGAGGACAGCTGA | 3613 & 3614 |
| CUL2 | CCAGCAAGCTACATCGGA | AGCCTGAGTAAGAGGCCA | 3615 & 3616 |
| CUL3 | CCCACCAGCACCAAGACA | GTGCACCTCCAACACCAA | 3617 & 3618 |
| CUL4A | ACGAGGAGCTGGAGCGGA | TCAGCATCGACTGAGGCA | 3619 & 3620 |
| CUL5 | AACACAAGCACCCTCGTA | AATGATGTCACCAGGGCA | 3621 & 3622 |
| CUL7 | GCCACGCTACTGTGAGCA | TTCAGCAAGGCTCCCGCA | 3623 & 3624 |
| CUTA | GTGGAAAGGGAAGATCGA | TAAGGGTGCACAGAACGA | 3625 & 3626 |
| CUX1 | CGAGAGCATGGAGAGGGA | CACAAGTCACCAGCCGCA | 3627 & 3628 |
| CX3CL1 | CACCTACCAGAGCCTCCA | GGGCACCAGGACATATGAA | 3629 & 3630 |
| CX3CR1 | ACTCCATGAACAACCGGA | ATTGCGGAGCACGGGCCA | 3631 & 3632 |
| CXADR | CAAAGAGCCGTACGTCCA | GGGAGAGTCGGACTCTGA | 3633 & 3634 |
| CXCL1 | GGACCCCACTGCGCCCAA | GGATGCAGGATTGAGGCA | 3635 & 3636 |
| CXCL10 | CTGAGCCTACAGCAGAGGA | GAGGTACTCCTTGAATGCCA | 3637 & 3638 |
| CXCL11 | GCACCAGCAGCAACAGCA | CAGGGCCTATGCAAAGACA | 3639 & 3640 |
| CXCL12 | CGTCAGCCTGAGCTACAGA | GGCTACAATCTGAAGGGCA | 3641 & 3642 |

FIG. 1 Cont.

| | | | |
|---|---|---|---|
| CXCL13 | ATCATAGTCTGGAAGAAGAACA | GAGCAGGGATAAGGGAAGA | 3643 & 3644 |
| CXCL14 | GAAGCCAAAGTACCCGCA | GACCTCGGTACCTGGACA | 3645 & 3646 |
| CXCL16 | GGACCCATGGGTTCAGGAA | GAGTGGACTGCAAGGTGGA | 3647 & 3648 |
| CXCL17 | GACACCAAAGGCACCACA | GAAGAGTGGGCGCTCAGA | 3649 & 3650 |
| CXCL2 | CCACTGCGCCCAAACCGA | CGATGCGGGGTTGAGACA | 3651 & 3652 |
| CXCL3 | GCTGAGCCCCATGGCCCA | GCAAGCACTGGCAGCGCA | 3653 & 3654 |
| CXCL5 | TGACGCAGCCAGGGCCCA | ATGGCGAACACTTGCAGA | 3655 & 3656 |
| CXCL6 | GCTGAGAGTAAACCCCAA | GGCTTCCGGGTCCAGACA | 3657 & 3658 |
| CXCL8 | ACACTGCGCCAACACAGA | CACAACCCTCTGCACCCA | 3659 & 3660 |
| CXCL9 | TCAGCACCAACCAAGGGA | AGGAAGGGCTTGGGGCAA | 3661 & 3662 |
| CXCR1 | ACACAGCAAAATGGCGGA | TTGTAGGGCAGCCAGCAA | 3663 & 3664 |
| CXCR2 | ATACAGCAAACTGGCGGA | GGACCAGGTTGTAGGGCA | 3665 & 3666 |
| CXCR3 | GCCGAGAAAGCAGGGTAGA | GCAAGAGCAGCATCCA | 3667 & 3668 |
| CXCR4 | CAACGTCAGTGAGGCAGA | GGATGACAATACCAGGCA | 3669 & 3670 |
| CXCR5 | GAACCAAGCAGAAACGCA | GTGGTAGGGTGACCAGCA | 3671 & 3672 |
| CXCR6 | CGCAGCACACACTGGGAA | GAGCACAGGGTTAAGGCA | 3673 & 3674 |
| CXCR7 | AGGAGTGGCTGATCGGCA | TGTCCAGCAGCACCGCCA | 3675 & 3676 |
| CXorf57 | CGGGAGGGGTGATCCGAA | TACAGGCACCACCTCCGA | 3677 & 3678 |
| CXXC1 | CGCCTGCCCAAGCGCCA | GCAGCATCAGGGCCAGCA | 3679 & 3680 |
| CYB5A | AGCTCCATCCAGATGACA | ACATCAAGGCGACGGCCA | 3681 & 3682 |
| CYB5B | GGAGGTGGCAAAGCGCAA | GAAGCGGGTGACATCGTA | 3683 & 3684 |
| CYB5D2 | CGGAGTGGAGCTCAGCCA | AGCTTCCTGGGGACGCCA | 3685 & 3686 |
| CYB5R1 | GGACAGGAATCACCCCAA | CATCCCCTGGAGCGGGCA | 3687 & 3688 |
| CYB5R3 | CGACCTGAGCTGGAGGAA | GTGGAAGGTGGTCCCGGA | 3689 & 3690 |
| CYB5R4 | GAGAGCAGCAGGATCAGA | CATTCTGCCAACCAGGCA | 3691 & 3692 |
| CYBB | GGACGGCCCAACTGGGA | CACTCCCCGAGGGCCAGA | 3693 & 3694 |
| CYC1 | CCAGAGCACGACCATCGA | TGGTGTAGACCAGGGGCA | 3695 & 3696 |
| CYFIP2 | CCTGCGGAAGATGGCAGA | TGACAATGTCAGCCAGCA | 3697 & 3698 |
| CYGB | CCTTGTGGGGAAAGCCCA | GGTGGGAAGTCACTGGCA | 3699 & 3700 |
| CYHR1 | CTCGGAGCGTAACCCCAA | GGCCCTTGAGCAGCAGGA | 3701 & 3702 |
| CYLD | CTGCACCCGTCCAAGAGA | GTACAGCCTGCACACTCA | 3703 & 3704 |
| CYP11B1 | CACCTCCAGGTGGAGACA | TGAAGGTGAGGAGGGGGA | 3705 & 3706 |
| CYP11B2 | CGGCAGGAACTTCCACCA | TCAGCACGTGGTGCAGCA | 3707 & 3708 |
| CYP17A1 | GAATCCAGCGGGGACCCA | GGGGATGCCTTCCAGGGA | 3709 & 3710 |
| CYP19A1 | CCTGCTGCCACCATGCCA | AGTTGCAGGCACTGCCGA | 3711 & 3712 |
| CYP1A1 | CCTGGAGACCTTCCGACA | CACAACGCCCCTTGGGGA | 3713 & 3714 |
| CYP1A2 | CTAACCCTGCCCTGCAGA | CCCGTGATGTCCCGGACA | 3715 & 3716 |
| CYP1B1 | GACTCGAGTGCAGGCAGA | AGGCCAGGACATAGGGCA | 3717 & 3718 |
| CYP21A2 | GGAGGAGCTAGACCACGA | GGGGCAAGGCTAAGGGCA | 3719 & 3720 |
| CYP26A1 | AGTGGAGCTGGCCAGGCA | GCAGGGAGATTGTCCACA | 3721 & 3722 |
| CYP26B1 | CGGGACACCCATGACACA | AGCGGCTGGTGCTAGCCA | 3723 & 3724 |
| CYP27A1 | AGCCTGCTACCCCCAGGA | GGATCAGCCTTGCGAGGA | 3725 & 3726 |
| CYP27B1 | CCCGAAGTCCAGACAGCA | TGACCACCGCCTTCAGCA | 3727 & 3728 |
| CYP2A6 | GGAGGCAGTGATCCACGA | GGGGTCTCTCAGCACAGA | 3729 & 3730 |
| CYP2A7 | CAAGAACCGGCAGCCCAA | CTCTCAGCACGGAGCCCA | 3731 & 3732 |
| CYP2B6 | CCCACATCGCCCTCCAGA | GGGTGACAATGTGGGGCA | 3733 & 3734 |
| CYP2C18 | CCTGTATGCAGGACAGGA | GGGGCAGGTTGGTGGGGA | 3735 & 3736 |
| CYP2C19 | CCACATGCCCTACACAGA | ACGTCACAGGTCACTGCA | 3737 & 3738 |
| CYP2C8 | GACACAGGAGCCCCTGCA | CCGGTGGGGACAAGGTCA | 3739 & 3740 |
| CYP2C9 | TGATTGGCAGAAACCGGA | TGGACCTCGTGCACCACA | 3741 & 3742 |
| CYP2E1 | TGATTGGGCCAAGCCGAA | GCAGGTTGGAGGGCACGA | 3743 & 3744 |
| CYP2F1 | CCACTACGACCCCAGCCA | GCCCAGCTGAGAAGGGCA | 3745 & 3746 |
| CYP2J2 | GGTGCAGAGAATGGGCAA | GCAGGTGGTACCCAGCCA | 3747 & 3748 |
| CYP2R1 | GCCAGCTGCTGAAGCAGA | GACATGGGGAAGCTCGGA | 3749 & 3750 |
| CYP2S1 | CCATGGGAATACCCCGCA | TGGAGCCAAGGAGGGGGA | 3751 & 3752 |
| CYP2W1 | ACACAGTGGCAGACCCCA | CAGGCGCTCCCCAACACA | 3753 & 3754 |
| CYP39A1 | AGGCCATTATGGAAGGCA | CCAGGTCATCCTCAGACA | 3755 & 3756 |
| CYP3A5 | GAGAAACTTGAGGCGGGA | CCATGCTGTAGGCCCCAA | 3757 & 3758 |
| CYP46A1 | AGGAGGTTCCTGCCGACA | GCAGAGGTCTCGTGACCA | 3759 & 3760 |
| CYP4A11 | AGTGTGGCCCAACCCAGA | TGGTGGGATCAGGCAGCA | 3761 & 3762 |
| CYP4A22 | GGAACCACCTGGACCAGA | TCAGGGAAGGTGACGGGA | 3763 & 3764 |
| CYP4B1 | GAGAGGAGGTCCGCGAGA | GCAGGTAGAGACCGGCCA | 3765 & 3766 |
| CYP4F11 | GCCATGACACTACAGCCA | ATGACCGGGACTGGGGGA | 3767 & 3768 |
| CYP4F2 | GGGTCATCCCCAAAGGCA | TCAGGGTCCGGCCACACA | 3769 & 3770 |
| CYP4F22 | CCCGGACAACCCACAGCA | GTGCCACAACCACGCGCA | 3771 & 3772 |
| CYP4F3 | CGTTCGCGATGGCGGAGA | CGGTGTGGTCAGGCAGGA | 3773 & 3774 |
| CYP4X1 | GGGAGGAGGTCAGGGGCA | ATGGACGGGACTGCAGGA | 3775 & 3776 |
| CYP7A1 | CCTGGGTGACAGAAGGGA | CCTGCTACCAGGGCTGGA | 3777 & 3778 |
| CYP7B1 | GATGCAAGGATGGTCAGA | GTTTGCCACAGAGGCCCA | 3779 & 3780 |
| CYP8B1 | ACATCCACCCTGAGCCCA | AGAACCTCCCAGGGCAGA | 3781 & 3782 |
| CYR61 | CGGCCTTGTGGACAGCCA | GCATCGGCCGTCCACGCA | 3783 & 3784 |
| CYSLTR1 | CTGCCACATGCCATGACA | AGACCACACGGAGAGGCA | 3785 & 3786 |
| CYTH2 | CCCCAACAACAAGGGGCA | AAGGGGTCCACACTCACA | 3787 & 3788 |
| CYTH4 | ACCGCATCTCAGCCACCA | AGAAGGGGACACGGGTGA | 3789 & 3790 |
| CYTIP | GTCGGCAGACGAGTACAGA | CCCACAAGGGAGACATGGA | 3791 & 3792 |
| CYTL1 | GAAGGACAAAGCACGGAA | GGACCGTAGTCACTGGGA | 3793 & 3794 |
| D2HGDH | TCAGCACCTGCAAGGGGA | ATCGGTCACCAGGCCGGA | 3795 & 3796 |
| DAB2 | CTCCCTCAGGCAGGACCA | CAAGCATTGGGTGCCACA | 3797 & 3798 |
| DACH1 | TACTCAACCCCGTCCCCA | TGCACACCACCGGCGTGA | 3799 & 3800 |
| DACH2 | AGGAGCGGATCCCAGAGA | GAGAGGGAGAGCTGGACA | 3801 & 3802 |
| DAD1 | CCCACAGAACAAAGCGGA | GCAGGATGGTGCTGGCAA | 3803 & 3804 |
| DAG1 | GCAAGAAGCGGAAGGGCA | GGAGTGGTCTCGGGCACA | 3805 & 3806 |

FIG. 1 Cont.

| | | | |
|---|---|---|---|
| DAGLB | CCGACCACATGCCAGACA | TGCTGGACAGGAGACGCA | 3807 & 3808 |
| DAK | GGCCAGAGCAATCCAGGA | GCAGTCAGGAACAGGCCA | 3809 & 3810 |
| DAND5 | ACATCCCTGGCTCGGA | GACACCCCTCGATCAGCA | 3811 & 3812 |
| DAO | CGAACTGGCTTCCGGCCA | GGCTGCCTCCAGGGCACA | 3813 & 3814 |
| DAP | GACAAGGATGACCAGGAA | GGGCGATGACCCCAGAGA | 3815 & 3816 |
| DAPK1 | GGCTGATGAGGAGGACGA | CATTCACCCACAGGCGGA | 3817 & 3818 |
| DAPK2 | CCGGTGGACAACCAGCAA | TCATCAGCGAGCGGGTGA | 3819 & 3820 |
| DAPP1 | CTCTGTGCAAAGACCGGA | TGAACGACCGAGATCGGA | 3821 & 3822 |
| DARC | TGGCAGAAGCCCTGGCAA | ATCCTTCAGGGAGGGGCA | 3823 & 3824 |
| DARS | AGTCCTACGTCAGCAGCA | CATCCAGCTGCAGGGGCA | 3825 & 3826 |
| DAXX | GAGCTCGGCTCCAAGGCA | TCTGGAGGCAGAAGGGCA | 3827 & 3828 |
| DAZAP2 | CACCCAGGGGCTGCCACA | ACCAGCACTGTGGAGCCA | 3829 & 3830 |
| DBH | CGTGCACTACTACCCCCA | CCTGAGGGCAGGTGCAGA | 3831 & 3832 |
| DBI | TGAGAAAGCTGCAGAGGA | GGCCATAGATGAACAGCA | 3833 & 3834 |
| DBN1 | CTGCCACTGCTGACACCA | GTTGAGAAGGGTGGCACA | 3835 & 3836 |
| DBNL | CAGCCGACGACACAGAGA | CCACGTAGTTGGCAGGGA | 3837 & 3838 |
| DBP | GAACAACGAGGCAGCCAA | GCTCCTGGCGCACGGCCA | 3839 & 3840 |
| DBR1 | AGGCGGATCTACGCTGCA | GGTGCCACCCAGCCACCA | 3841 & 3842 |
| DBT | GCCTATGTGGGGAAGCCA | TCCATTGCCAGACGGCGA | 3843 & 3844 |
| DCAF10 | GCTTGCCCAAAGAAGCCA | AACCCGTCCACTAAGGCA | 3845 & 3846 |
| DCAF11 | CAGTTCGTGGGACGGGAA | GATTGGGGCACTGGGGCA | 3847 & 3848 |
| DCAF4L2 | CCCGTGCATGTGAACGAA | GCAGGTGGCCATGACGGA | 3849 & 3850 |
| DCBLD2 | ATGTCAGGGCACCCCACA | GGCCTGGGCTGAGGAGCA | 3851 & 3852 |
| DCC | CCTCACACCAGTCAGCCA | GGGATGGCGCTCACGACA | 3853 & 3854 |
| DCHS1 | GTCCATGCAGGAGGCACA | AGGGTCAGGGTCAGCACA | 3855 & 3856 |
| DCLRE1B | GGAATCACTGCTGGAGCA | ACTGCATGGATGCGGCCA | 3857 & 3858 |
| DCN | TCTGGCCAACACGCCTCA | CCAGGTGGGCAGAAGTCA | 3859 & 3860 |
| DCP1A | CAGGTTGACCCCACAGCA | AACACCTTAGGCTGCACA | 3861 & 3862 |
| DCPS | CCGGATGAAGGGAGACCA | GCCTAGGGTCACACTCCA | 3863 & 3864 |
| DCSTAMP | GATGGCAACAACCACAGA | TCCAACCACAAGGGCCCA | 3865 & 3866 |
| DCT | GCCACATTCAGCCGCCAA | TGTGACCAATAGGGGCCA | 3867 & 3868 |
| DCTN1 | GCGAATGCCAGGGACAGA | GCCAGTTCCTCCAGAGCA | 3869 & 3870 |
| DCTN4 | ACCCAGCCAAGACCACCA | GGTTCCTGCCAACCGCCA | 3871 & 3872 |
| DCTPP1 | TCCCCCAGGGAACGGGCA | AGAGCACTGCTAGCGGCA | 3873 & 3874 |
| DCX | CCAGCTCTCTACCCCCAA | CATCCAAGGACAGAGGCA | 3875 & 3876 |
| DCXR | CCAAGGGTGCCCTGGACA | CCTGGCCCATGGACGTCA | 3877 & 3878 |
| DDAH1 | ACCGCTACGACAAACTCA | CCGGGGTTCGGTGCAGCA | 3879 & 3880 |
| DDAH2 | CAAAAGGCTGTCCGGGCA | GGCACACCAGGCAACCCA | 3881 & 3882 |
| DDB1 | AGGATAGCGCTGCCACCA | GGGTGGAAGTCTCACCCA | 3883 & 3884 |
| DDB2 | TGTGGGCCGATACCCAGA | AACCCATTGCAGAGGCCA | 3885 & 3886 |
| DDC | TTGCCACCCTGGGGACCA | GTGCCGGAACTCAGGGCA | 3887 & 3888 |
| DDIT3 | GGAGCCAGAACCAGCAGA | TGAGCCAGGGAGCTCTGA | 3889 & 3890 |
| DDIT4 | AGCTGGCACTCGACCCCA | GAAGGGAGAGTTGGCGGA | 3891 & 3892 |
| DDOST | CCGGCTAGGCTACACACA | GTAGTAGGGGTAGGCCGA | 3893 & 3894 |
| DDR1 | TGGGCAGCTCACCGACGA | TCCTCTGCCAGGAACCGA | 3895 & 3896 |
| DDR2 | CGAGATCTGGCCACACGA | CCCAAGACATCCAGCGGA | 3897 & 3898 |
| DDT | AGGACAACCGCAGCCACA | GCCAGGACTCCAAGGGGA | 3899 & 3900 |
| DDX10 | CCTGAGGATGCCAACACA | GAAGAAGCTGCTGCACCA | 3901 & 3902 |
| DDX11 | GGAAGGCTCTGGTGGAGA | ATCGCTGGTCCAGGAGCA | 3903 & 3904 |
| DDX17 | GGAGCACAAGCAGGCCAA | GCTCCATAAGTGCCAGCA | 3905 & 3906 |
| DDX18 | AAGTCAGCCCAGGAAGCA | GATCAACGAAGGGAGGCA | 3907 & 3908 |
| DDX20 | CTGGGCTGTGACAGGCAA | ATCTGGGGGAGTGACACA | 3909 & 3910 |
| DDX21 | TGCCACGTCCGTAGACCA | GGCCACAGAGAGCTGCCA | 3911 & 3912 |
| DDX25 | CTGACCGTGGAGCAGCGA | ACATCAATCCCTCGGGCA | 3913 & 3914 |
| DDX28 | GGACTGGTCCCTCAGGAA | ACAACCAGCTCCACACCA | 3915 & 3916 |
| DDX3X | CAGCAAGAGGACTGGACA | AATGAGGTTGCCAGGCCA | 3917 & 3918 |
| DDX4 | CAGAGAGAGCGGGAGCAA | CAACGACCAGTACGCCCA | 3919 & 3920 |
| DDX41 | GCTCGGGAAACACAGGCA | AATGCAGCACCTGCAGCA | 3921 & 3922 |
| DDX5 | GCAGTACCAAAACAGGCA | ACCCCTGGAACGACCTGA | 3923 & 3924 |
| DDX58 | GGAGGATCTTCAGGCCCA | CACTGACGCATCAAGAGA | 3925 & 3926 |
| DDX6 | CTCAGCAGCAAGCACAGA | GTGGAGGTCACATCCGAA | 3927 & 3928 |
| DDX60 | CGACACATGGCAGCGAGA | TGGGTGCAACGTACACGA | 3929 & 3930 |
| DEAF1 | ACTCCCACCAAAGCGGCA | TGAGCAAGGAGTTGACCA | 3931 & 3932 |
| DECR1 | GGCACAGCCTTCGTGACA | CCTGAACCAGTCTCAGCA | 3933 & 3934 |
| DEF6 | GCGCAGCAGGAGAAGGAA | GAGCTGCTGGTGACCGGA | 3935 & 3936 |
| DEF8 | GCTCTGCAGAGAGGGCGA | CCGGGCACACTTGGGACA | 3937 & 3938 |
| DEFA1 | GAAGACCTGGGACAGAGGA | GCAGGGCCACCAGGAGA | 3939 & 3940 |
| DEFA3 | GACCCCAGCCATGAGGA | CATGCAAGGGAAACAACCA | 3941 & 3942 |
| DEFA4 | GGCCAGAAGACCAGGACA | AGGCAGTTCCCAACACGA | 3943 & 3944 |
| DEFA5 | GGCAAGAGCCACCTGCTA | GATTTCACACACCCCGGA | 3945 & 3946 |
| DEFB103A | GCCTAGCAGCTATGAGGA | GCAGCTGAGCACAGCACA | 3947 & 3948 |
| DEFB104A | GGAAGAAATGTCGCAGCCA | CGACTCTAGGGACCAGCA | 3949 & 3950 |
| DEFB105A | TCAGGGTGCCAGGCAGGA | TCCCCGACCAAGCTTGCA | 3951 & 3952 |
| DEFB106A | ACCCCAGCCAAGAATGCA | CCGACAGCATTTCAGAGA | 3953 & 3954 |
| DEFB107A | TCCAAGCCAGGACAGCA | CCCACTGATATCGCAGCCA | 3955 & 3956 |
| DEFB108B | GGGGCAAATTCAAGGAGA | GTTGATGCCCCAGAGGCA | 3957 & 3958 |
| DEFB110 | GGACTTGAGGAGAGAGTGCA | GCAAGCAGCAATGAGTTCCA | 3959 & 3960 |
| DEFB116 | CAATGGCAAGAGCCGAGA | CACAGAAAGTTTCAGGCAGCA | 3961 & 3962 |
| DEFB118 | CTGGAACAGATCAGGGCA | GTGGGAGATGTCGCAGGA | 3963 & 3964 |
| DEFB119 | AAACGCCACATCCTTCGA | GGACTGGAGGCAGCAGGA | 3965 & 3966 |
| DEFB125 | TATACTCGACGACCAGCA | GGGAGTAGTGGCCTCAGA | 3967 & 3968 |
| DEFB130 | GAAAGGGGTGTGCAGAGA | GGGCTCAAGTATCCACCA | 3969 & 3970 |

FIG. 1 Cont.

| | | | |
|---|---|---|---|
| DEFB132 | GTGAGTAACACCCCAGGA | GCAGGAAGGAGTAGCTGA | 3971 & 3972 |
| DEFB134 | GGGATCCAGTGCTGGCA | CCTTTGACACAGCACTCCA | 3973 & 3974 |
| DEFB135 | AGGTAGAAGTGGACCCAA | GCCGGCAAGTACCTTGCA | 3975 & 3976 |
| DEFB4A | GCCTTAAGAGTGGAGCCA | TGTTCCAGGGAGACCACA | 3977 & 3978 |
| DEGS1 | CCTGGCAAAGTATCCAGA | AAGGCAGCATTGTGGGCA | 3979 & 3980 |
| DEK | CACAAGGAAAGGGGCAGA | AGCCACTGAACTGACCCA | 3981 & 3982 |
| DENND2D | CATGGACAGCCCTATGGAA | TGATCCCCTGACCAAGAGA | 3983 & 3984 |
| DENND4A | GGCCCCTTGGATAAGGAA | GGGACTTGGAAGGTGCCA | 3985 & 3986 |
| DENND5A | CCGGAACATCGGCAAGGA | TGATGGGGCAGTCAGCCA | 3987 & 3988 |
| DENND5B | GCAGTGAGAGTACCAGCA | CACCCAGAGAAGCAGAGA | 3989 & 3990 |
| DENR | TCAAGGAACAGCAGGGGA | CAAAAGTTGCAAGGCCACA | 3991 & 3992 |
| DEPDC1 | GCAATGGGTACGAGGTCA | CTTCCAGCAAGAAGCTCA | 3993 & 3994 |
| DEPDC1B | TGAGGATGATGGCAAGGA | ACACAAGATGCAACGGGA | 3995 & 3996 |
| DEPDC5 | GACGAGGACGAGTGGCAA | ATCATGCGATCCGAGCGA | 3997 & 3998 |
| DES | TCAGACCTGACCCAGGCA | CGCAGGTGTAGGACTGGA | 3999 & 4000 |
| DFFA | CAGCGGCTGCAGCACACA | ATGTGGCTCGCCAGCGCA | 4001 & 4002 |
| DFFB | ACAGCTGTGAGAGCCGGA | AGCCGAGGACCCGCAGGA | 4003 & 4004 |
| DFNA5 | CCTGAGCCACAACAGACA | CCCACCCTGTAAGCTGCA | 4005 & 4006 |
| DFNB31 | CCAGACCAGACAGGCACA | GCCTCGCCAGCATCCACA | 4007 & 4008 |
| DGAT1 | AGTGGATGGTCCCCACCA | AGCCACGGCATTCAGGCA | 4009 & 4010 |
| DGCR2 | CACCTGCCATGGAGGGGA | GCCATCTGGGTCCAGACA | 4011 & 4012 |
| DGCR8 | GTCACCTGGTCCAGGCCA | GGCTTGACGGGGGACACA | 4013 & 4014 |
| DGKA | ACCGCTGGATCTGAGCAA | ATTGCACCCTCCAGCCCA | 4015 & 4016 |
| DGKG | CGGTGGGGAACTCAGAGA | TTGGCGGACACGCAGCCA | 4017 & 4018 |
| DGKH | CTCCCAGGCTGCAGAGGA | ATTCAGGGCATGGGAGCA | 4019 & 4020 |
| DGUOK | GCTCTCCATCGAAGGCAA | GGGTGCCAGCAGCCTGGA | 4021 & 4022 |
| DHCR24 | TCTGGGAGCTCCAGGACA | GGTCAGCTTCAGGAGGGA | 4023 & 4024 |
| DHCR7 | AGCAGCGGGAGCTCCACA | CCAGACACAGTCGCCCCA | 4025 & 4026 |
| DHDDS | GAGGTGACAGTCTACGCA | GCAATCAGCTCCTGGAGA | 4027 & 4028 |
| DHFR | ACCTCCACAAGGAGCTCA | ACTGCCACCAACTATCCA | 4029 & 4030 |
| DHH | CGGAAAGGGCTGCGGGAA | GGCCACTCGGTCTCCACA | 4031 & 4032 |
| DHODH | GCACTCACCCAAGGCCGA | CCGTGTACAGCTGCACCA | 4033 & 4034 |
| DHPS | CATCAACACAGCCCAGGA | AAGACCAGGGAGGCGTCA | 4035 & 4036 |
| DHRS1 | GACAGAACTGCTGAAGGA | TCCACATCCCGAAGGCCA | 4037 & 4038 |
| DHRS11 | ATGTGGACGATGGGCACA | GTCAGCGCAGTGACGGCA | 4039 & 4040 |
| DHRS2 | AGCCCTGCTGCTGAGCCA | TGTAGACACCCAGCGCCA | 4041 & 4042 |
| DHRS3 | CATCAACACCCTGGGCCA | GACAGTCCAGCAGCCCCA | 4043 & 4044 |
| DHRS4 | GCTCTGGATGGACAAGGA | AGACACGATGCCAGCACA | 4045 & 4046 |
| DHRS4L2 | TGAAGGCCCCAGCCCTGA | TGGAAGACACGATCACCA | 4047 & 4048 |
| DHRS7 | CCCACAAGATGACAACCA | GGTTATCCACCAGGCCCA | 4049 & 4050 |
| DHRS7B | GGACACCACCACAGCCCA | AGGCTGAAGAAGAGCCCA | 4051 & 4052 |
| DHRS9 | CCCACTGACTGGCTGACA | GGAGTATAGCCCCCTCCA | 4053 & 4054 |
| DHRSX | AAGCCACGTGACCGCCAA | CCAGACGGGTGGCCCAGA | 4055 & 4056 |
| DHX15 | GGCCAAGAAAGCCGCAGA | GTCTGCGGACATCAGGGA | 4057 & 4058 |
| DHX16 | TCCGTGTACGCAAGGCCA | AGCCACCTCCAGAAGCCA | 4059 & 4060 |
| DHX29 | TCTACCAGCTGGGAAGGA | GGCCGTCTCCACAATGCA | 4061 & 4062 |
| DHX30 | TGACAGCGGCAGTGACCA | GTCCGTGGATGAAGCGCA | 4063 & 4064 |
| DHX34 | AACTGCGACGGAAGCCGA | AGGAGGGACTGGAGGGCA | 4065 & 4066 |
| DHX35 | TAGTGAAGGTGACCCGGA | AGCCAGCTCCAACAGCCA | 4067 & 4068 |
| DHX58 | ACCCAGAGGGACCAGCAA | GCCCATAACGCACCACCA | 4069 & 4070 |
| DHX8 | CCGGACACTGATCGACCA | AACTCCACAAGCCACCGA | 4071 & 4072 |
| DHX9 | GCCAAGACATGAAGTACCCA | ATGGCTGCCCGGAGACCA | 4073 & 4074 |
| DIAPH1 | CCCGTCAAGCCAACAGGA | TGGCAGGAACAGCAGCCA | 4075 & 4076 |
| DIAPH3 | GTACTGCCTGCGAAGAGA | TGAGCATTCCGGGAGCCA | 4077 & 4078 |
| DICER1 | AGAACCAGCCCCAGCCCA | AGTCCAGGATTGGGGCCA | 4079 & 4080 |
| DIDO1 | CTCCAGAGGGAGACACGA | GGTGCGATCCTCCCACCA | 4081 & 4082 |
| DIO1 | AGCGACTAGAGGACACGA | TGGGCTGCCTGCAGGCGA | 4083 & 4084 |
| DIO2 | TGAGGGAGCCACATGCCA | GCCCAGCCATCTGATGGA | 4085 & 4086 |
| DIP2C | CTCGGTCATCAGAGCCCA | CGATGTCCACCACGACCA | 4087 & 4088 |
| DIS3 | GGCAGCCAGGTCAAGGAA | TAAGTACAGTCAGCCCCA | 4089 & 4090 |
| DKC1 | GGACCATCTACGAGAGCA | CCAGAACGAACCCTCCGA | 4091 & 4092 |
| DKK1 | GTGCGCAGAGGACGAGGA | GGGCAGCACATAGCGTGA | 4093 & 4094 |
| DKK2 | GAAGCGCTGCCACCGAGA | TCCAGAGCCGGGATGTGA | 4095 & 4096 |
| DKK3 | GATGGAGCCTTGGACCGA | GGACCTCTCTGGGCAGCA | 4097 & 4098 |
| DKK4 | CTGCTCCAGAAGAGGGCA | CACAGTAGTCCAGGGCCA | 4099 & 4100 |
| DKKL1 | GCCACCTCCAGATCGACA | TGAATGGATGCCACCACA | 4101 & 4102 |
| DLAT | CCCTGAAGGCACAAGAGA | TTGGAGGAACAGCGGCCA | 4103 & 4104 |
| DLC1 | CCCCTCACTCTGGAAGCA | AGTGGAGTAGCTGACCCA | 4105 & 4106 |
| DLD | GGTGCAGATGTGACAGCA | GGGTCGTCGGCCAATGCA | 4107 & 4108 |
| DLEC1 | GGGCTGCTAGAAGCACGA | CGAGCACACCTTCCACCA | 4109 & 4110 |
| DLG1 | CGAACTAGCCAGAAGCGA | CCCTGACTGGGAAGCCCA | 4111 & 4112 |
| DLG4 | CCTTCGACAGAGCCACCA | CTCTCGGGCTGGAACCCA | 4113 & 4114 |
| DLG5 | GGCGCAGAAGCTTGAGCA | GGCAGGCTGGAATCCACA | 4115 & 4116 |
| DLGAP5 | CTGAAAGCAGGAGCAGCA | CTGCTACTCCACCAGCAA | 4117 & 4118 |
| DLK1 | TCTCCTCACCGAGGGCCA | GCGCAGGTTGGACACCCA | 4119 & 4120 |
| DLK2 | GCAGTGCCAGGACGACCA | CAGGACAGAGGCAGGAGA | 4121 & 4122 |
| DLL1 | GCTGCACGGATCTCGAGA | TGAAGCCGGAGTAGCCCA | 4123 & 4124 |
| DLL3 | CGTGTGCCAATGGAGGCA | GTCTGCACCCCCGACACA | 4125 & 4126 |
| DLL4 | CCGACCTCTCCACAGACA | GCACAGCCACTGCCACCA | 4127 & 4128 |
| DLST | CTGCAGCACCCATACCCA | CAGCTAGTGGTGGGGCAA | 4129 & 4130 |
| DLX1 | ACCTAGCTCTGCCGGAGA | ACGGGTGGGGAGCCAGCA | 4131 & 4132 |
| DLX3 | AGGTGCCGCTGGAGCACA | GGCAGCTGACTGCGGGCA | 4133 & 4134 |

FIG. 1 Cont.

| | | | |
|---|---|---|---|
| DMAP1 | GCTCTGTGGGACAGAAGAA | GCTCGTAGAGCAGCACCA | 4135 & 4136 |
| DMBT1 | AGTCCCAGTCAACGCCCA | TCACCAGCCTCAGAGCCA | 4137 & 4138 |
| DMC1 | ACCACCGGGAGCCAGGAA | TAAGGCGATCTGGACGGA | 4139 & 4140 |
| DMD | GCCTGGAGCAAGAGCACA | CATGCAGAAGGAGGCCCA | 4141 & 4142 |
| DMGDH | GGACTCCTGGGTCACCAA | GGCCCCACCATAGGCAGA | 4143 & 4144 |
| DMKN | ACGTGCAGGCAGAGACGA | ACCCACTGCAGCAGGCCA | 4145 & 4146 |
| DMP1 | ATGAGGACCGGGTGGACA | CATCACTGCCACCTCCCA | 4147 & 4148 |
| DMPK | GGGAGACACTGTCGGACA | GCACGTGTGGCTCAAGCA | 4149 & 4150 |
| DMRT1 | GCAGAGGGCATGTGGAGA | GCACATAAGGTCCGGGGA | 4151 & 4152 |
| DMRT2 | GCCCAGTGGAACCACCAA | GTCGCTAATGGGGCCACA | 4153 & 4154 |
| DMRTA1 | GCGCAGGAGGAGAGCGAA | TCAAGGCACCCAGTCCCA | 4155 & 4156 |
| DMTF1 | CTGTTGCCACAGAGGACA | AGGGCGTCTGGAGGCTCA | 4157 & 4158 |
| DMXL1 | CCAGCTCAATGGCCAGGA | GAATGTGTGGCCAGGCCA | 4159 & 4160 |
| DNAH14 | GGACAAGGAGGAAACCAA | GGAAGCTGGCTCTGGAGA | 4161 & 4162 |
| DNAH7 | CGGAGGCAGAGTGACCGA | GCTGGGGTCAGTGGCAGA | 4163 & 4164 |
| DNAH8 | ATGGAGCAGCCTGGGACA | GGGCCACTCCTCTCAGGA | 4165 & 4166 |
| DNAH9 | TGTGGACTACCGGGCAGA | AACACGCCTGCAAGGGCA | 4167 & 4168 |
| DNAJA1 | TTGGAGGAGGAGGAAGGA | ACCTCGGCAATTGGGACA | 4169 & 4170 |
| DNAJA4 | CCAAGGACCGCTGCGAGA | TGACATCACCAGGCTCCA | 4171 & 4172 |
| DNAJB11 | GAGGTGGTCTGCGACGAA | CCATCCACGTGAGGCTCA | 4173 & 4174 |
| DNAJB4 | AGGAGGTACTGATGGACA | TGAGGCGGGATGGCCCCA | 4175 & 4176 |
| DNAJB8 | ACCACAGCCCCTTCGACA | CCCCGCTGCAGCCCAGCA | 4177 & 4178 |
| DNAJB9 | AGTCGGAGGGTGCAGGA | GATGCCGATTTTGGCACA | 4179 & 4180 |
| DNAJC1 | AGTCCAGCGACGAGGAGA | GGTACTGCTGCAACGCCA | 4181 & 4182 |
| DNAJC12 | GGAGCAGAAAGAACCCAA | CATCCTTGGACCAGCGGA | 4183 & 4184 |
| DNAJC15 | GACGTCGACCAGCAGAGA | AATGCGTAGCGACCTGCA | 4185 & 4186 |
| DNAJC19 | CGGCCTCTGAGCTGGGA | GCCACCACTGAAGGCAGA | 4187 & 4188 |
| DNAJC22 | ACACAGCTGCCACCCTCA | CCATCAGTAGCCTCCAGA | 4189 & 4190 |
| DNAJC25 | GGCTATCAGAAACCCCAA | GATCCACCGACAATACCA | 4191 & 4192 |
| DNAJC3 | GCAGAGAGCCAGCAAGGA | CCGCCTGAGCTGAAGGGA | 4193 & 4194 |
| DNASE1 | GCGCTGACACCACAGCTA | GGAAGAGCCGAGTCGGGA | 4195 & 4196 |
| DNASE1L1 | GAGCTGCGGACTGAGCCA | CAGCCGCAGTGTGCAGCA | 4197 & 4198 |
| DNASE1L2 | ATCAAGCCGTGGCGGAGA | CACTGCTCCTCAGACGGA | 4199 & 4200 |
| DNASE1L3 | CACACCACCCCAGAGACA | ACGTAGCTGCAGCCGGCA | 4201 & 4202 |
| DNASE2 | GCCCAAGCTTCAACAGCA | CTGGCAGCTGGGCACACA | 4203 & 4204 |
| DNASE2B | GCTGCTCCATCCCAGCCA | GTGGTGAGGAGCCTGCCA | 4205 & 4206 |
| DNER | CACCAACATGCCACGGCA | AATGCGGCTGATGCGGCA | 4207 & 4208 |
| DNM1 | CGGCCAGAACGCGG | GACCAGCTGCAAGACCA | 4209 & 4210 |
| DNM1L | CAGGCAACTGGAGAGGAA | GTGCAACAGGAACTGGCA | 4211 & 4212 |
| DNM2 | GGCCTTCATCCACCACGA | GGGGTACAGGCGTGGACA | 4213 & 4214 |
| DNMBP | GCTGCCCAAGTTCCACCA | TCCAGAGCCTGGTGCACA | 4215 & 4216 |
| DNMT1 | AGGGAAGGGCAAGCCCAA | GGTGGAATCCCTCCGACA | 4217 & 4218 |
| DNMT3A | GCTGAGAAGAGGAAGCCCA | CACACACCTCCGAGGCA | 4219 & 4220 |
| DNMT3B | CCCAAGCGCCTCAAGACA | AAGGAAGCGATCCCGGCA | 4221 & 4222 |
| DNTT | CAGGTTGCCTAGCAGGAA | ACGACGCTCGTAGGGGCA | 4223 & 4224 |
| DNTTIP2 | CAACTGTGGAAGTAGGCA | CTACCACCACAATCACCA | 4225 & 4226 |
| DOCK10 | CCCAGCAGAGGTGAAGGA | GCCAGGCTGTACTGGAGA | 4227 & 4228 |
| DOCK2 | GCCAGGGGATGTCAGGAA | CCTCCGCGCACACACACA | 4229 & 4230 |
| DOCK4 | CCTGGACAGTGGGAAGGA | GGAGATGAGTCCTGGCGA | 4231 & 4232 |
| DOCK6 | GCATCAGCACCATCCGCA | CCAGGGACGAGAGAGACA | 4233 & 4234 |
| DOCK9 | AGGGAAGCACCCTGGACA | ATCACAGCGAACCACGGA | 4235 & 4236 |
| DONSON | TGATGCAACCCTGCAGCA | CTGCTGCTCGGAACAGGA | 4237 & 4238 |
| DOPEY1 | GGGCAGCTGCCATCCCAA | CCCCTGAGTGACTACGGA | 4239 & 4240 |
| DOT1L | TGTGCCCTACCAGGACCA | CTTCCCGCCAAGCCACCA | 4241 & 4242 |
| DPAGT1 | AGCCTCCAGCTGGTGACA | TGCCCAGGATCTGCAGCA | 4243 & 4244 |
| DPEP1 | CCTGCACCAACAAGGCCA | GGGACCCTTGGAACACCA | 4245 & 4246 |
| DPEP2 | CGGATGAGCAGCTGAGCA | ACTGGGAAGGTGGCCACA | 4247 & 4248 |
| DPEP3 | TCCCACTCAGCTGCCAGA | GCAGGTTGCACTGCAGCA | 4249 & 4250 |
| DPF1 | CGGCACTGTCATCCCCAA | GGTTCCGCACAGGCTGCA | 4251 & 4252 |
| DPF2 | CCACTTGGCTGAGGAGGA | TGAGCGGCCACAGTCAGA | 4253 & 4254 |
| DPF3 | GGGAGGAGAAGGCAGGAA | AGGAGCGAGGCTCTTCCA | 4255 & 4256 |
| DPP10 | GGAGCTCATGCCACCTGA | TGCTGAGAGAGCCACGTA | 4257 & 4258 |
| DPP4 | GGGTCTCCCAACTCCAGA | CGACCAGGGCTTTGGAGA | 4259 & 4260 |
| DPP7 | CCTGACCTTCGCCAGCAA | CCCAGAAGCTGGTCAGCA | 4261 & 4262 |
| DPT | GCATGGAATGGTACCAGA | ACTGCCACTCCCGATCCA | 4263 & 4264 |
| DPYD | GGCACACCTTGGCCAGCA | CCAGGCAGAGCACGAGCA | 4265 & 4266 |
| DPYSL2 | GATTCCGGAGGGCACCAA | TCGGCATCGGATCCCACA | 4267 & 4268 |
| DPYSL3 | CAACCTGCACGTGACCCA | ATGCCCCTTGGGACGGCA | 4269 & 4270 |
| DPYSL4 | TCAACCCAGACCCCACCA | TCTCCCAGACCATCGACA | 4271 & 4272 |
| DRAM1 | CGCCGTGCTCTCCGGGCA | ACATCGTGGCTGCACCAA | 4273 & 4274 |
| DRAM2 | GCCCAAAATCCATGGCAA | CTGATGAGCAAGTCAGCA | 4275 & 4276 |
| DRD1 | GGCACAAGGCAAAACCCA | TCATGATGGCCACAGGGA | 4277 & 4278 |
| DRD2 | GGACCTCCCTCAAGACCA | TGTACAGGACAGGCGGGA | 4279 & 4280 |
| DRD3 | GCCCGTTCACTACCAGCA | AGAGGGCAGGACACAGCA | 4281 & 4282 |
| DRD4 | CCCAGACTCCACCGCAGA | GCGTGATGTGCACCACGA | 4283 & 4284 |
| DRD5 | CCTGCGTCAGTGAGACCA | AGAAGTGGCTGCACCCCA | 4285 & 4286 |
| DROSHA | GTGGAATTCGGCAGCCCA | CAACAGCATCACCCAGGA | 4287 & 4288 |
| DSC1 | CAACCTCGGCTTGGCGAA | GCTGCAGCAACCTACTGA | 4289 & 4290 |
| DSC2 | GGAGAACATGTACGGGGA | TCATCAGGATCAACCGCA | 4291 & 4292 |
| DSC3 | GACCGCATGCCATCCCAA | TCACTGCAGCAGCCCACA | 4293 & 4294 |
| DSCAML1 | TGTGAAAGGGCCACCCCA | TGGTGCAAGGAGACGCCA | 4295 & 4296 |
| DSCC1 | TGGATGCGACGCTGCAGA | GGCACAGCGTGGGCTCCA | 4297 & 4298 |

FIG. 1 Cont.

| | | | |
|---|---|---|---|
| DSE | GACAGACTGAGGAGGCCA | TCAGGGACAGCATCCACA | 4299 & 4300 |
| DSG2 | CTGCAGGGAAGCACAGCA | CGCAATGGCACATCAGCA | 4301 & 4302 |
| DSG3 | GACGATGGCCAGGAAGCA | AACAACCCACGGAGCCCA | 4303 & 4304 |
| DSG4 | GACCTGTGATGAGCGGCA | ATGGGGGATGTGGAGCCA | 4305 & 4306 |
| DSP | ACCAAGACATGGCCACCA | CCAGGAAGCGCTGGCCA | 4307 & 4308 |
| DSPP | TGGAATGGGGACACAGGA | TCTTGGACAACAGCGACA | 4309 & 4310 |
| DST | GCAGGGCCAAAGGAAGGA | GCGCAGCCTGACTGGACA | 4311 & 4312 |
| DTD1 | GCTCGAAAAACAGCAGCA | GAGGACACGTCGCCCTCA | 4313 & 4314 |
| DTNA | CTCCCAGACCTGTAACCA | CTGGAGCAGCCCTAGCCA | 4315 & 4316 |
| DTNB | AGGCACAGCAGAACCCCA | TCTCCTGCAGGGCCGACA | 4317 & 4318 |
| DTX1 | TACGCAGCCGCCTGGGAA | CCCAGGCCGTGATGAGCA | 4319 & 4320 |
| DTX2 | AGTGCCCCCAGATGAGGA | GTACATGGCCAGGAGGCA | 4321 & 4322 |
| DTX4 | CCACAGGCGAGTCAGACA | GGGCAGCCAGTTCAGCCA | 4323 & 4324 |
| DUOX1 | TCCGAGAGGTGGAGGAGA | AGTGGGTGATGGAGCGCA | 4325 & 4326 |
| DUSP1 | CCTGGTTCAACGAGGCCA | TCTGCCGAACAGTGCGGA | 4327 & 4328 |
| DUSP13 | GCAAGTTCCAGGTGGACA | CAGAGCGGCTTACCCCCA | 4329 & 4330 |
| DUSP14 | GTCATCAGGCCCAACGTA | ACGTCGGGAACTATGCCA | 4331 & 4332 |
| DUSP2 | CAAAACCAGCCGCTCCGA | AGGACGGCTGTGATGCCA | 4333 & 4334 |
| DUSP22 | GTGCATCCCAGCAGCGGA | GTGCAGGGCATCCTCCCA | 4335 & 4336 |
| DUSP3 | CTCGTCCACTGCCGGGAA | CTCACGATGCTCAGGGCA | 4337 & 4338 |
| DUSP4 | ACGGGTGAGGCTGGAGGA | AGTGCACGCCCACGGAGA | 4339 & 4340 |
| DUSP5 | CAGCTCCTGCAGTACGAA | TGCAGTAGGCACCCTGCA | 4341 & 4342 |
| DUSP6 | GCAGCGACTGGAACGAGA | TTGGACAGCGGACTACCA | 4343 & 4344 |
| DUSP7 | CCTGGACGTGCTCGGCAA | AGCTGATGGCCTCAGGGA | 4345 & 4346 |
| DUSP8 | CAGCAACTCCTGCCCCAA | GATGGCGATGGTGGCAGA | 4347 & 4348 |
| DUSP9 | CCTCAATGTCACCCCCAA | CCCCGCAGTTCTGGGACA | 4349 & 4350 |
| DUT | CGCTGGCTGGAAGGGCGA | GAAGGGAGCGCTATCTGA | 4351 & 4352 |
| DUX4L2 | AGGGGCAGATGCAAGGCA | CCAGGAGCTCATCCAGCA | 4353 & 4354 |
| DVL2 | CAGGCCTGATCCGACACA | GAAGCCCCACTGGAGCCA | 4355 & 4356 |
| DYNC1H1 | TCAGGACGTTCGCCAGGA | CACCGTGTAGTGGGACCA | 4357 & 4358 |
| DYNC2H1 | GCGCTAAGACCGGACAGA | GAAGGATCAGCACCCGGA | 4359 & 4360 |
| DYRK1A | GCTCATCGGGGACAAGCA | TCCATGGCCTGCACGGCA | 4361 & 4362 |
| DYRK2 | CAGCGGAGGAGATCCGAA | TGCAGAATCGAGTGGGCA | 4363 & 4364 |
| DYRK3 | CCAGACCTCTCACCACCA | TTCCAACAACTGGAGGCA | 4365 & 4366 |
| DZIP1 | GGAAGCGAAATCGAGGACA | ATCCTCCACATCCGCACA | 4367 & 4368 |
| E2F1 | CCCTCATCCCTCACCACA | CGGAGAAGTCCTCCCGCA | 4369 & 4370 |
| E2F2 | CCCATCCTTGGACCAGGA | GTCCCCAAGGTCGTAGGA | 4371 & 4372 |
| E2F3 | CCAACGTTCTGGAAGGCA | GGCCTTGACACTGGGCCA | 4373 & 4374 |
| E2F4 | CCATCAAGGCAGACCCCA | AGACGAAGCAGAGGGGCA | 4375 & 4376 |
| E2F5 | CACAACTGGAGGTACCCA | TGGAGTCAAGGACTGGGA | 4377 & 4378 |
| E2F8 | GCAAGGAAGGGCCACCAA | GTGCCCCTGTCACAGCAA | 4379 & 4380 |
| EAF2 | CAGGCTGAGGTGGCAGA | CACAGTGTGGAAGGCGCA | 4381 & 4382 |
| EBAG9 | GATCTGGCAGAGGACGGA | CTTCATCCCAGGAAGTCCA | 4383 & 4384 |
| EBF1 | CACTCCCCAGCAGACCAA | CAGCTGAGCCGTTGAGGA | 4385 & 4386 |
| EBI3 | CTGCTCCAAACTCCACCA | GACATTGAGCACGTAGGGA | 4387 & 4388 |
| EBP | AGTATGCCAAGGGAGACA | AGGCGATCACCACCCACA | 4389 & 4390 |
| ECD | GGACCAGGAACTAGCACA | TGGAAGCAGGTCCTGCCA | 4391 & 4392 |
| ECE1 | CACACGCTCCTCACCCAA | CTTGAAGGCCTCCACGGA | 4393 & 4394 |
| ECE2 | GCTGGCTGGGGAACGAGA | AACCGGCCTCCAGGGACA | 4395 & 4396 |
| ECH1 | ACCATTCGGTGGCCGAGA | AGTCGTGGCCTGGACCGA | 4397 & 4398 |
| ECHS1 | TGCCGGTGAGAAGGCCCA | GCTGAGATCCGGTCACCA | 4399 & 4400 |
| ECM1 | ATGGAAGGCCTGGGAGGA | TTGGGGTAAGGAGCCCGA | 4401 & 4402 |
| ECM2 | GCACACTGCGCCTGCCAA | CATCTGGGATGGAGGCGA | 4403 & 4404 |
| ECSIT | GGAAGAGACGCCGGAGGA | GGTCATGAGCACCCGCCA | 4405 & 4406 |
| ECT2 | CAGTCAGCAAGGTGGCAA | GGTGCAAGGATAGGTCCA | 4407 & 4408 |
| EDAR | GGGGCATGACAGACGGCA | CACAAGGACTCCACAGCA | 4409 & 4410 |
| EDC4 | GCCACATGAAGAGCCGGA | TGCTGCACCTCAGCACGA | 4411 & 4412 |
| EDEM1 | CGATAAGGGTCCTGGGAA | AAGCAGGGAGGAGCCGCA | 4413 & 4414 |
| EDEM2 | CCATGACCAGGCAAGGGA | GAAGGGCTGACTGGGGCA | 4415 & 4416 |
| EDEM3 | CAGAGGCAGTGATGGGAA | CCACCAATGGCTCCAGCA | 4417 & 4418 |
| EDF1 | GCGGACTATGAGAGCGGA | CCCCGGAGCTTGAGGCCA | 4419 & 4420 |
| EDIL3 | TACAAATGCTCAGGCCCA | AGCTCGGTGAGTAGAGGA | 4421 & 4422 |
| EDN1 | TTGCCAAGGAGCTCCAGA | ATCCATCAGGGACGAGCA | 4423 & 4424 |
| EDN2 | CTCCTGGCTCGACAAGGA | GTCCCTGGCACTGGAGCA | 4425 & 4426 |
| EDN3 | AAACTCTGGACGTCAGCA | GGAGCGAGGGCGAGTCCA | 4427 & 4428 |
| EDNRA | AGCGTCGAGAAGTGGCAA | ACAGCAGCAGCAGAGGCA | 4429 & 4430 |
| EDNRB | GCCAAGGACCCATCGAGA | TGCAGCAGGTCTCCCAGA | 4431 & 4432 |
| EED | CGTAGAAGGGCACAGAGA | AATCGCCTAACCATCGCA | 4433 & 4434 |
| EEF1A2 | CGGTCATCGACTGCCACA | CCGGCACCATCTCCACGA | 4435 & 4436 |
| EEF1B2 | ACGATTACCTGGCGGACA | AACGTAGGGCATGACACA | 4437 & 4438 |
| EEF2 | CCCCAACATCCTCACCGA | CGTGGACGTCGAAGCGCA | 4439 & 4440 |
| EFEMP1 | TCAGAAGCGAGGGGAGCA | CCCAGGACTGCACTGGCA | 4441 & 4442 |
| EFEMP2 | CCGCTGCGTGGACACCAA | GCGAGTTTCCAGCACGGA | 4443 & 4444 |
| EFHC1 | GCAAGTACCTTGGCAGGA | AGGATGATGAACCGGTGA | 4445 & 4446 |
| EFHD1 | CAAGCTCAGCTTCCGGGA | AGGGCCACATCGATCTCA | 4447 & 4448 |
| EFNA1 | TCACAGTCCTCAGGCCCA | CAGTCCAGGCAAGTGGGA | 4449 & 4450 |
| EFNA2 | CAACGAGACCCTGTACGA | GGGTCCAGAGCACGGGGA | 4451 & 4452 |
| EFNA3 | GCCCACTCACAACCTGCA | CCATGGTGAACTGGGGGA | 4453 & 4454 |
| EFNA4 | GAAGTCTGAGTCAGCCCA | AGACAGAGGGGGCTGGGA | 4455 & 4456 |
| EFNA5 | CATGAGTCAGCCGAGCCA | CCAGGAGGAACAGTAGGA | 4457 & 4458 |
| EFNB1 | CCAGGAGTTCAGCCCCAA | GGCGTCACAGCATTGGGA | 4459 & 4460 |
| EFNB2 | CGCTAAGGACTGCGGACA | CCGGGCTCTGCGGGGGCA | 4461 & 4462 |

FIG. 1 Cont.

| | | | |
|---|---|---|---|
| EFNB3 | GGGAAGGAGAACCTGCCA | CTCCGCCAACACATGGCA | 4463 & 4464 |
| EFR3A | CCCGGGTTCGAGCAGGTA | ATTCAACGCTGAGACGCA | 4465 & 4466 |
| EFS | TGGGCAATGCCAGAGCCA | CCAGGCGATGAGCAGCCA | 4467 & 4468 |
| EFTUD2 | AACCGAACCCCGAGGCAA | TGCGCAGGCCATCAAGCA | 4469 & 4470 |
| EGF | GCCTGCTGACACTGAGGA | GCCTGGCCATCCTCACCA | 4471 & 4472 |
| EGFL6 | TGGCATGGGAGAAGACCA | AGACGCCATCCACTGCGA | 4473 & 4474 |
| EGFL7 | ACCCGACAGGAGTGGACA | TGTGCAGTGGGGCCAGCA | 4475 & 4476 |
| EGFL8 | CATGGAGGGGTCCCCAGA | GCAGCTCTTCAGGCGGCA | 4477 & 4478 |
| EGFLAM | CAGGCAAATCCCCAGGCA | CCACGGCATCTTCCACGA | 4479 & 4480 |
| EGFR | GATGGATGTGAACCCCGA | CGGACGCACGAGCCGTGA | 4481 & 4482 |
| EGLN2 | TAGTGAGCCAGAGGGCGA | ACATGGGCCATGAGGGCA | 4483 & 4484 |
| EGLN3 | AGGAGAGGTCTAAGGCAA | ATGCAGGTGATGCAGCGA | 4485 & 4486 |
| EGR2 | GAGGAAGCGCCACACCAA | GAGAGGAGCAAGGGGCGA | 4487 & 4488 |
| EGR3 | CGCTCACCCTCAAGCCCA | TGCAGATCCGGCACTGGA | 4489 & 4490 |
| EHBP1 | GAGCTGCTGAACCGGGAA | ACCAGGGCCACCAGCTCA | 4491 & 4492 |
| EHD1 | CCTCCGCAAGATGCAGGA | CCCTTGACCACCTGGGAA | 4493 & 4494 |
| EHF | CGGCCAGTGCAGTAGTGA | GGTGACTCTGCAACAGGA | 4495 & 4496 |
| EHHADH | AATGCAACAGAGCGGCCA | CCAATGACCAAGTGAGGA | 4497 & 4498 |
| EHMT2 | GCTGCTGAGCACAGGACA | GCGTCAGTAGCATGCGGA | 4499 & 4500 |
| EIF1 | GCATCCGGAATATGGAGA | CTCTACGAGGAACTGGCA | 4501 & 4502 |
| EIF1B | CGGAACGGCAGAAAGACA | ATGCCAACCTCCAAGAGA | 4503 & 4504 |
| EIF2AK1 | GGACCAACAGAAACGGGA | GATTCCGGCAACTGACCA | 4505 & 4506 |
| EIF2AK2 | GTGCATGGGCCAGAAGGA | AGAACCAGAGGACAGGTA | 4507 & 4508 |
| EIF2AK3 | CCATCCCCCATGGAACGA | TCCCGATGAACTCAAGGA | 4509 & 4510 |
| EIF2C4 | AGACTTCCCGGCAGGAGA | TCAGCAGCTCTCGAACCA | 4511 & 4512 |
| EIF2S1 | TAGGCGCTTGACCCCACA | CATACCGAGGAGGAGCTA | 4513 & 4514 |
| EIF2S2 | CTGCAGAAGGACACACGA | TGCCCGTGACAGCCTGGA | 4515 & 4516 |
| EIF2S3 | CGGTGCAGCAGTGATGGA | AGCAGCCAGGTGTTCCGA | 4517 & 4518 |
| EIF3A | GACAGGGACCGAAGAGGA | GCTGGGGGAGGAACTCGA | 4519 & 4520 |
| EIF3B | AGTCCAAAGCCTCAAAGGA | CCCTCCTCGCAACTCCA | 4521 & 4522 |
| EIF3D | CATCCTAGGCACCCAGCA | GCAGATGTCAATGACGCA | 4523 & 4524 |
| EIF3F | CCAACCCCATCCACCTCA | GCGTGAACATCACTCCCA | 4525 & 4526 |
| EIF3H | CCCGCTCCCTGAGGAGGA | CAATGAGCAGCGAGTCCA | 4527 & 4528 |
| EIF3J | GGGGGATTAAAAGCCACCA | CAAGGGATTGTGGGCAACA | 4529 & 4530 |
| EIF4A1 | ACCTGCTGGCCAGAGGCA | GCCACACCTTTACGGCCA | 4531 & 4532 |
| EIF4A2 | TACGAGGCGCAAGGTGGA | GACTTGACCCTGACCGGA | 4533 & 4534 |
| EIF4A3 | GCCCCAGAAAGAGCGGGA | TGAGGGACACCTGAGGGA | 4535 & 4536 |
| EIF4E | GAGACGAAGTGACCTCGA | GCGTGGGACTGATAACCA | 4537 & 4538 |
| EIF4E3 | CGGGGAACAGTTCACAGA | CTCGGTCCCGAACACTGA | 4539 & 4540 |
| EIF4EBP1 | CCGGGGACTACAGCACGA | TCCGACACTCCATCAGGA | 4541 & 4542 |
| EIF4G1 | GCCATCGACACCGAGGAA | CCATGAGGCAGCGGCACA | 4543 & 4544 |
| EIF4G2 | AAGCCAGGGGCTAAGCCA | ACGACTGAGCAGGCCTCA | 4545 & 4546 |
| EIF4G3 | GCTGGGGAAAAGGCAGCA | GCTGGAGGTTGCAGGGCA | 4547 & 4548 |
| EIF4H | CAGAAAAGGTGGACCAGA | CGCCGGTCGCCTGGGCGA | 4549 & 4550 |
| EIF5 | CGAGGCATGCTTGACACA | CTGCTGGATACGGAGCCA | 4551 & 4552 |
| EIF5A | GAGACCTTGGCAAGGAGA | TGGCAGACAGCACCGTGA | 4553 & 4554 |
| EIF5A2 | CAAAGGACGACCATGCAA | ACAAGGTGAACCTTGGCA | 4555 & 4556 |
| ELANE | GGGCAGGAACCGTGGGA | CCCGGACGAAGGAGGCA | 4557 & 4558 |
| ELAVL2 | CCATTGACGGAATGACCA | CATCTGCGTCAGGAGCCA | 4559 & 4560 |
| ELF1 | GAGAAGCAGCTAGAACCA | TCCTAGGAGACACAACCA | 4561 & 4562 |
| ELF3 | ACGACGGTCAGCAAGCCA | CACGTCACTTCCACCGGA | 4563 & 4564 |
| ELF4 | TCCCCACTACCTCCACCA | GCTGGAACACTCTGGAGA | 4565 & 4566 |
| ELK1 | GGACCCCAGGATCGGGAA | ACGGGGGTCGAGAGGCCA | 4567 & 4568 |
| ELK4 | CCCCTAAGTCCAGCCAGA | AATGGGCCAGGGGTGGAA | 4569 & 4570 |
| ELL | CCTGGCCGATGTCAGCAA | AGTCCGTCAGCAGGGGCA | 4571 & 4572 |
| ELL2 | GGCCTACAAGAAACCGGA | GCAGCATTCTGAGACGGA | 4573 & 4574 |
| ELMO1 | ACCGCCTTGTGGAAGGGA | GCAAGGAATCGTGGGGCA | 4575 & 4576 |
| ELMOD3 | CAGGTCCAGAGAGCCCAA | AGGGCGACAGTCAGGGCA | 4577 & 4578 |
| ELN | TACGGAGTGGGGACCCCA | GCAGCTGCAACTCCACCA | 4579 & 4580 |
| ELOF1 | AGGCACCCTCGAGACCCA | GGCACACGGTACAAGAGA | 4581 & 4582 |
| ELOVL2 | TGACATCCGGGTAGCCAA | CCAGTTCAAGACACACCA | 4583 & 4584 |
| ELOVL3 | TGGTACCACCACAGCACA | TGATGAGCATGGGCAGCA | 4585 & 4586 |
| ELOVL5 | AGACCAGCTGCGGGGTCA | ACAGCAGCCATGGACCCA | 4587 & 4588 |
| ELOVL6 | AAAGGCCTGAAGCAGTCA | AGTACATCACGGCGTGCA | 4589 & 4590 |
| ELP2 | TGAGCCTCCCACTGAGGA | CATTAGGTGAGAAGGCCA | 4591 & 4592 |
| ELP3 | GACCTGCCAAACGTGGGA | ATGGAGGCACGAGGGCTA | 4593 & 4594 |
| ELP4 | GGAGGGGTCCTAGAGCCA | GGAGCCCGGTTGATACCA | 4595 & 4596 |
| ELSPBP1 | AGTGGAAGTACTGCCAGA | GCAGGGCTTCCTGAGAGA | 4597 & 4598 |
| ELTD1 | CTAAGCCCAGCCGTGGTA | AACCCTGCAGTGTGACGA | 4599 & 4600 |
| EMCN | GCAAGCACTTCAGCAACCA | CGGTACAAACCCACCAGA | 4601 & 4602 |
| EMID1 | GTTGCACCAGCTACGCGA | CCCTCTTGCCCCGAAGGA | 4603 & 4604 |
| EMILIN1 | ACGGTCCCCTTCGACAGA | TGAGGCTGAAGACGCCCA | 4605 & 4606 |
| EMILIN2 | GCAGAGGTTGCAGAGCCA | GCCTGACACAGTTCCACA | 4607 & 4608 |
| EMILIN3 | GACAGCTGGCAGAAGGGA | GGGACGTGTTGGCAGCCA | 4609 & 4610 |
| EML4 | TGGAAGGTGCACTGGACA | CCTTCTGGCCAGACACCA | 4611 & 4612 |
| EMP1 | CCAACATTAGCTGCAGTGACA | ACGAAGACCAGGAGGGCA | 4613 & 4614 |
| EMP2 | CCGTGACCAGAGAAGGCA | GCCGCTGATGAAGGTGCA | 4615 & 4616 |
| EMP3 | TACACCATGCGACGAGGA | CCACCCAGGCCAGGGCGA | 4617 & 4618 |
| EMR1 | GGATCACTGGGAAGACGA | AGCGGATGGCATGGAGGA | 4619 & 4620 |
| EMR2 | CCCTCCGGAACACAAGGA | GGAGGCAGTACACCAGGA | 4621 & 4622 |
| EMR3 | CAACCATCCAGAACACAAGGA | CTGAGGAGGCAGTAGACCA | 4623 & 4624 |
| EN1 | CAGCCAAGCCCTCGGACA | ACGTGTGCAGTACACCCA | 4625 & 4626 |

FIG. 1 Cont.

| | | | |
|---|---|---|---|
| ENAH | GGGCAGGAAGATTCAGGA | GCTGCCAAAGTTGAGACCA | 4627 & 4628 |
| ENAM | GCACCTGGGGAGAACCAA | CTCCTCAGCGTGGACACA | 4629 & 4630 |
| ENC1 | GTGGGAGATGTGACAGCA | GAATCAGCGAGTACGGGA | 4631 & 4632 |
| ENDOD1 | GGGAAGAGTTGGTGAGCA | AGTGAGACAGTGCCACCA | 4633 & 4634 |
| ENDOG | CGTGGCAGTGCCCACACA | CCACAGGTGCGTTGGGCA | 4635 & 4636 |
| ENDOU | CGCTATGGCTCAGAGCAA | AACTGCATTGCCAGCACA | 4637 & 4638 |
| ENG | CGGGTCTCAAGACCAGGA | AGAGTGCAGCAGTGAGCA | 4639 & 4640 |
| ENHO | CGGCATGGGCCTCACCA | GCAGCAAGAAGCCCACGA | 4641 & 4642 |
| ENO1 | GGCAGAAGTTCACAGCCA | AGACACCATGACGCCCCA | 4643 & 4644 |
| ENO2 | GGAGAGACTGAGGACACA | CAGACGTTCAGAACGGCA | 4645 & 4646 |
| ENO3 | ATCGGCTCGGTGACCGAA | GTCCTGTGCAGAGCCCCA | 4647 & 4648 |
| ENPEP | GTGGTCGAGGCGGAGGAA | GAGGGAGCCGTTCAGCCA | 4649 & 4650 |
| ENPP1 | CCGGCTCCTAATAACGGA | TGAAGGGGCACTGTACCA | 4651 & 4652 |
| ENPP2 | TGGGGAGGTCAACCGCTA | ATCTGGCAGGGTGAGCCA | 4653 & 4654 |
| ENPP6 | GGATGAACAGCACCGGCA | GCACATCACCCTGGACCA | 4655 & 4656 |
| ENPP7 | CTCCTGGACTACGGACCA | AGTGGAAGGCCTCGGGGA | 4657 & 4658 |
| ENTPD1 | CAAGATCCAGGGCAGCGA | CATAGGTGGAGTGGGAGA | 4659 & 4660 |
| ENTPD5 | CCCTGGAGACAGAAGGGA | CAGCACTTCGGCATAGCA | 4661 & 4662 |
| ENTPD7 | AGGTGTCCGACAAGCCCA | CACCACCTCTTCAAGCCA | 4663 & 4664 |
| ENTPD8 | ACGGGTTCAGCGAGGAGA | TAGCCCAGTGTCCAGCCA | 4665 & 4666 |
| EOMES | GAGCGAAGAGGTGGCCAA | ATACCCCAGGGCATGGGA | 4667 & 4668 |
| EP300 | GAGGAGGAAGACCAGCCA | GGGTCCACAGGTTGACGA | 4669 & 4670 |
| EP400 | GTGGCCAGCATCCAGCAA | TGCTGAACCACCTGGGCA | 4671 & 4672 |
| EPAS1 | CTGCCCGAACTGACCAGA | GGTCCAGGGCTCTGAGGA | 4673 & 4674 |
| EPB41 | AGCCTCGATGGAGCAGCA | TAGCAGAGGCATCTAGGA | 4675 & 4676 |
| EPB41L2 | GGGCTTATCGCCAGCACA | CATTAGCACACACGCCCA | 4677 & 4678 |
| EPB41L3 | GAGAAGGTGGTGCAGGAGA | CCCTCCGTCAAGGCAGA | 4679 & 4680 |
| EPB42 | ACTCCCTAGATGCCCCCA | CAGGCCACACTGAACGGA | 4681 & 4682 |
| EPB49 | GAAGCCCAGGCCTGCAGA | CTTCAGGGGACATGGCAA | 4683 & 4684 |
| EPC1 | CGGAAGCTGAGGAAGACA | AGGACTAGTCCAAGGCCA | 4685 & 4686 |
| EPCAM | GGCTCAAAACTTGGGAGA | ACCCCAGCAGTGTTCACA | 4687 & 4688 |
| EPDR1 | TGACCAAGCCACCAAGCA | ACCACTCCTGGACGGTGA | 4689 & 4690 |
| EPHA1 | ACTGCTTGCCAACCCCCA | CCGAGTGGAAGTGCAGGA | 4691 & 4692 |
| EPHA10 | TGGCAAAGGAGGAGGGGA | GATGCACAGCCTGCAGCA | 4693 & 4694 |
| EPHA2 | TACGTGGACCCCCACACA | CTGCCGAGTGACACAGGA | 4695 & 4696 |
| EPHA3 | GTGAGCCATGCAGCCCAA | GTGATGCTGACCGCAGCA | 4697 & 4698 |
| EPHA4 | TCGGACAGCTGCCAGGAA | CCCGAGACAGAGACCAGA | 4699 & 4700 |
| EPHA5 | CGAGCACGTACAGCAGCA | GCTGTAGCCACACCGCCA | 4701 & 4702 |
| EPHA6 | CCCAGCTTCCTGAGGGCA | CTCGGAGCATTCCGACCA | 4703 & 4704 |
| EPHA7 | AGTTGGGAGCAGGGCGAA | GAGGGAGCTGCTTGACCA | 4705 & 4706 |
| EPHA8 | CTTCCTGAGGACCCACGA | CTCGGTGGACATAGCCCA | 4707 & 4708 |
| EPHB1 | GGACCTGGCTGCTAGGAA | ATCCTGGAGGTAGCGGGA | 4709 & 4710 |
| EPHB2 | CATGGGCCAGTTCGACCA | AAGGAGTCCAGGGAGCCA | 4711 & 4712 |
| EPHB3 | GAAGGTGGGCTACACCGA | CCCGCAACATGCCCACCA | 4713 & 4714 |
| EPHB4 | GCGGCTAAACGACGGACA | GGATGTTGCGAGCAGCCA | 4715 & 4716 |
| EPHB6 | GTGGTCACCAAGAGCCGA | ACAGCGAGCGATGGACGA | 4717 & 4718 |
| EPHX1 | CCCAGAAGCATGAGCGGA | GCTCCAGCACCGACAGGA | 4719 & 4720 |
| EPHX2 | CCCCACCTGAAAAGGGGA | GGCATCAGAATCCAGCCA | 4721 & 4722 |
| EPHX3 | AGCTCCGGGAGTTCCAGA | TGGGGGCACCACTGACCA | 4723 & 4724 |
| EPN2 | TGAACCAGCTTCGGGGGA | TACCCACACTGCCCACCA | 4725 & 4726 |
| EPO | GCCTTCGCAGCCTCACCA | TCGGAGTGGAGCAGCTGA | 4727 & 4728 |
| EPOR | CCCTTCACGGAGGACCCA | TGCCCACTGGCTCCAGCA | 4729 & 4730 |
| EPRS | CCGAGCTGGCAGAACCAA | TGAATTCCCAACGCACCA | 4731 & 4732 |
| EPS15 | GCAGCAGTGAAACAGCCA | CAGTCACACCAGAAGGCA | 4733 & 4734 |
| EPS8L1 | CCGAGACTTGGAGCCAGAA | CGCTGCTTGACCGACA | 4735 & 4736 |
| EPS8L2 | GCAGCTGAACCAGCGGAA | TCAGGTCCAGAGGCCCGA | 4737 & 4738 |
| EPSTI1 | ACGGCAGCAGCAAGAGCA | CCAGATTGCTCGAGGCCA | 4739 & 4740 |
| EPX | CATGGCCACCCCTGCCAA | GCTGGGAGAGCCCACAGA | 4741 & 4742 |
| EPYC | GGAAGAGGAAGAGGAGGA | GCCCCAGAACCCCTGTGA | 4743 & 4744 |
| ERAP1 | CACAGTGAGGGGGAGGAA | ACATGCCACAGGTACCCA | 4745 & 4746 |
| ERAP2 | GGCCTGTGACCTGAACCA | TGTCTGAGCACCCACAGA | 4747 & 4748 |
| ERBB2 | GGCACAGTCTACAAGGGCA | GGAGCCCACACCAGCCA | 4749 & 4750 |
| ERBB2IP | GGCCATCTCACCAAACGA | GTAGAGCCTGGATCACCA | 4751 & 4752 |
| ERBB3 | GAACCGGAGGAGAAGGCA | TACAGGGTGGAGTGGGCA | 4753 & 4754 |
| ERBB4 | CCCAGACTACCTGCAGGA | TGTAAGGTGGAGGCGGCA | 4755 & 4756 |
| ERC1 | GGGGACACAAGCTGGAGA | GGTGTCAGCCTGCAAGGA | 4757 & 4758 |
| ERC2 | CAACAGTCCCTGGCCGAA | TGGAGGCAGACAATTCCA | 4759 & 4760 |
| ERCC1 | CCAGCAGGCCCTCAAGGA | GTCTCCAGGTACCGCCCA | 4761 & 4762 |
| ERCC3 | GTGGCTCAAGACCCAGGA | GGGCACCAGACCTCAGCA | 4763 & 4764 |
| ERCC4 | AGGCACAGCATCTGCAGA | ATGTCAATGCCCCGACGA | 4765 & 4766 |
| ERCC5 | CCAAAGGCCGTGGAACCA | AGGAGGCTCTCGGACTCA | 4767 & 4768 |
| ERCC6 | GACGTGCTGGAACAGGGA | GAGGTCATCCAGGACCGA | 4769 & 4770 |
| ERCC6L | GCAAGGATGAACGGACCA | CCTGTGAGGAGGAGGCGA | 4771 & 4772 |
| ERCC8 | TGGTACTAGAGGACCCAA | GTCATAACGTGGAGACCA | 4773 & 4774 |
| EREG | CGGGGAGGAGGATGGAGA | ACTTGAGCCACACGTGGA | 4775 & 4776 |
| ERG | ATCCAGGCAGTGGCCAGA | CGGGCCACCTCGTCGGGA | 4777 & 4778 |
| ERGIC1 | CCAGCCACAGAACCCAGA | CCAGGGGGTTGGAGGTGA | 4779 & 4780 |
| ERGIC3 | CCCCCTGGACCACACCAA | TCACCATCATGGGCGAGA | 4781 & 4782 |
| ERH | CGAGCTGATACCCAGACA | GTTGGGCCTGCCGACGAA | 4783 & 4784 |
| ERLIN1 | GCCCACACACTTCAGGAA | TAGTGAGACCTGGGGCCA | 4785 & 4786 |
| ERLIN2 | TCCAGACAGATGAGGTGA | ACACTGCGTTCGGGACCA | 4787 & 4788 |
| ERMAP | GCCAGAAGGGAAAGGCCA | TCCTGAAGGGCTGGGCCA | 4789 & 4790 |

FIG. 1 Cont.

| | | | |
|---|---|---|---|
| ERN1 | GCCCAATGCACACGGCAA | TCTGTGCCAGGCACCCCA | 4791 & 4792 |
| ERN2 | GGGGACATCAGTGCGAGA | GGACGAAGCCATCAGGGA | 4793 & 4794 |
| ERO1L | CTGGCCTACATGCAAGCA | GGCGCTCGAAGAATGGTA | 4795 & 4796 |
| ERO1LB | GGAGAGTGTGGAACAGCA | CGCCTCGGCTAGGCGCCA | 4797 & 4798 |
| ERP27 | GTGCTGCCCAGGAACCCA | CCTATGACAGCCACCTCA | 4799 & 4800 |
| ERP29 | GCAGCGGCCTGCACACCA | CCAACCTTAACTGCCCCA | 4801 & 4802 |
| ERP44 | GGCAGATTACATCAGGCA | AGGCACAGTCATCATGCA | 4803 & 4804 |
| ERRFI1 | CTACCTGAACGACCACCA | GGCTGAAGATATACCGCA | 4805 & 4806 |
| ESAM | CCCAAGAGCTCAGACACA | AGGGCCTGGCTGGAGAGA | 4807 & 4808 |
| ESM1 | CACAGTCTCAGGCATGGA | CATCCCGAAGGTGCCGTA | 4809 & 4810 |
| ESPL1 | GAAGCTGGCTGGAGAGGA | TCAAGGAAGCGGGCACCA | 4811 & 4812 |
| ESR1 | CAACCTGGCAGACAGGGA | GAGCGCCAGACGAGACCA | 4813 & 4814 |
| ESR2 | CCTGACCAAGTTGGCCGA | GGTCAATTGAGCGCCACA | 4815 & 4816 |
| ESRP1 | GCACTGCAGCCCTCCACA | TGTGGAGGGACACCGCTA | 4817 & 4818 |
| ESRP2 | CGCTCATTCCCACGGAGA | AGGCTCCTGACTGGGACA | 4819 & 4820 |
| ESRRA | GCGAGAAGCTCTGCACGA | CCCTCCAGCTTCACCCCA | 4821 & 4822 |
| ESYT1 | ATCACCTCCTCAGCCCCA | CGAAGGGACCGGCAACCA | 4823 & 4824 |
| ETFA | AGTGATCGACCAGAGCTA | CGGGAAGCACCAACTGCA | 4825 & 4826 |
| ETFB | TGCTGGGCAAACAGGCCA | CTGTCACCACAGCTGGCA | 4827 & 4828 |
| ETFDH | AGACCGTCCTGCCACGGA | TCAGAGTCCACGGCTCCA | 4829 & 4830 |
| ETHE1 | CCGTGGAGGAGGAGAGGA | TCTGCACCCCACAGCGCA | 4831 & 4832 |
| ETS1 | CAGCTTCGACTCAGAGGA | GGTCAGCACGGTCCCGCA | 4833 & 4834 |
| ETS2 | CGAAGATGACTGCAGCCA | CCAGCACAGCTGCAGGTA | 4835 & 4836 |
| ETV3 | AGGCTCCCGGCAGATCCA | AGGCGATGACATGGCGGA | 4837 & 4838 |
| ETV4 | AGCCTGAGGAGGTCGCCA | GATTGTCCGGGAAGGCCA | 4839 & 4840 |
| ETV5 | CCCCCTTACCAGAGGCGA | CCTCGACCTGTCCAGGCA | 4841 & 4842 |
| ETV6 | AGCTGATGCCCAGCCCCA | ATGCAGCCCGTCCTCGGA | 4843 & 4844 |
| EVA1A | CAGAGAGAGCAGCAGCGA | TCCGCAGAGGTGAACACA | 4845 & 4846 |
| EVI2B | AACTTGCCCCTGCCACCA | AGGTGGAGGTGGCAGGGA | 4847 & 4848 |
| EVI5 | AGGGGCTTCTCAGGCCAA | CTGCCACTGCGGGGTCCA | 4849 & 4850 |
| EVL | CAGACAAGCCAGCCGAGA | CACAGGCTTCTCCACCGA | 4851 & 4852 |
| EVPL | TCCGCGAGAAGGACCAGA | AGGCCTCGTATGGGGACA | 4853 & 4854 |
| EVX1 | ACCTGCCGGAAACCACCA | CCGGCGAGTAGTAGGGCA | 4855 & 4856 |
| EWSR1 | GGAAACGTCCAGCACCGA | CCACGATCCATGAGGCCA | 4857 & 4858 |
| EXO1 | CTAAGCTACGCTGGGCAA | GAATGGGCAGGCATAGCA | 4859 & 4860 |
| EXOC1 | GGCATAAGGGAGGAGGAA | GAGTGCCACACCACCTGA | 4861 & 4862 |
| EXOC2 | TCGCTCACGCCATCCAGA | CAACGTGGCCATTACGCA | 4863 & 4864 |
| EXOC4 | TGCCAGCACTGGACGAGA | CTCGCAGATAGGCGCTCA | 4865 & 4866 |
| EXOC8 | CCGAAGGCTACTCGCAGA | TCGATGCGAAGCTGACGA | 4867 & 4868 |
| EXOSC1 | AGGAAGATGTCCGAGCAA | GGGCTACCACCACTCCCA | 4869 & 4870 |
| EXOSC10 | GCGGCAGCAGATCAACGA | TAGCCATCCGGAGGGGCA | 4871 & 4872 |
| EXOSC2 | AGTGCTGAGGTCCAGGCA | CCGAGAATCACTGAGGCA | 4873 & 4874 |
| EXOSC3 | CTCTCAGCAGAAGCGGTA | AGATCTCCAACCTGCACA | 4875 & 4876 |
| EXOSC4 | TGGATGCCGGGATACCCA | TCCATCTCAAGCAGCGCA | 4877 & 4878 |
| EXOSC5 | TGCAGAGAAGAGCCGGGA | ATCAGAGTCCAGGGCGCA | 4879 & 4880 |
| EXOSC7 | ATGACCTTGGCACCGAGA | CACCACATTCCAGAAGCA | 4881 & 4882 |
| EXOSC8 | GGCCCAAGTGGCTAGCCA | CCATCGTAGTCGAGGCAA | 4883 & 4884 |
| EXOSC9 | ACCTGGCAGGCAGTCAGA | CATAAGGCCACGATTGCA | 4885 & 4886 |
| EXPH5 | GCTTATCGCAGCGGGACA | GGCACCTGACTACTGGGA | 4887 & 4888 |
| EXT1 | GGTGGACCAATTGGCCAA | GAGAGTGGATCAGCGGCA | 4889 & 4890 |
| EXT2 | CCCACAGGTGCTACAGGA | ACAACCGGGACACAGCCA | 4891 & 4892 |
| EXTL1 | GTGGCAGAGCTTCCCAGA | CGGCTGTGGTGAGAACCA | 4893 & 4894 |
| EXTL2 | ACTCATCAGCACCCCAGA | ATGAGGCTCCAATCAGCA | 4895 & 4896 |
| EYA4 | GGGTCAAAGTCCAGAGGA | GTGCATAAGACCCGGTGA | 4897 & 4898 |
| EYS | CCCCTGCCAAAATCAGGA | AGGAGGCTGTTGGAGACA | 4899 & 4900 |
| EZH1 | CTGCCAGTGCAACCCAGA | CAGTGCTCTGAGGCCCCA | 4901 & 4902 |
| EZH2 | CCGCTGACCATTGGGACA | CCAGCCTGCCACGTCAGA | 4903 & 4904 |
| EZR | GGAGGAGCTGGAGAGACA | GCCTCTTCCAGGAGGGCA | 4905 & 4906 |
| F10 | CCACGCTGATGACGCAGA | TGCGGTCCACGTAGGGCA | 4907 & 4908 |
| F11 | CCCAGGATCGTTGGAGGA | CCAATGATGGAGCCTCCA | 4909 & 4910 |
| F12 | GTGCCAGACCCCAACCCA | CGCGGGTCATCGAAGACA | 4911 & 4912 |
| F13A1 | TCCACCGTGCAGTGGGAA | TCCAGCTCGCCATACACA | 4913 & 4914 |
| F13B | GCAAGCTATGCAACAGGA | AACAGGTGGGGATGACCA | 4915 & 4916 |
| F2 | CGGATGCAGAGATCGGCA | GCTTGCCAATGCGCACCA | 4917 & 4918 |
| F2R | GCACCTGGCCACGGCAGA | AGCCCAGATGGCCAGACA | 4919 & 4920 |
| F2RL1 | GAGCCAGGGCCAGAGCCA | GTGCGGACACTTCGGCAA | 4921 & 4922 |
| F2RL2 | CCTGCCCAAGCACACCTA | GGGAGATGAGGACTCGCA | 4923 & 4924 |
| F2RL3 | GCGCTGAGGCTGACCGCA | GTCCCTGAACTCGGCCGA | 4925 & 4926 |
| F3 | GTGTGACCTCACCGACGA | CAGAGGCTCCCCAGCAGA | 4927 & 4928 |
| F5 | GCAGGGATGCAAACGCCA | TGGGCTCCCAGTAACCCA | 4929 & 4930 |
| F7 | ACGACGGGGATGAGCAGA | CCAGCGTCCTCTCAGAGA | 4931 & 4932 |
| F8 | GCTCAGCATGGGCAGCAA | GAAGCCATTCCCAGGGGA | 4933 & 4934 |
| F9 | GGAGAAGATGCCAAACCA | TCAACACAGTGGGCAGCA | 4935 & 4936 |
| FAAH2 | CACAGTGGCACCTAAGCA | GTCCAGCCACAACCTGGA | 4937 & 4938 |
| FABP1 | TTCACGGTGGGGGAGGAA | CACCTTCCAACTGAACCA | 4939 & 4940 |
| FABP3 | GCCTACCACAATCATCGA | CATCGAACTCCACCCCCA | 4941 & 4942 |
| FABP4 | TGGGCTTTGCCACCAGGA | TGTACCAGGACACCCCCA | 4943 & 4944 |
| FABP5 | CGCAATGGCCAAGCCAGA | TGCTGAACCAATGCACCA | 4945 & 4946 |
| FABP6 | GCAAGTTCGAGATGGAGA | CCCGGAGTAGTGCTGGGA | 4947 & 4948 |
| FADD | GACAGCATCGAGGACAGA | GTACCAGGTCAGCCACCA | 4949 & 4950 |
| FADS1 | GCTCCAGGCCACATGCAA | CACACAAGGACTGCACCA | 4951 & 4952 |
| FADS2 | CCCGGCACAACTTACACA | AAGGTAGGCGTCCAGCCA | 4953 & 4954 |

FIG. 1 Cont.

| | | | |
|---|---|---|---|
| FAF1 | CCTGCACAGACCCGGGAA | GCAGATGACGCCATGCCA | 4955 & 4956 |
| FAH | CCAAGGCCCATGAGCACA | GAGCATCCATGGGCACCA | 4957 & 4958 |
| FAIM3 | CTGCACAGGCAGAGAGCA | TTCACCACCAGCCCCAGA | 4959 & 4960 |
| FAM102A | CGACCTGGGTGGACGACA | GGCTCACGAACAGCCGGA | 4961 & 4962 |
| FAM107B | TGGCAGTGCGAATCGGAA | CGCCCCATCATCCAGGGA | 4963 & 4964 |
| FAM110A | CAAGTCGGACTTGAGCGA | GGGCATTGCGCTCCACCA | 4965 & 4966 |
| FAM111B | CAGGACTATGGCGACAGA | GGCCTTCAGGATGACCAA | 4967 & 4968 |
| FAM114A1 | CCGAGGTCCTTAACCCCA | AGACCTGCAGAACAGGCA | 4969 & 4970 |
| FAM117A | CCTGGAAGGGCTCAACCA | AGGCCACAAGGCTGGGGA | 4971 & 4972 |
| FAM120A | CTCAAAGCCAGCCGGGAA | AGGCAGGGTAGAAGGGCA | 4973 & 4974 |
| FAM123B | CTGCCTGGATAAGCCCCA | GGTTATAGCAAGGGCCCA | 4975 & 4976 |
| FAM124B | CAGGTGGCAGACTCAGGA | TATGATGGCACCACCGCA | 4977 & 4978 |
| FAM125A | TTCACACTCCACCCACGA | CTCCACCACGAAGCCGTA | 4979 & 4980 |
| FAM126B | TGGGCGTTCAGCCAAGGA | GGCACCACCTGGCCAGCA | 4981 & 4982 |
| FAM129A | CTGCCTCAGTGAGAGCCA | AGCATCCTCCACCACCCA | 4983 & 4984 |
| FAM131A | GCCCACCACTAACGGGCA | TCTAAGGACACCACCCCA | 4985 & 4986 |
| FAM132A | GTCCCTGTGCCAGCGCCA | CCGGAGCCATTGTCCACA | 4987 & 4988 |
| FAM133A | GAAGGTGTGAAGAGCGAGA | ACACAGGGGAACTCGGCA | 4989 & 4990 |
| FAM134A | GGACTCGGAGGAAGAGGA | GGCAGAGCAGTGAGGCCA | 4991 & 4992 |
| FAM134B | AAGACCCAGGCTCAGCCA | TGCACACACTACAGACCA | 4993 & 4994 |
| FAM135B | AGAGCTGCCACACACGGA | CCAGGAACTGGGTCCACA | 4995 & 4996 |
| FAM13A | CGGCAGGTGATGAAGCCA | CCGCTTGCTGGAGGGGGA | 4997 & 4998 |
| FAM13C | AACCCACTGCTGTCGCCA | GCCATCTCCACAGCTGCA | 4999 & 5000 |
| FAM150A | AGGGAGTGCTCAACGCCA | GGGAGCACAGTGGACTCA | 5001 & 5002 |
| FAM150B | ACACCAGAGACTGCACCA | CCATGCACACTGGACTGA | 5003 & 5004 |
| FAM160B1 | CCGAGACGCTCATAGGCA | GCGAGGTTCACGTAAGGA | 5005 & 5006 |
| FAM161A | CCAAGGCGTAAGTCACCA | TGGAAGATACCGTGGGCA | 5007 & 5008 |
| FAM162A | CCGGAGCTCCATCCCGCA | CAAGCATCTCCAACGAGA | 5009 & 5010 |
| FAM164C | TGGCACTGATGGGGACCA | TCCGCCTGCGTGGCAGCA | 5011 & 5012 |
| FAM171A1 | CCCAGCTTCCCTGAACGA | GGACCTGCCATCCAAGGA | 5013 & 5014 |
| FAM171A2 | GAGGCAACAGCACCGCAA | GAAGTCATCCCGGGAGGA | 5015 & 5016 |
| FAM171B | GGAGCCGATACTCAAGCA | GGCTCTGGGATGCGGGGA | 5017 & 5018 |
| FAM174B | CCCTCAAGGCAGCCGTGA | CCGACCTGAAGACGCGCA | 5019 & 5020 |
| FAM177A1 | CCCAAGGAGAGTCATCCA | ATGTAGCAGCCCGAAGCA | 5021 & 5022 |
| FAM179B | CGCAGGGTACGCCAAGCA | GCCAATCTGGCCTGCACA | 5023 & 5024 |
| FAM180A | CGCCAGCCTCTCCAGCCA | TGTAGGCCAGGGTCAGCA | 5025 & 5026 |
| FAM189A1 | GACCCCACCTTGTGCACA | GAAGCGCTCCCAGGCACA | 5027 & 5028 |
| FAM190B | GCATTACCACCTCAGCCA | CCTGAACCATGTGCCGAA | 5029 & 5030 |
| FAM193A | GCAGTCCAGCAACAGCCA | AGGTGAGGTGTGGAGGCA | 5031 & 5032 |
| FAM193B | GCCAAGAAGAGCGAGGCA | CCCTCTCCAGCCTCAGCA | 5033 & 5034 |
| FAM198A | CCTTCAGCACCCTGAGGA | GCAGCGACTTCAGCAGCA | 5035 & 5036 |
| FAM198B | GAAGCCCAAGCGCAGGAA | TACCCAGGTGCTACAGCA | 5037 & 5038 |
| FAM19A2 | GTGGTGGCACTCCACAGA | GCATCCACACATGATGGA | 5039 & 5040 |
| FAM19A3 | GCCCTCCTGCGTGGACGA | GCAGGGCTCCATCTGACA | 5041 & 5042 |
| FAM19A4 | CATAGAAGAGCGGTCACA | CAAGAAGGTTGAGCCCGA | 5043 & 5044 |
| FAM19A5 | CCAAGCAGTGGTGTGACA | GGGCTGCGTGCACGTCCA | 5045 & 5046 |
| FAM20A | CAGAGGGTTCGGACGACA | AGTCAGCTTGGGCCAGCA | 5047 & 5048 |
| FAM20C | CCCTGACTACTGCGAGGA | GCGGCACCAGGATGGAGA | 5049 & 5050 |
| FAM212B | GAAAGGCCAGCCCCAGGA | TCACGGTCAGGCCGCACA | 5051 & 5052 |
| FAM22A | AGGAGGAGGAACTCCCCA | CTGAGAAGGCCCGAGGCA | 5053 & 5054 |
| FAM22D | CCAGAGGCCAGTGACCAA | CCACATACTCCTGCACCA | 5055 & 5056 |
| FAM26D | GCCACCTCCAGAATGAGA | CTCCCGGGAATGAAGCCA | 5057 & 5058 |
| FAM26F | GCAGGACCTCCTGAAGGA | AGATAGGCATCGGGTGACA | 5059 & 5060 |
| FAM3D | AACTGGGCTTCCGGGACA | GGGGCATGCAGCCCTCCA | 5061 & 5062 |
| FAM46A | AGCCCCCTATGTAGCAGA | GCAGGGTAGCCAAGTGGA | 5063 & 5064 |
| FAM46B | GGACTCGGTGAGACGCCA | GGTGGAAGGCCTCAGACA | 5065 & 5066 |
| FAM46C | AGGCCCACAGACCAGGAA | CGTTCACCACCCTGCGAA | 5067 & 5068 |
| FAM57A | GGACTAAGCCTGCTCCAA | TCTGAGGAGCTACGAGGA | 5069 & 5070 |
| FAM57B | TGATGGCAGAGGTCAGCA | GCCCAGTACAGGTAGGGA | 5071 & 5072 |
| FAM5C | CCTCCTGGCGTAAGCGGA | TGGCTGCCTCCGAAGGGA | 5073 & 5074 |
| FAM63A | TGGCTCCCCAGAAACGCA | CCAAGTCGGTAAGCCCCA | 5075 & 5076 |
| FAM65B | AAGACCCAGAGGAGCCCA | CAGAACCCTCAGAGAGCA | 5077 & 5078 |
| FAM73B | CCTGGAGAGCTACGAGGA | AGGACCGACCAGCAAGCA | 5079 & 5080 |
| FAM78A | CGAGAGCAACGTGGCCAA | GTTGGTGGCCACCAGCCA | 5081 & 5082 |
| FAM82A2 | TCCAGCCAGAAAACCCCA | AGGAAGCTCTGGAGGGCA | 5083 & 5084 |
| FAM92B | CCCTCCAGCTGGAGGAGA | GTGTTGGCAAGCAGCCGA | 5085 & 5086 |
| FAM96A | GGACCCAGAAAAGCCCAA | ACTCTTAAGCACAGCCCA | 5087 & 5088 |
| FAM9B | AGGACAACCAGCCACGGA | CACATTCATCACGGACTGGA | 5089 & 5090 |
| FANCA | CGGCTCCAGCGGAGACCA | CAGAAGGAAAGACGGGAGA | 5091 & 5092 |
| FANCD2 | CAGCAGACTCGCAGCAGA | TGAAGTCTAGGAGCGGCA | 5093 & 5094 |
| FANCE | CCTGGAGCCAGATGCACA | GGAGTGACTGCAACACCA | 5095 & 5096 |
| FANCF | CCTGGAGAGGGGAGCCAA | GCAACTCCTCCCAGGGCA | 5097 & 5098 |
| FANCG | CTGATCCAGGCAGGCAGA | AAGCAGGTGGGTGGCAGA | 5099 & 5100 |
| FANCI | GGAAAACAGCCGGGAGGA | CCTGGGACAAGTCACGCA | 5101 & 5102 |
| FANCM | GGGACTACCAGCTGCACA | TTGGGGCCATGAAGACCA | 5103 & 5104 |
| FAP | GTGGCAAGTGGGAGGCCA | CCTGGGCCGTAGCAGACA | 5105 & 5106 |
| FARP1 | GATGACACCCAGGAGGCA | GGAGCATCTCAGTACCCA | 5107 & 5108 |
| FARSA | CCCACACCACATCAGCCA | TGGTGAAGAACTCCCGCA | 5109 & 5110 |
| FAS | GACATCAACTCCAAGGGA | AGGACAGGGCTTATGGCA | 5111 & 5112 |
| FASLG | GGTGATGATGGAGGGGAA | GATTGAACACTGCCCCCA | 5113 & 5114 |
| FASN | CAGCACCTCTATCCCCGA | AGGCCACGCTTCAGGACA | 5115 & 5116 |
| FAT1 | CAGTGGCAGAAACGGGGA | TAGCCTGCACGTGGACCA | 5117 & 5118 |

FIG. 1 Cont.

| | | | |
|---|---|---|---|
| FAT2 | AGCCACCACTCTCAGCCA | CTACGCTGATGACCCCCA | 5119 & 5120 |
| FAT3 | GGAGATGCACAGCAGCGA | ACAGTCCAGCCCTGAGCA | 5121 & 5122 |
| FAT4 | GCACTCTGGTAGGCACCA | CATTGAGGTCCCGCACCA | 5123 & 5124 |
| FBF1 | GGAAGCAGGAGCAGCACA | CCCTGGGGAACAGACCCA | 5125 & 5126 |
| FBL | CTCCACAGCCTCAGCCGA | ACTCCCACGACCACGGCA | 5127 & 5128 |
| FBLN1 | AGGCTACCAGCTCAGCGA | CAGCCTGTAGCCAGACGA | 5129 & 5130 |
| FBLN2 | GCTACACCATGACGGCCA | GAGGACACTCGAAGCGCA | 5131 & 5132 |
| FBLN5 | CCCCATCCGCTGTGAGGA | TGGAAGATGTCAGCGGGA | 5133 & 5134 |
| FBLN7 | AGCGTTCAGACCGGCAGA | CCGACATGTCGACGTCCA | 5135 & 5136 |
| FBN1 | TAACCACCGCTGCCAGCA | GATGTGAGCGCTGAGGCA | 5137 & 5138 |
| FBN2 | GGGAACCACAGGTGCCAA | GCAGGAAGCAGAGCCACA | 5139 & 5140 |
| FBN3 | GGACGAGTGTGCAAGGGA | ACACTGGCCATGGGGACA | 5141 & 5142 |
| FBP1 | GGCCACCACTGGGAAGGA | GAGCACGTCGTCGGGGGA | 5143 & 5144 |
| FBP2 | TGGCCTCCATCGGAACCA | TCACCAAGAGCCGGGTCA | 5145 & 5146 |
| FBXL2 | AGGTTACCCGTGCAGGCA | GTCGGTGGGGTGACGGGA | 5147 & 5148 |
| FBXL8 | CACACCACTACGCCGCAA | AGCGTAGGCCTCCAGGGA | 5149 & 5150 |
| FBXO11 | GACTGGAAGCAACCCCAA | AGGAGACCTCGACCCCCA | 5151 & 5152 |
| FBXO31 | GGGCGTGAGCTCCAGGAA | GCTGTACAGGCTGAAGGA | 5153 & 5154 |
| FBXO32 | TCTCCACTGGCAGCAGCA | CAGCCTGGCCCAGGCTGA | 5155 & 5156 |
| FBXO34 | CTCAGGCTGATGAAGGCA | GGGCAGTCCTGAGAAGCA | 5157 & 5158 |
| FBXO4 | TACGACCTCACGGGAGGA | CTTCCCAACTGACACAGA | 5159 & 5160 |
| FBXO5 | AGAAATCAGCAGCCCAGA | GCAGGTGAATTACAGCGA | 5161 & 5162 |
| FBXO6 | GAGTCACCAACAGCAGCA | CGGTAGGGCGATTGGGCA | 5163 & 5164 |
| FBXO7 | CGGGGGTGAATATGACCA | GGTCCTGGAAGTGGGCCA | 5165 & 5166 |
| FBXW11 | AAGTCTGGAGCACGAGCA | ACCGGATGCATCGGACCA | 5167 & 5168 |
| FBXW7 | GCAAGGTCCCAACAAGCA | CCGACTCCCAACTGCACA | 5169 & 5170 |
| FCAR | CGCATGGCCGTGGCAGGA | CAGCTCGGTTCAGCCACA | 5171 & 5172 |
| FCER1G | GGCCCTGGGAGAGCCTCA | TCAGTCGACAGTAGAGGA | 5173 & 5174 |
| FCER2 | TGACGACATGGAAGGGCA | CCGAAGGCCAATCCAGGA | 5175 & 5176 |
| FCGBP | TCACGGTCCAGGTGGCAA | GTTCCCACACAGGCCACA | 5177 & 5178 |
| FCGR1A | CTGCGAGGCAGGAACACA | CAAGCACTTGAAGCTCCA | 5179 & 5180 |
| FCGR1B | CAGGGCGAAGTGACCCCA | CATGACACCTCAAGGCCA | 5181 & 5182 |
| FCGR2A | CATCCAAGCCTGTGACCA | TGGGCAGCCTTCACAGGA | 5183 & 5184 |
| FCGR2B | CATCCAAGCCTGTGACCA | GGCCACTACAGCAGCA | 5185 & 5186 |
| FCGR3A | AGCTGGCATGCGGACTGA | CTCGAGCACCCTGTACCA | 5187 & 5188 |
| FCGR3B | GGTGCAGCTAGAAGTCCA | CCCAACAAGCCCCCTGCA | 5189 & 5190 |
| FCGRT | GGCCCCAACAGTGACGGA | CGATGACGATTCCCACCA | 5191 & 5192 |
| FCN1 | TGAGCGGCTGGCACACCA | GGGCAGTCAGGGCGTGGA | 5193 & 5194 |
| FCN2 | TGACCGCCCAGGGAACCA | GTCAGGGAATCTCCCGCA | 5195 & 5196 |
| FCN3 | CCAGCTGGCACTGGGCAA | GACACTGCATAGCGACCA | 5197 & 5198 |
| FCRL1 | GGACAGGTGATGGAGGGA | TTGGGCGAGACACCGGGA | 5199 & 5200 |
| FCRL2 | ACTCCTGTGAGGCCAACAA | CAGTCCCCAGAGAACTCCA | 5201 & 5202 |
| FCRL3 | GCCCGAAGGAAACCAGGA | GGAAGGCCTGGACGAGGA | 5203 & 5204 |
| FCRL4 | GCTCCCTGCCATCAGACA | CTTCCTCCGACGCCAGCA | 5205 & 5206 |
| FCRL5 | CCCCAGGCATCTCAGGAA | GAGGAGCTGAGGAAGCCA | 5207 & 5208 |
| FCRLA | GCCACTGAGGACAACCAA | GGAGCAGTTCCTGGAGCA | 5209 & 5210 |
| FCRLB | ACGACAAGGTGGTCTACAA | CAGCCACCTTAGCGGAGAA | 5211 & 5212 |
| FDFT1 | CTGAACAGGAGTGGGACA | AGGCCCATAGAGTTGGCA | 5213 & 5214 |
| FDPS | ACCCCAGTGTGACCGGCA | GGAGTGGCCCGTTGCAGA | 5215 & 5216 |
| FDX1 | GCGGGAGCGCGGAGGCGA | GACAGGTTGAACAAGCCA | 5217 & 5218 |
| FDXR | AGGGTGTCGATGAGGCCA | CAGTAGAGGCCTGGCACA | 5219 & 5220 |
| FECH | CTCAGGAGGTAAGCGCCA | GAGGACCCAACCAGGGCA | 5221 & 5222 |
| FEN1 | TGCTGCGGCTACCGAGGA | TGGGCCCAATACCCCGGA | 5223 & 5224 |
| FERMT2 | GAAGCCCCTTGTCACCAA | ACTTGAATCGGAGCAGCA | 5225 & 5226 |
| FES | TGGCCATTCACCGGGAGA | ACGTCAGGTGCGGACCCA | 5227 & 5228 |
| FETUB | CACCAGGGCTTCTAGCCA | AGGCACAGAGTCGGAGGA | 5229 & 5230 |
| FEV | GCTCACGGACCCGGACGA | CCAGGCCCTGGAAGTCGA | 5231 & 5232 |
| FEZ1 | GCAGAAGGAGCAGCGAGA | TGAAGCGCTTGAGAGGCA | 5233 & 5234 |
| FFAR2 | CTTGAACACGACTGAGCA | AAGGTCCGAAGCACACCA | 5235 & 5236 |
| FGA | GGGGCTCCTATGACCCAA | GCGAACAGCCCTGAGGGA | 5237 & 5238 |
| FGB | GCTCGTCCAGCCAAAGCA | TAGGACACAACACCCCCA | 5239 & 5240 |
| FGD1 | GATCTTGGGAAGCGGGCA | ACCCCGTGCAAGGCCACA | 5241 & 5242 |
| FGD4 | GCAGCTGGACCAGCACCA | CCAGCTCTGGCAAGAGGA | 5243 & 5244 |
| FGD5 | GAGCCCTGTCCACAGCAA | TGCCGACGAGATGGGACA | 5245 & 5246 |
| FGD6 | GCAGCTTGGACCCAGACA | TCAGAGGGAAGGTCACCA | 5247 & 5248 |
| FGF1 | AAGGCTGGAGGAGAACCA | GAGACTGGCAGGGGGAGA | 5249 & 5250 |
| FGF10 | GTCCGCTGGAGAAAGCTA | CAGGATGCTGTACGGGCA | 5251 & 5252 |
| FGF12 | CCTGCAGATGCACCCAGA | GGATGGCCACTACACGCA | 5253 & 5254 |
| FGF13 | CCAAGCTATACAGCCGACA | GATAGCCACCACTCGCA | 5255 & 5256 |
| FGF14 | CTACCCAAGCCATTGGAA | TCACCCCAGGCTTCGGGA | 5257 & 5258 |
| FGF17 | AGCTGAGCAGGCGGCAGA | GCGGTGGCGGAGATGCGA | 5259 & 5260 |
| FGF18 | CGATGGCACCAGCAAGGA | GGTGAAGCCCACGTACCA | 5261 & 5262 |
| FGF19 | CAGTGCCAAACAGCGGCA | CCTCTGGGACCATGGGCA | 5263 & 5264 |
| FGF2 | GCCACTTCAAGGACCCCA | GCCAGGTAACGGTTAGCACA | 5265 & 5266 |
| FGF21 | TTACCAGTCCGAAGCCCA | GCAGGCCTGGTAGTGGCA | 5267 & 5268 |
| FGF22 | CAACACCTACGCCTCACA | GGGCAGGAAGTGGGCGGA | 5269 & 5270 |
| FGF23 | CGGGTACGACGTCTACCA | CGTTCCTCCGGGACAGGA | 5271 & 5272 |
| FGF3 | ACCACAGGGACCACGAGA | CCCAGTCTCGAAGCCTGA | 5273 & 5274 |
| FGF4 | CCTCCAGGCGCTCCCCGA | GCTGCTCATGGCCACGAA | 5275 & 5276 |
| FGF5 | ACTCCATGCAAGTGCCAA | ATTCAGGGCCACATACCA | 5277 & 5278 |
| FGF6 | CCACGAGGAGAACCCCTA | CGAAGAGGGCACTTCTCA | 5279 & 5280 |
| FGF7 | CACAGTGGTACCTGAGGA | CCACAATTCCAACTGCCA | 5281 & 5282 |

FIG. 1 Cont.

| | | | |
|---|---|---|---|
| FGF8 | CAACGGCAAAGGCAAGGA | CCTTGCGGGTGAAGGCCA | 5283 & 5284 |
| FGF9 | CTGGGTCAGTCCGAAGCA | AGCTGCCTCCGCCTGAGA | 5285 & 5286 |
| FGFBP1 | CTGAGCAGGAGGAGGGCA | GAGCGCAGATTCCGGGCA | 5287 & 5288 |
| FGFBP2 | GCCGCAACACAGACCAGA | CATGGTGAAGGCGCCTCA | 5289 & 5290 |
| FGFR1 | TGGACCAGTACTCCCCCA | GCAGCGGCTCATGAGAGA | 5291 & 5292 |
| FGFR1OP | AAGGCTGAACTCCGAGCA | CTGCAACAAGACTAGCCA | 5293 & 5294 |
| FGFR2 | TGGCGGAAGCAGTGGGAA | ATGACATAGAGAGGCCCA | 5295 & 5296 |
| FGFR3 | CGCCAACTGCACACACGA | GCTCGAAAGGCGCCGACA | 5297 & 5298 |
| FGFR4 | CCGGGTGTACACACACCA | ACAGCTCCTCCACCGGGA | 5299 & 5300 |
| FGFRL1 | GCCTTGGCGCCAACACCA | CAGGCTAGTGGCCGAGGA | 5301 & 5302 |
| FGG | GCTGACAAGTACCGCCTA | GAGATGGCCAGCGTGACA | 5303 & 5304 |
| FGGY | AGAAAGGCTGGGACGACA | CGACCGCAATCCCAGGGA | 5305 & 5306 |
| FGL1 | CAGCACGTGGGACAGAGA | ATACCACCACCCATGCCA | 5307 & 5308 |
| FGL2 | CTATAATGGCACAGCTGGAGA | CAGCCCACAGTTCCCAGA | 5309 & 5310 |
| FGR | CCCAGGTAGCTGAGGGCA | ATGAGACGCGCCAAGCCA | 5311 & 5312 |
| FH | CCAAGTCATGGGGAACCA | CTGAAGCATCCCCCAGCA | 5313 & 5314 |
| FHDC1 | CCAGGGACAAACCCACCA | GGTCAGGGTCCGCACAGA | 5315 & 5316 |
| FHIT | CCCGCTGCGGCCAGTGGA | AAGGTGAGAGAGGTCCCA | 5317 & 5318 |
| FHL1 | CTGGATGCAAGAACCCCA | GGCCAGATTCACGGAGCA | 5319 & 5320 |
| FHL2 | ACCAACCCCATCAGCGGA | TGAGGAAGCCACGCCCCA | 5321 & 5322 |
| FHOD3 | CGTCAAGTCAGCCACCCA | AGGTGCCAACCAAGCCCA | 5323 & 5324 |
| FIBIN | GAGCAGGCTCAACGAGGA | GTCCCTGAGCCCCACAGA | 5325 & 5326 |
| FICD | GCCCATCACCATCCGCAA | CACTTGGCGATGAAGCGA | 5327 & 5328 |
| FIP1L1 | TCAGCCGAGTAGAAGGCA | ACAGTCGGAGGAGGTGGA | 5329 & 5330 |
| FIS1 | GAACAACCAGGCCAAGGA | CCAGGGCCATGCCTCCCA | 5331 & 5332 |
| FJX1 | CGACCGGCTCGTAAGCAA | ACACGCACACTGACTGCA | 5333 & 5334 |
| FKBP10 | GCTACTCCCGCAACCACA | CGTTCCCCCATGCAGGCA | 5335 & 5336 |
| FKBP11 | GCCTATGGAAAACGGGGA | GCAATCAGCTCCACGTCA | 5337 & 5338 |
| FKBP1A | TGTGGGTCAGAGAGCCAA | GCTCCACATCGAAGACGA | 5339 & 5340 |
| FKBP2 | CATCAAGGGCTGGGACCA | ACCCTAGCTCGGATGGGA | 5341 & 5342 |
| FKBP4 | TGGGGGAGGTGTGCCACA | CCAGTGCAACCTCCACGA | 5343 & 5344 |
| FKBP5 | TCATCAAGGCATGGGACA | AGGGAGACTGCCAGCCGA | 5345 & 5346 |
| FKBP9 | GCTACTCTCGGAACCGCA | AGGTGAGGCGGGACCACA | 5347 & 5348 |
| FLCN | ATCGTGGAGGTCCACGCA | GGCTCCCACTGGTCACCA | 5349 & 5350 |
| FLI1 | CCTCCCACCACAGCAGGA | ACGCTGCAGTCCACCGGA | 5351 & 5352 |
| FLII | GGAAGCCTTCCACGGCAA | ACAGTGCGGCACTCAGCA | 5353 & 5354 |
| FLNA | TGCCCAACTTCCCCAGCA | CCCTCAATACCAGGCCCA | 5355 & 5356 |
| FLNB | GTCTGAGCTGGAGCCAGA | TGCCATAGGCGGACACCA | 5357 & 5358 |
| FLNC | TCACCAGCCTCCAGGAGA | TCGATGGAGTGGACGCCA | 5359 & 5360 |
| FLOT2 | CAAAATCGGGGAGGCGGA | GCAGGGCCTCTAGCACCA | 5361 & 5362 |
| FLRT2 | CCTGACTGGGATGGCAGA | GGTGAAGAGAGAGAGCCA | 5363 & 5364 |
| FLT1 | CTGGCACCCCTGTAACCA | CAACCAAGGTGCTAGCCA | 5365 & 5366 |
| FLT3 | AGGATGTCAGCTGGCAGA | GCGGAGAGAGTAGCCCCA | 5367 & 5368 |
| FLT3LG | CTCGGGACTCAGTGGGA | CATCTTGGACCCAGCGACA | 5369 & 5370 |
| FLVCR2 | TGAAGCTGGGCAGCCTGA | GGAGGGACCAAGAACCCA | 5371 & 5372 |
| FMN2 | TCCTGCCCTGGACACAGA | CAGGAGGCAGTGTCAGCA | 5373 & 5374 |
| FMNL3 | CCAAGTCCACTGACCGGA | CCTTCACGTCCAGCAGCA | 5375 & 5376 |
| FMO1 | GCTCCTAACGGATCCACA | CTGGGCCAGTCAAGCGGA | 5377 & 5378 |
| FMO2 | GCAATGTACTGCCACGAA | AGTAGACGACTTGGGACA | 5379 & 5380 |
| FMO3 | ATGAGCTCCCAGCAAGCA | TCAAGGAAGGGGTAGGCA | 5381 & 5382 |
| FMO5 | GCTCCAGGGAGGATGACA | AGGGCTGAATCAAGCCTA | 5383 & 5384 |
| FMOD | CCTACAACCAGCTGCAGA | GCACCTGCAGCTTGGAGA | 5385 & 5386 |
| FMR1 | GCTGGAGAGTTCAAGGCA | TCAATAGCAGTGACCCCA | 5387 & 5388 |
| FMR1NB | CATCATCGGGGACCACGA | TGGGCAGACATACCAGGA | 5389 & 5390 |
| FN1 | GCACACCTGTGACCAGCA | GTCGGAAGCTGAGACCCA | 5391 & 5392 |
| FN3K | CCACCGGAAGATCCCCAA | TCGCATGGTGCCCAAGGA | 5393 & 5394 |
| FNBP1 | CCCTCCCTGCCATAGGGA | CGAATGCGGGTCCAGCCA | 5395 & 5396 |
| FNDC1 | GACTGCCATGGACGGCAA | CTGACAGGCTCCTGACGA | 5397 & 5398 |
| FNDC7 | GCCCAAGGGGAGAAAGGA | GGCCACAGCAGTGACAGA | 5399 & 5400 |
| FNTA | AGCAGCACAAGGAAGAGA | CAGGACATAGGAGGGCGA | 5401 & 5402 |
| FOLH1 | CCCAGGTTCGAGGAGGGA | CTCACTGAACTTGGAAGCAA | 5403 & 5404 |
| FOLR1 | GCAACTACAGCCGAGGGA | GCCCCACTCATGGCTGCA | 5405 & 5406 |
| FOLR2 | GGCAACCCCAACGAGGAA | GTTGCAGCATCAGGGCCA | 5407 & 5408 |
| FOLR3 | GGAGTGCCCAGCCCAGGA | CTGGCCGTGCAGCAGGCA | 5409 & 5410 |
| FOLR4 | AAAGCCAGCCCTGAGCGA | ATGGGGCAGAGCTGGCGA | 5411 & 5412 |
| FOS | CAAGCGGAGACAGACCAA | GGTCATTGAGGAGAGGCA | 5413 & 5414 |
| FOSB | CCCTTCCAGACCAGCCAA | GAGGGCGAGTTCAGGGGA | 5415 & 5416 |
| FOSL1 | CCCCCACACTCATGACCA | AGCGAGGAGGGTTGGAGA | 5417 & 5418 |
| FOSL2 | GTGAGGAGCCCCTGCACA | GCGGTGAGCCTTGGAGCA | 5419 & 5420 |
| FOXA1 | CCTGAAAGGGGACCCCCA | GGGCAACGTAGAGCCGTA | 5421 & 5422 |
| FOXA2 | ACCACCACCAACCCCACA | GGAGTACACCCCCTGGTA | 5423 & 5424 |
| FOXC1 | ACTGCAACCTGCAAGCCA | GCCGTGACTCAGGGACGA | 5425 & 5426 |
| FOXC2 | CAGCGGGGACCTGAACCA | AATCCCCAGCCGGTGGGA | 5427 & 5428 |
| FOXE1 | CAGTTCGGAGCGCTGGGA | CCACCGGGATAAGCGGCA | 5429 & 5430 |
| FOXF1 | CAGCCGAGCTGCAAGGCA | GCATGGAAGAGGACGCCA | 5431 & 5432 |
| FOXI1 | GACTGAGCCCTGAGCCCA | GAGGTTGGTGAGCGGGGA | 5433 & 5434 |
| FOXJ1 | CTACGCCACCAATCCGCA | CGTGGCGGAAGTAGCAGA | 5435 & 5436 |
| FOXJ2 | CCACCCTCATCAGCACCA | CTGGACCAATTGAGCCGA | 5437 & 5438 |
| FOXL2 | CTCAGCCCTGCCAGCCCA | GTGGTCCCAGTAAGAGCA | 5439 & 5440 |
| FOXN3 | GCACATCAGGTCCACCCA | CTCAGTCCGCATCCGGCA | 5441 & 5442 |
| FOXO1 | ACCTATGGCAGCCAGGCA | GGACGCCCGTTAACTGCA | 5443 & 5444 |
| FOXO3 | GCGACTTGGACCTGGACA | GAGGCCTGCTTAGCACCA | 5445 & 5446 |

FIG. 1 Cont.

| | | | |
|---|---|---|---|
| FOXO4 | CCTTCCGTCCACGAAGCA | GAGGTGAGATTGAGCCCA | 5447 & 5448 |
| FOXP1 | GAAGAGCTGAACGGGGCA | CAGGATGCACGGCTTGCA | 5449 & 5450 |
| FOXP3 | ATCCTGCCACCTGGAAGAA | CGGAACTCCAGCTCATCCA | 5451 & 5452 |
| FOXQ1 | GCTCAACCCCAACAGCGA | GGAAGGGCTTGCGCAGGA | 5453 & 5454 |
| FOXRED2 | TGGAGCACCGCCACCACA | TCTCCAGCTGGGCCAGCA | 5455 & 5456 |
| FPGS | AAAGGGCCTCCTCACCCA | GCTCCAGCAGCTTCAGGA | 5457 & 5458 |
| FPR1 | CCTGGACCAACGACCCTA | TGGCTATAAGGGCCACCA | 5459 & 5460 |
| FPR2 | GGCCCAGAACCACCGCA | GGGGTGCCACCCCAGGA | 5461 & 5462 |
| FPR3 | ACTACGAATGGGGACACA | AAGCCACCACAGCAGCGA | 5463 & 5464 |
| FRAT1 | TCAAGGAGGCCGTGCGAA | GCGAAGGGGGTTCATGCA | 5465 & 5466 |
| FREM1 | CCCAGCAGGATGTGGACA | CCCCACTTGAGAAGGGGA | 5467 & 5468 |
| FREM2 | GTCCCCCACAGACACAGA | GGAACTGGAACTGGGCCA | 5469 & 5470 |
| FRG1 | CCCTGGGAGCTCCACACA | CGCCCAACAACAAGTCCA | 5471 & 5472 |
| FRK | TCCCCAGTCACAGAGGCA | ACCACCAGCCCTCATGCA | 5473 & 5474 |
| FRMD4A | CCTTGCAGAACAGCCCCA | GAATGGACGTAGTGGGGA | 5475 & 5476 |
| FRMD8 | CTACTCCAAGCAGGCCGA | ATCCGGCTGGACACCACA | 5477 & 5478 |
| FRMPD2 | CTGCCAAGGAAGGGCAGA | CTTGCAACCTGCCCAGGA | 5479 & 5480 |
| FRMPD4 | GGCAGAGATGGAGGAGGA | CCACCTTCAGTGGCCACA | 5481 & 5482 |
| FRS2 | CTGAAAGCAGCACACCAA | GAACAGGGGTTGGCCCTA | 5483 & 5484 |
| FRZB | ACTTCCAGCACGAGCCCA | CGATGGCCTCGGGAGAGA | 5485 & 5486 |
| FSCB | TACGGAGCCTCCTGCAGA | GGAGACTGAACTTCAGCA | 5487 & 5488 |
| FSCN1 | GAGGGCGTCCAATGGCAA | GCCCGTGACCTTGCGGCA | 5489 & 5490 |
| FSHB | AGCTGACCAACATCACCA | GTGTAGCAGTAGCCAGCA | 5491 & 5492 |
| FSHR | TGACACCAGGATCGCCAA | ACACAGTGATGAGGGGCA | 5493 & 5494 |
| FST | GTCCAGTACCAAGGCAGA | CAATAGATCTGCCCAGCA | 5495 & 5496 |
| FSTL1 | CCAGTGGCTGGAAGCTGA | TCACTGGAGTCCAGGCGA | 5497 & 5498 |
| FSTL3 | CCGCAAGTCCTGTGAGCA | CGCTCGACACACCACGCA | 5499 & 5500 |
| FSTL4 | CAGCCAGCACTGAGCAGA | AGGACAGCTTAGCCGGCA | 5501 & 5502 |
| FSTL5 | GCTGCAAACCTGACAGCA | AGTGGCCATCTGGAGAGA | 5503 & 5504 |
| FTCD | CTGCCGAGAAGCACAGGA | ACAGGGAGTCCAGGCCCA | 5505 & 5506 |
| FTL | CAAGAAGATGGGTGACCA | AGATACTCGCCCAGCCCA | 5507 & 5508 |
| FTSJD2 | GCAGACTCCATTGCCCCA | TGGGAGTCATGCACACGA | 5509 & 5510 |
| FUBP1 | GCACAGCCACCACCAGCA | GGAGGAGCCCCAGTCGGA | 5511 & 5512 |
| FUCA1 | GGGAACAGCTCTCCGGAA | CCACTCCCCATCAGACCA | 5513 & 5514 |
| FUCA2 | GGTGAAACTACTGGGCCA | GGCTAGAGCCCAGCCCCA | 5515 & 5516 |
| FUK | TGCCAGCCTCATGCCCCA | CCGAGTGGACATGCACGA | 5517 & 5518 |
| FURIN | GCGAGTGGGTCCTAGAGA | GGAGGGCAGTGCTGGACA | 5519 & 5520 |
| FUT10 | TCAGACTGTGACCCACCA | GCATCCATAGAGGCTGGA | 5521 & 5522 |
| FUT11 | GGCTACAGGACACAGCCA | AACCGCGGTACACGGGCA | 5523 & 5524 |
| FUT3 | ACCGCAGCGACTCCGACA | ACACCGCCCAGGCCACCA | 5525 & 5526 |
| FUT4 | GAACTCGCAGCACCTGGA | GGAGGAGGCACTTGGGAA | 5527 & 5528 |
| FUT5 | CCGACTACATCACCGAGA | TGAAGGAGCGAGGCCGCA | 5529 & 5530 |
| FUT7 | GGCATGAATGAGAGCCGA | GTGGGTAGCGGTCACAGA | 5531 & 5532 |
| FUT8 | ATGCTCACCAACCCCGAA | GATTTCCAGCCACACCAA | 5533 & 5534 |
| FUT9 | CACCCTTCCAGAAATGGA | AGCCATAAGGCACTTGGA | 5535 & 5536 |
| FXN | GACCTTGCAGACAAGCCA | TCTGCGGCCAGCAGCTCA | 5537 & 5538 |
| FXR1 | TGATCGAGACAGCCGACA | ACGACCTCGACCCCCTGA | 5539 & 5540 |
| FXYD1 | CAGTCCCTGCAGATCGGA | TGCTCAGCACGATGAGGA | 5541 & 5542 |
| FXYD2 | GCAATAAGAAGCGCAGGCA | GGGAGGCGCCAGAGGCA | 5543 & 5544 |
| FXYD5 | CCCCAGACCCTCAAGCCA | ATTCCGGCATAACCGGGA | 5545 & 5546 |
| FYB | TGGGGCCAAAGTCAGGAA | GGAGGTGGACCCAAGGTA | 5547 & 5548 |
| FYN | GAGACTGGGAAATGGGCA | CCACTGCATAGAGCTGGA | 5549 & 5550 |
| FZD1 | GGGACCAGTGGGAACGCA | TGCCGGACCAGATCCAGA | 5551 & 5552 |
| FZD2 | AGAAGGAGGGCTGCACCA | AGCACACGCCGCTCAGCA | 5553 & 5554 |
| FZD3 | GAAGGAGCCCCAGTGGCA | CAATCACGCACATGCAGA | 5555 & 5556 |
| FZD4 | TCCCCGCAGTGAAAACCA | ACGAACCCGGTGAGGGCA | 5557 & 5558 |
| FZD5 | CCGCAGCGTCATCAAGCA | CGTACAGGTAGCAGGCCA | 5559 & 5560 |
| FZD6 | GCACAGGAGCTACAGCAA | GGCGAGGCAGGTTCACCA | 5561 & 5562 |
| FZD7 | CATGAAGTGGGGCCACGA | AGACGAACAGAGGCGCCA | 5563 & 5564 |
| FZD8 | GCTACGTGGGCAACCAGA | GCTTGATGACCGAGCGGA | 5565 & 5566 |
| FZD9 | CGGGCCACAGAGCAGCCA | GGAGCTCCACACCCAGA | 5567 & 5568 |
| FZR1 | CGCACGGCTACTCACAGA | CTCCAGCACCAGTGACGA | 5569 & 5570 |
| G3BP1 | CGTGAGGCTGGTGAGCAA | TAATGCGCAACTCCACCA | 5571 & 5572 |
| G3BP2 | CAGGGATATTAGGCGCAA | ATGCCACCCCTTGGAGGA | 5573 & 5574 |
| G6PC | ACCCCCATCCCAAGTCGA | GGGGATGACACTGACGGA | 5575 & 5576 |
| G6PC2 | ACCCCGACTGGATCCACA | AGGCACAGAGCAACCGGA | 5577 & 5578 |
| G6PD | CCATCTGGAACCGGGACA | CTCCATGGCCACCAGACA | 5579 & 5580 |
| GAA | CTGGAAGTGCTGGAGCGA | CAGGGACACCGTTGGAGA | 5581 & 5582 |
| GAB1 | GCCCTATGATCAAGCCCA | ACACTGCTGCCTGAGCCA | 5583 & 5584 |
| GAB2 | CCATCTCCACCCAGAGCA | GCTGGAAGTCCAGGGCCA | 5585 & 5586 |
| GABARAPL1 | CGGACAGGGTCCCCGTGA | GCCAACAGTAAGGTCAGA | 5587 & 5588 |
| GABARAPL2 | CCGACAGGGTTCCGGTGA | TCCACATGAACTGAGCCA | 5589 & 5590 |
| GABBR1 | GAATAGCCGCAGGGACA | CAGCCTCAGCCACCA | 5591 & 5592 |
| GABBR2 | CCGCACTCAACGACAGCA | CGGCACGAATACCAGGCA | 5593 & 5594 |
| GABRA1 | CCTGCGGATCACAGAGGA | AGTGGGCAAGCATGGGCA | 5595 & 5596 |
| GABRA2 | GCCAATCAATCGGAAAGGAGA | CAGTTCTTGCAGGCACAGA | 5597 & 5598 |
| GABRA3 | CAGCCCGACTGAGACCAA | GTGGCCCAATAGACCAGA | 5599 & 5600 |
| GABRA4 | CCATGACCACACTAAGCA | TGCACTGGAGCAGCGGGA | 5601 & 5602 |
| GABRA5 | CCAAAGTGGCCTACGCCA | ACTCTATCAGCGCCGAGA | 5603 & 5604 |
| GABRA6 | AGGAGTCCGTCCCAGCAA | TGACAGCTGCGAACTCGA | 5605 & 5606 |
| GABRB1 | ACCGCAAGCCCCTGAGCA | GGGAGGCACGCCTGCGGA | 5607 & 5608 |
| GABRB2 | CGATGGACCCCCATGAGA | AGTCCCATCACAGCCTCA | 5609 & 5610 |

FIG. 1 Cont.

| | | | |
|---|---|---|---|
| GABRB3 | TCGGGAGACCTTGCCCAA | ACTCCAGAAGGGCCAGGA | 5611 & 5612 |
| GABRD | TGGACGTGAGGAACGCCA | TGTCTCCACCCCCACCGA | 5613 & 5614 |
| GABRE | CCCGGACCTCTCTAGGGA | ACTCCAACAGAGCGCAGA | 5615 & 5616 |
| GABRG1 | CTTGGAGGGAAGGAAGGA | AACCAAGTTGAACAGGGCA | 5617 & 5618 |
| GABRG2 | GTGTCTGGACGGCAAGGA | GGCAGAAGGCAGTGGGGA | 5619 & 5620 |
| GABRG3 | ACGCCAGCAAGAACAGCA | CGTAGGACACGCGTGGCA | 5621 & 5622 |
| GABRP | ACAGCGCTGGATGGACCA | GCATACAGGACCGTGCCA | 5623 & 5624 |
| GABRQ | TCGGAAAGCCTCAGCCCA | TCTGAGGTGGAGGGGAGA | 5625 & 5626 |
| GABRR1 | TCACAACGGTGCTGACCA | AGGTAGTTGACGGCCGCA | 5627 & 5628 |
| GABRR2 | TGGGTACCCCAGAAGCCA | CTTCACCACTCAGGCCCA | 5629 & 5630 |
| GABRR3 | TCACCACAGTGCTGACCA | AGAGGGAGCTGACCCACA | 5631 & 5632 |
| GAD1 | GCTCTCTGACCACCCCGA | TGACCTGTGCGAACCCCA | 5633 & 5634 |
| GAD2 | GTGCCACAGCTGGAACCA | GGAGAGCAGAGCACTGCA | 5635 & 5636 |
| GADD45A | GGTGTACGAAGCGGCCAA | ACGCCTGGATCAGGGTGA | 5637 & 5638 |
| GADD45B | TGAATGTGGACCCAGACA | GCATGCCCGACACCCGCA | 5639 & 5640 |
| GADD45G | GCGAGAACGACATCGACA | CAAGGCGGGATCCTTCCA | 5641 & 5642 |
| GAGE1 | AGCAACTCAACGTCAGGA | CGGCCCTTGACCTGCAGA | 5643 & 5644 |
| GAL | CCTCACCAGCAAGCGGGA | AGGAGGCGGTCGAGGGCA | 5645 & 5646 |
| GAL3ST1 | CCATCCAGGACGAGGCCA | GGATCTCGGGCGTGAGCA | 5647 & 5648 |
| GAL3ST2 | CCACACGCAGATCAGAGA | GCCGGAGGTTGTAACCCA | 5649 & 5650 |
| GAL3ST3 | CCAGCCGCAAGGTGGACA | AGTACTGGACCTCGGGCA | 5651 & 5652 |
| GAL3ST4 | ATAAGCAGGGCCTCAGCA | GTGGACATAGAGAGCCCA | 5653 & 5654 |
| GALC | TGAGCCCTCCCACATGCA | CGCCCACAATCCAGGTCA | 5655 & 5656 |
| GALE | TGGCACAGGTGTCCGGGA | GTAGATCCGGCAGCCACA | 5657 & 5658 |
| GALK1 | CTGCCCAGAGCTGGACCA | AGTGTCACCGTGCAGCCA | 5659 & 5660 |
| GALK2 | TACAGCGAGGCTGCGCGA | CTGATCCAGCTCGGGGCA | 5661 & 5662 |
| GALM | GGAGGGTGGCCAACCGAA | GGACGCCATTTGACAGCA | 5663 & 5664 |
| GALNS | GCACGTCACTGCAGGCCA | GGGAGGAGGTTGAGGCCA | 5665 & 5666 |
| GALNT1 | ATCGCTCACCAAGACACA | TGGCCAAGAGAGGCTCCA | 5667 & 5668 |
| GALNT10 | CTTAAGCGGGTGGCCGAA | AGTTAAGGGAGCTGCGGA | 5669 & 5670 |
| GALNT12 | GGGATGTGACAGAGAGGA | AGCATCCCGAAGAAGCCA | 5671 & 5672 |
| GALNT13 | AGGAGGAAAGGAGACAGA | ATGACCAACATGGGAGCA | 5673 & 5674 |
| GALNT14 | CTGACATCGCCCAGGGCA | CCTCTGAGCTCCGAGGCA | 5675 & 5676 |
| GALNT2 | AAAGGGTGGCGGAGGACA | CCGCCCTTCAAGTCAGCA | 5677 & 5678 |
| GALNT3 | TGGACTTGGGGGAAACCA | GCCTTCAGCTGAACGAGA | 5679 & 5680 |
| GALNT5 | GGCAACCTCACCCAGCAA | GGAGCCCTTAAGTCAGGA | 5681 & 5682 |
| GALNT6 | CGACTGCAGCTGAGGGAA | CTCACCCACATCCAGGCA | 5683 & 5684 |
| GALNT8 | TTCCAGGCAACACCCCCA | GCCAGGGTCTGTCAGGCA | 5685 & 5686 |
| GALNTL5 | AGGGGCTGATTCGAGCAA | TGGCAATGGCATGCAGCA | 5687 & 5688 |
| GALNTL6 | GGAGCCTTCGACTGGGAA | CCTCCAGCCATAACAGGA | 5689 & 5690 |
| GALP | ACAGCCCTCCAAGAGGAA | ATGCTGAGCATGCCCAGA | 5691 & 5692 |
| GALR1 | CCACCAGGGCCTCTTCCA | GCAGGTAGCCGAAGACGA | 5693 & 5694 |
| GAMT | CTGTACGACACGTACCCA | CCAGGAGGTGAGGTTGCA | 5695 & 5696 |
| GANAB | TCTGCCTGGCCAAGGGGA | CTCGCATCCATCGAGGCA | 5697 & 5698 |
| GAP43 | GCTGCCACAGAGCAGGCA | AGCCTTGGAGGACGGCGA | 5699 & 5700 |
| GAPDHS | AAGACAGTGGACGGGCCA | ATGGCTGAGTAGGGGGCA | 5701 & 5702 |
| GAPVD1 | CCCAGACTCTGCAAGCCA | GTCAGCACTGGGAAGGCA | 5703 & 5704 |
| GARS | CTGAGGGACCGTGACTCAA | GAGGATACCTGGCCTCCA | 5705 & 5706 |
| GART | AGACCTGGAGGATCCCCA | ACCACAAGGACAGCGCCA | 5707 & 5708 |
| GAS1 | GCACCGTCATTGAGGACA | CCTTGACCGACTCGCAGA | 5709 & 5710 |
| GAS6 | TCGGCCGTGTCACCAGCA | CAGCTCCTCATGCAGCCA | 5711 & 5712 |
| GAS7 | AAGAGCCTGGCGGACGAA | AGGCATAGCGGCTGGCGA | 5713 & 5714 |
| GAST | CTGGAGCAGCAGGGCCCA | GCCACGAGGTGTGGGGGA | 5715 & 5716 |
| GATA1 | CTGGGAGGCACAGGAGCA | CCAGTAGGGGTCCAGGGA | 5717 & 5718 |
| GATA2 | GGCGGAGTGCTTCGAGGA | TGGGCGTCGGAGTGGGCA | 5719 & 5720 |
| GATA3 | CACTGGAGGACTTCCCCA | AGTGGCTGAAGGGCGAGA | 5721 & 5722 |
| GATA6 | AGAGCACCAATCCCGAGA | GGAATCCGGTCGCACGGA | 5723 & 5724 |
| GATAD2B | CTCACAGGCTGCAGCCAA | TGTGCGGCACTGGGCACA | 5725 & 5726 |
| GBA | GCCTGTTCCCCAACACCA | TCCAGTCGGTCCAGCCGA | 5727 & 5728 |
| GBF1 | GCTATCCCGAGTCAGCCA | AGCCGATGCACTCCAGCA | 5729 & 5730 |
| GBGT1 | GGAGACCATCAGCCAGCA | GCCTGCGCTCATAGGGGA | 5731 & 5732 |
| GBP1 | CCAAGAAGCCAGGCCACA | GGAGGACGGCCAGGGCGA | 5733 & 5734 |
| GBP2 | GGGAACCATCAACCAGCA | CGGATGCACAACCGAGGA | 5735 & 5736 |
| GBP4 | CCCCACCTCTCTAAGCCA | TGCTTAGAAGCACAGCCA | 5737 & 5738 |
| GBP5 | TGAGAGGGAGGCCATTGAA | AAGCCGAGCAATAATCCGA | 5739 & 5740 |
| GBP6 | CCCATCCAAGCCAAACCA | AGGTGCTGCACAGGAGCA | 5741 & 5742 |
| GC | GAGCTGCCTGAACACACA | CATCTGGAAGCTCGGGGA | 5743 & 5744 |
| GCA | GGCCAGCATATTCAGACA | CACCATCCTGTCCAGCAA | 5745 & 5746 |
| GCDH | ACAGCGGAAGTGACCCCA | ATCTTCACACCGAGCCCA | 5747 & 5748 |
| GCG | TGGTGAAAGGCCGAGGAA | CAGCATGTCTGCGGCCAA | 5749 & 5750 |
| GCGR | GCGGAACACCAGCAACCA | GCCAATCTAGGGAGGCCA | 5751 & 5752 |
| GCH1 | TCAGCAAACTTGCGAGGA | ACCACTACCCCGACTCCA | 5753 & 5754 |
| GCK | TCAACCGCATGCGCGAGA | AGCTTGTACACGGAGCCA | 5755 & 5756 |
| GCKR | ACCTCACGGAGGTGCAGA | TCAGCAAGGTCTGACCCA | 5757 & 5758 |
| GCLC | GAGCGAGGACTGGAGCCA | GAGCAACATGCTGGGCCA | 5759 & 5760 |
| GCLM | GGGCACAGGTAAAACCAA | GCAGTAGCCACAGCGGCA | 5761 & 5762 |
| GCM1 | CCAGTCAAAGGGAGAGCA | CAGGCTCAATGAGACGGA | 5763 & 5764 |
| GCNT1 | GGGCCACCATCCAAAGGA | ATGCACACTGAGCGCACA | 5765 & 5766 |
| GCNT2 | ACCACGCTGTTGGACGGA | TGGAGGACGAAGTTAGCA | 5767 & 5768 |
| GCOM1 | CGACAGCTCACCCAGGAA | CAGGCCAATGGAATCTGA | 5769 & 5770 |
| GDA | AGGAGCATCCATCGCACA | CAGCCACGTCTGTACCCA | 5771 & 5772 |
| GDE1 | CAGGCGTGGAGTTGGACA | CACAATCGCCCAGTCCCA | 5773 & 5774 |

FIG. 1 Cont.

| | | | |
|---|---|---|---|
| GDF1 | CGCCGCTTGGGCTCGCAA | GCGGGTCGAGGGTCACCA | 5775 & 5776 |
| GDF10 | CAGGAAGAAGGGCCAGGA | GGTTGGATGGACGAACGA | 5777 & 5778 |
| GDF11 | CCCACCAAGATGTCCCCA | AGCCACAGCGATCCACCA | 5779 & 5780 |
| GDF15 | CCGTCGCAGTCGGACCAA | GCCCAGGTCTTCCAGCGA | 5781 & 5782 |
| GDF2 | CAAGGACGGCTCCACAGA | CATCGTCAGCCAAGGGGA | 5783 & 5784 |
| GDF3 | AGCCATCCCTGTCCCCAA | GGTCAGTGAGAAGGGACA | 5785 & 5786 |
| GDF5 | GGCTGAGTCCCATCAGCA | AGCCACACGACTCCACGA | 5787 & 5788 |
| GDF6 | TCGCCATGGCAAGCGGCA | GTCGCATACACCCTCGCA | 5789 & 5790 |
| GDF7 | AGCCCACCAACCATGCCA | GCGCGCTGGCACACAGCA | 5791 & 5792 |
| GDF9 | GTCAGCTGAAGTGGGACA | ACTGGAGAGCCATACCGA | 5793 & 5794 |
| GDNF | GAGAGGCCAGAGGGGCAA | ATCGCAAGAGCCGCTGCA | 5795 & 5796 |
| GEM | GCGAGCTTCGAGAAGGCA | GTGCTGGACAGCTGCAGA | 5797 & 5798 |
| GEMIN4 | CCGTGAAACCCCAAGGGA | GGTCCAAGAGCTGGCACA | 5799 & 5800 |
| GEN1 | CCAAAGGGAGTCCCTGGA | AGGTGAACCTGGATGGGA | 5801 & 5802 |
| Gene | FwdPrimer | RevPrimer | 5803 & 5804 |
| GFI1 | TGAGCCTGGAGCAGCACA | TGACAGGGGTAGGGCCGA | 5805 & 5806 |
| GFOD2 | CACGGGCTGCTCAAGACA | CTGCAGAGCCTACCACCA | 5807 & 5808 |
| GFPT1 | CCGGTGGAAGAAAAAGCA | ACAGCTCGTCCGGGGTGA | 5809 & 5810 |
| GFPT2 | CCTGGAGCTCTACACGCA | GCTTCAGCTCCCCAGCCA | 5811 & 5812 |
| GFRA1 | GCACAGTCATGACCCCCA | ACGGTCACATCGGAGCCA | 5813 & 5814 |
| GFRA2 | CACGTCTGTCCAGGAGCA | GACAGCACGGTCAAGGCA | 5815 & 5816 |
| GFRA4 | AGGTGTCCTCCACAGGCA | GCCGGGAGAGCCAGGACA | 5817 & 5818 |
| GGA1 | CCACCAGCCTTCTCCACA | GGAACACGATGTTGCGGA | 5819 & 5820 |
| GGA2 | CACTTCTCCCAGACGGGA | TCCCAGACAGGCTGGGGA | 5821 & 5822 |
| GGCX | TGAGTGAAGACCTGGGCA | GGTACTCACCAGCAGGCA | 5823 & 5824 |
| GGH | TGACCTCAGACGCTCAGA | CAGTGAAGTTCAGCGGCA | 5825 & 5826 |
| GGT1 | CTGCCCAACGTCACGACA | TGGCTTGCACCACAGCGA | 5827 & 5828 |
| GGT5 | GCCAGAACCAGACCCAGA | TCCGAGACGGCGTACACA | 5829 & 5830 |
| GH1 | GGGAGGAAACACAACAGA | ACACCAGGCTGTTGGCGA | 5831 & 5832 |
| GH2 | ACTGCTTCAGGAAGGACA | GCCCTCCACAGAGCGGCA | 5833 & 5834 |
| GHDC | GCTGCTCCCAGTCAAGGA | CACCAACCACTCGCACCA | 5835 & 5836 |
| GHITM | AGAGCTGCATGGTACACA | AGACGAGACCCAGGCCCA | 5837 & 5838 |
| GHR | GAGGCCTGGGACAGGAGA | TCAGGCAAGGGCAAGGCA | 5839 & 5840 |
| GHRH | GTCGTCAGGTAGACAGCA | GCTTCTGCAGCAGGGCCA | 5841 & 5842 |
| GHRHR | TGGAGCCAGCTCAGGGCA | AGCCCTGGAAGGAACCCA | 5843 & 5844 |
| GHRL | AGCCCTGAACACCAGAGA | CTAGAGCTCGGGGCTGCA | 5845 & 5846 |
| GHSR | CCCTTGGGACACCAACGA | TGGTCCCTGAGCGAGGCA | 5847 & 5848 |
| GIF | CAAGACCCTGCTGGCCAA | AGAGAGCCTGCATGGCGA | 5849 & 5850 |
| GIGYF2 | GCACCTGCAGTACCAGCA | GCCAGTATCTGGCACGGA | 5851 & 5852 |
| GIMAP4 | CGACACAGAGGTGCCCAA | CCTCAGTGTAACGGCCCA | 5853 & 5854 |
| GIMAP5 | GGGCTCCTTCCACAGCAA | TGGCAGGCCCCAGCTCCA | 5855 & 5856 |
| GIMAP6 | CACGGATGAGGATCAGCA | TCTTCCAGGGAGCCGCCA | 5857 & 5858 |
| GINS1 | GTCAGGTGGACGAAGTGA | ATCCGAAGCAAGCGGTCA | 5859 & 5860 |
| GINS2 | ATTCCTCGCCGAGAAGGA | CCATCCACTCTGGAGGGA | 5861 & 5862 |
| GINS3 | ACTCCCCAAGATCTACCA | TGCAGGAGCTGGGAGCCA | 5863 & 5864 |
| GINS4 | GCATCCACCAAATGGAGA | GGCCAACTCTTCCGGCGA | 5865 & 5866 |
| GIP | AGCCAAGAACCCCAGCGA | GATCCAGCAAGCAGGCCA | 5867 & 5868 |
| GIPR | GGAACGGTACCGCAGGGA | CACACTGGCGGAGGACGA | 5869 & 5870 |
| GJA1 | ACCCTTACCATGCGACCA | AGGAGGAGACATAGGCGA | 5871 & 5872 |
| GJA5 | GGTGGCAGAGAAGGCAGA | ACAGGGACTCCTGCGGCA | 5873 & 5874 |
| GJB3 | CCAGAAACACGGGGACCA | CGCGGCATATTGAAGCCA | 5875 & 5876 |
| GJD4 | ACCAGGACGAGCAGGAGA | GACGCTGAAGACGGCGGA | 5877 & 5878 |
| GK5 | ATCCGGGCAGATGGAGGA | AACCCAACAGCAAGGCCA | 5879 & 5880 |
| GKN1 | CACCTCCCAAGGGCCTGA | TTGGAATCCCACGACACA | 5881 & 5882 |
| GKN2 | CAAGCAACAATGGTGGCA | TCGGGAGAGCACCCTGGA | 5883 & 5884 |
| GLA | CCGACACATCAGCCCTCA | AGAGAGGTCGTTCCCACA | 5885 & 5886 |
| GLB1 | CAGACTTGCCCCAGGACA | CACGAACGTCACAGCACA | 5887 & 5888 |
| GLB1L | GCCTGTTGAAGCCACCAA | CCAGAAGGAGCTTGAGGA | 5889 & 5890 |
| GLB1L2 | CGGCGATTACACGGCCAA | ACTTGAGGGCGTCCCACA | 5891 & 5892 |
| GLCE | AGAAAGGTGGCTGGCCAA | CCCTTGGGCCATGGCAGA | 5893 & 5894 |
| GLDC | CCACTGAGTCGGAGGACA | GGTCAGGGAGTGTGGAGA | 5895 & 5896 |
| GLG1 | GCAGGAAGCCAAGGAGCA | GATCTGGCTCCAAGCGGA | 5897 & 5898 |
| GLI1 | GGGTCTGACTCCACAGGA | TAGGGGCCTGACTGGAGA | 5899 & 5900 |
| GLI2 | CTCACCAGGGGTCAACCA | CTCAGAGCACCCGAGAACA | 5901 & 5902 |
| GLI3 | CGAGGGCAGCAAAACCGA | TCTGCGGGTGGACGACCA | 5903 & 5904 |
| GLIPR1 | AATACACGGCTGAAGCCA | GGGCACAGACCCAGTCCA | 5905 & 5906 |
| GLIPR2 | CTGGACACTTCACGGCCA | GGACCCGTCACTTGCGGA | 5907 & 5908 |
| GLIS3 | CCATGCGCACCTTCACCA | GTCGATCCAGCGGCAGCA | 5909 & 5910 |
| GLMN | GGGCACACAGACCAGCTA | AGGCATCGAACAACAGGA | 5911 & 5912 |
| GLO1 | CATGCTACGAGTGAAGGA | TGGAGAGCGCCCAGGCTA | 5913 & 5914 |
| GLOD4 | CAACGCCAGGAAGCTGGA | CAGGATCTGACTGAGGCA | 5915 & 5916 |
| GLP1R | TACACGGTGGGCTACGCA | CAGGCGGCAGCTCAGAGA | 5917 & 5918 |
| GLRA1 | TCCCCAGAGGAGATGCGA | TGAGGAAGGCCATGGGGA | 5919 & 5920 |
| GLRA2 | CACTCCCACAACCGCCAA | TGAGGAAGGCCAATGGGA | 5921 & 5922 |
| GLRA3 | GCACCCGTACAAGTGGCA | GCTCCAGATGGAATCGCA | 5923 & 5924 |
| GLRA4 | TCACCATGACCACCCAGA | TGGCAGCATACTCCAGCA | 5925 & 5926 |
| GLRB | CACAACCCTTGCCGCTGA | CAACTGCATACTCCACCA | 5927 & 5928 |
| GLRX5 | GACGCCGGAGCAGCCCCA | AATCGCGGACGCCGTGCA | 5929 & 5930 |
| GLS | AAAGAGCTGGTGGCCTCA | GGGATCAGACGTTCGCAA | 5931 & 5932 |
| GLS2 | ACGGTGGGATCTGCCCCA | ACTTGGCTGGCAGGCCCA | 5933 & 5934 |
| GLT25D1 | GCGGATGCAGGTGGAGCA | CGAACATGACGGGCAGGA | 5935 & 5936 |
| GLT6D1 | CAGTCACATCCAGGACGA | CCAGGGTCTCCACCCCGA | 5937 & 5938 |

FIG. 1 Cont.

| | | | |
|---|---|---|---|
| GLTPD2 | GCAGTGCAGCGACGCCTA | TGGCTCCGGGACACGCCA | 5939 & 5940 |
| GLTSCR1 | TCCACACCTGCCCACCAA | GGAGGAGGAGGAAGAGGA | 5941 & 5942 |
| GLUD1 | CGGCAGAGTTCCAAGACA | GCCTGGCAGAACGCTCCA | 5943 & 5944 |
| GLUL | GCATACGCATTCCCCGGA | AAGGGGTCGCAGTTGGCA | 5945 & 5946 |
| GLYAT | GTGGCAAACCCAAGGCCA | CCCTCAGGCCCCAGGAGA | 5947 & 5948 |
| GM2A | AGAGCCCCTGCGTACCTA | TGGTGAGCCAACTGGGCA | 5949 & 5950 |
| GMCL1 | TGCGGGCAGAACAGGACA | CAAGTAGGTCGAAGCCGA | 5951 & 5952 |
| GMFB | ATGAGGAGCTTGAGGGCA | ACATCCAACAGGACTGGA | 5953 & 5954 |
| GMFG | GCAAGCCGGAACAACAGA | CAGGCCTCAGTGAGGTCA | 5955 & 5956 |
| GMIP | CAGTACCCTGGAGCAGCA | CGCACAGCTTGGAAGCCA | 5957 & 5958 |
| GMPPA | CTGGCCAAGCACACCCCA | CCCACGATGCTATGCAGA | 5959 & 5960 |
| GMPPB | GTCACTGAGGCAGAAGCA | CCAGCCCACAATGCAGGA | 5961 & 5962 |
| GMPR | TGAGAGGAACGGACGGAA | TGGACCTCAGTCCCCCGA | 5963 & 5964 |
| GMPR2 | GCCTCAGAGGGAAAGACA | AGGTACACGTAGAGCGGA | 5965 & 5966 |
| GMPS | CACCGTGCAGAACAGAGA | GAGGGCCTCTTCAACAGA | 5967 & 5968 |
| GNA13 | CCATGGCAGCCCAAGGAA | CGACGCCGGTCATAGGCA | 5969 & 5970 |
| GNA14 | TTACGACAGGAGGAGGGA | CCAACATCCACCATCCGA | 5971 & 5972 |
| GNA15 | CCGACGCCTCTTCAGCCA | CGAGCACCGAGTCCCGCA | 5973 & 5974 |
| GNAI1 | CTGAGCGGAAGAAGTGGA | AGCTAGAACCAGGTCGTA | 5975 & 5976 |
| GNAI2 | GCGTAAAGACCACGGGGA | CGCTCAGACCGCTGACCA | 5977 & 5978 |
| GNAI3 | GGAAGCTGCCAGGGCAGA | AAGCAAGCTTGTACCCCA | 5979 & 5980 |
| GNAO1 | CGCCTACATCCAAGCACA | CGTCGAACACCACCTGGA | 5981 & 5982 |
| GNAQ | TGATGGACCCCAGAGAGA | GGCGCACGTGAAGTGGGA | 5983 & 5984 |
| GNAS | GACTATGTGCCGAGCGA | GGCCACCCACGTCAA | 5985 & 5986 |
| GNAT1 | AGAAGGCGCACCTCAGCA | TGAGCTCGAGGAACTGCA | 5987 & 5988 |
| GNB2 | CACCACCGGCTCTGACGA | AGTCGTCGTAGCCAGCGA | 5989 & 5990 |
| GNB2L1 | CAAGGCAGAACCACCCCA | CAATGGTCACCTGCCACA | 5991 & 5992 |
| GNB4 | GCCCAGCAGACCACCACA | GTGGCATCATCAGAGCCA | 5993 & 5994 |
| GNB5 | GGACGTGGAGAGCGGGCA | GCACTGGCCGGAGCGCA | 5995 & 5996 |
| GNE | GTGGAAGCCATGGGTGCA | TGAGATGGAGCGCACCCA | 5997 & 5998 |
| GNG12 | ATAGCCCAGGCAAGGAGA | GGACATGAGGTCCGCTGA | 5999 & 6000 |
| GNG2 | GTCCAAGGCAGCTGCAGA | AAGCCGGAACAGGGGTCA | 6001 & 6002 |
| GNG7 | AAGCCGGGATTGAGCGCA | AGGCAGGGACTCCGACCA | 6003 & 6004 |
| GNGT1 | GGACCTGACAGAAAAGGA | CAGTGGATCCTCGCCAGA | 6005 & 6006 |
| GNGT2 | CAAAGGCATCCCTGAGGACA | CCCTGGGGGTCTAGGAGA | 6007 & 6008 |
| GNL3 | CCAGGCTGATGCTCGACA | GTCCAAGATGTAGGGGGA | 6009 & 6010 |
| GNLY | CGGAGAAACTGCCCAGCA | AGCGAGGAGCCGGCAGA | 6011 & 6012 |
| GNMT | GCGAGCATGGTGCGGGCA | GGTAGTAGGAGAGCCGGA | 6013 & 6014 |
| GNPAT | CTGCTTCAGAACCGGCCA | GCATAAGCCCATCGACCA | 6015 & 6016 |
| GNPDA1 | AGGAGGGAGTGAACCACA | TGTACAAGGGGTCCACCA | 6017 & 6018 |
| GNPTG | CGAGTGGGAGATCGCCAA | GCTCGGACACATGGGCCA | 6019 & 6020 |
| GNRH1 | GGAAAGAGAGATGCCGAA | CAGGTCTCGGAGGGGAGA | 6021 & 6022 |
| GNRH2 | CCTCAGCTCAGCCCAGGA | GCATCACTTGGGAGGCCA | 6023 & 6024 |
| GNRHR | GCAACCTCCCCACTCTGA | ACATCCCATCCAGTGGCA | 6025 & 6026 |
| GNS | CTGCAGACCCAGACCAGA | AACCCCTGGAGTGCGACA | 6027 & 6028 |
| GOLGA4 | CAGCGAGGAGCAGCAGCA | CCACGGAGGGCACCCGGA | 6029 & 6030 |
| GOLGA5 | AGCGCCTCGAACAGCAGA | GGAACATTTCGCAGACGA | 6031 & 6032 |
| GOLGA6L6 | GGAAGCCCTAAGGAGGGA | CTGTGTAGCGACAGCAGA | 6033 & 6034 |
| GOLGA7 | AGACTACAGCAGTGGCACA | AGGGTCTGTCAGGAGGA | 6035 & 6036 |
| GOLGA7B | CCTCTGCATGGAGACCCA | GTAAGTAGGAGGCCTCGA | 6037 & 6038 |
| GOLGA8B | AAGGAGCCAGAGGCAGCA | CCACAAGCCGCAACACCA | 6039 & 6040 |
| GOLM1 | AGGAGCCTCAGAGGGACA | CCCCCGAAGCCTCTTCCA | 6041 & 6042 |
| GOPC | CAGGAAGGGTCCAACAGA | CTGCAGGCTCGGATCACA | 6043 & 6044 |
| GORAB | CGACAACAACTTCAGCGA | CACCAACGGGGGAGGTGA | 6045 & 6046 |
| GOSR2 | ACGACTCTGACACCACCA | AAGCCCAGCATGTTGGCA | 6047 & 6048 |
| GOT1 | TGACCCAACTCCGGAGCA | TAGCGAATGGCCCAGGCA | 6049 & 6050 |
| GOT2 | CCGGAACAGTGGAAGGAA | GCTCCTACACGCTCACCA | 6051 & 6052 |
| GP2 | CACTCGGAGAGGTGCACA | AGCCAAGCCAGGAGGACA | 6053 & 6054 |
| GP6 | CATGACCGCTGAACCCCA | CAGACAGACACTGGCCGA | 6055 & 6056 |
| GP9 | CAGGCTACCAGCTGGGCA | GTGGCACACAGCAGGCCA | 6057 & 6058 |
| GPAM | ATCCAAGGAGCACCAGCA | GGTTCTGGAACAGGACCA | 6059 & 6060 |
| GPC1 | CTTCAGGCACGCTGGAGA | GGCCATCCCGTTCCAGCA | 6061 & 6062 |
| GPC2 | GTCTGAAGGCTGCAGCCA | GCCAGGATCAGGAGACCA | 6063 & 6064 |
| GPC3 | CTCCGAAGGACAACGAGA | CCAGGAAGAAGAAGCACA | 6065 & 6066 |
| GPC4 | CAACCACAGCAGCTGGCA | GCTCGGAAGGGAGGACCA | 6067 & 6068 |
| GPC5 | AGGCACTCAATCTGGGCA | AAGGCTTAGTGAGCGCCA | 6069 & 6070 |
| GPC6 | CACGTCCAACGAGGAGGA | GGCCGAGTGATGTCCACA | 6071 & 6072 |
| GPCPD1 | GGATGCCTGAACAACCAA | AAGCGGCTAACAGTGGGA | 6073 & 6074 |
| GPD1 | GTGCAAGAGGTGGACACA | CTCCAAGAAGGTGGCAGA | 6075 & 6076 |
| GPD1L | GCTGTGGAGACAACACCA | CCCCGCAGCTCTCTAGGA | 6077 & 6078 |
| GPD2 | CACAGCATCTTGCCGCCA | CAGGCGAGTACGACGTGA | 6079 & 6080 |
| GPER | ACGAGCGGTACTACGACA | CAGCGTGGCTGACACGGA | 6081 & 6082 |
| GPHA2 | GGGCTCCCACGTGGCACA | TGGTGCAGCACTGAGAGA | 6083 & 6084 |
| GPHN | TGCTGATGGCCCAGGAGA | CTGGCCGAGCTTGCACCA | 6085 & 6086 |
| GPI | GGTGTGAGACACACGCCA | CTGGACCGGGATGAGGAA | 6087 & 6088 |
| GPIHBP1 | CCAAGACGGTGGAGGGGA | CCAGGGTGGGACATTGCA | 6089 & 6090 |
| GPKOW | CGGACAGATGAAGGCCGA | CCCAGCACCACCATCACA | 6091 & 6092 |
| GPLD1 | GCCACTCGCATGTACGCA | CTCAAGTGCAGAACGCCA | 6093 & 6094 |
| GPNMB | AGGGAGCATTCCCACGGA | CCCAGGGTGAGGTTCACA | 6095 & 6096 |
| GPR1 | AGCTCACCATTCACCACA | CAGCAACTGAGGACCGGA | 6097 & 6098 |
| GPR107 | CCACCGAGGAGGGCACGA | GAACAGCGAGTTTGAGGA | 6099 & 6100 |
| GPR108 | CATCAACAGCCAGGGCCA | CCTGCATGGGGATCACGA | 6101 & 6102 |

FIG. 1 Cont.

| | | | |
|---|---|---|---|
| GPR110 | GACATCGTGACGTGCCAA | AGCCTCGATGATCAGGCA | 6103 & 6104 |
| GPR112 | CCTGAGGCATCCTCCAGA | GGCAGAGGCATGGCACCA | 6105 & 6106 |
| GPR123 | AGGGCCACTTCCTGGACA | GCAGCATGCCCACCAGCA | 6107 & 6108 |
| GPR124 | CTCTGGCACAGAACCCCA | GGAAGTGCGTGGTCACCA | 6109 & 6110 |
| GPR125 | CGTGGCAACAGCTCGACA | CGCTGAAGACACTGCACA | 6111 & 6112 |
| GPR126 | GGATGGGGCTAGAAGCAA | ACACCACTAAGGCAGGCA | 6113 & 6114 |
| GPR132 | CCGGGTACTACTACGCCA | GGGCAGCGCTTAAGCCCA | 6115 & 6116 |
| GPR133 | GCTGCACTCACCTCACCA | CCAGCACGGCGAAGGACA | 6117 & 6118 |
| GPR158 | ACCTGAACCCAGGCACCA | TCTGAAGGCACAGGACCA | 6119 & 6120 |
| GPR162 | TCCGGGAGGAGATCACCA | CTCAGGGGACCCAAGGGA | 6121 & 6122 |
| GPR171 | GCTGCAAGATCTACCGAA | GAAGGACCATTAGCCACA | 6123 & 6124 |
| GPR174 | ACTCCTCAGAACCAGTGA | TAACAACGGACTGGGCCA | 6125 & 6126 |
| GPR18 | TGACCCTGACCACGACCA | ATGACCAAGTAGCACCCA | 6127 & 6128 |
| GPR182 | TGGAGGGCCCTGAGCCCA | CGGCAGGCTGTCAGCACA | 6129 & 6130 |
| GPR183 | CACCGCTTTGCCTACACGA | AGAGGGTGCACCACAGCA | 6131 & 6132 |
| GPR19 | CGAACGGTGAGGAGGACA | AAGGCAGCCAGGAGAGCA | 6133 & 6134 |
| GPR25 | GCTGCGCCAACCCGCTCA | CCGGCAACGGAACACGGA | 6135 & 6136 |
| GPR3 | CGCAAGGGCATTGCCACA | TGTAGGTGGCAGGGAGCA | 6137 & 6138 |
| GPR32 | CATAGGCACCTGCGCCCA | GTCGCCACAGATGGACCA | 6139 & 6140 |
| GPR56 | GGTGTGAGACCGTCAGGA | TGGTGACAAGGCAGGCCA | 6141 & 6142 |
| GPR65 | GCAACCGGAAAGTCTACCA | ATGCAGCGAATCAGCAACA | 6143 & 6144 |
| GPR83 | CGATGTGACCACAGAGCA | CCTTGCTGGACAGGAGGA | 6145 & 6146 |
| GPR84 | CCAGACCCTGGAAGGGGA | GGGATGTAGCTCAGGGCA | 6147 & 6148 |
| GPR87 | CTGAAGGTGGTCAAGCCA | GAATCACCAGCACGGCCA | 6149 & 6150 |
| GPR97 | GTGATAGGGAGAACCGCA | GAAGATGGCCAACCCCCA | 6151 & 6152 |
| GPR98 | GTAGAGGGAGGAGCCGAA | CGAAGCCCAACAGCCACA | 6153 & 6154 |
| GPRC5A | CACGGGCTGGAAGAGACA | CCCAGCCATTGGCAGCCA | 6155 & 6156 |
| GPRC5B | CTGCGTGACACAAGGCCA | GGTCATCCAGGCCACCCA | 6157 & 6158 |
| GPRC5C | TGCTCCTCACCACAGCCA | GAAGAGGACGAAGGCCCA | 6159 & 6160 |
| GPRIN2 | GGACCATGACCTCAGCCA | CACATCCCGCACAGGGGA | 6161 & 6162 |
| GPS1 | GAGAGCGTGACAGCCAGA | GGAGCTGCTGGAGATGACA | 6163 & 6164 |
| GPS2 | CAGATGCAGCCAGCAGGA | TGGATGAAGGGGAGCCGA | 6165 & 6166 |
| GPSM2 | GGTATCCCCCAACACGGA | TTAGACGAAGCCCTGGCA | 6167 & 6168 |
| GPT | GGACGAGGTGTACCAGGA | GGAGGTGGAGTGGAAGGA | 6169 & 6170 |
| GPX1 | GCCAGCTCCCAGCGACGA | TCGTTGCGACACACCGGA | 6171 & 6172 |
| GPX2 | GAAGGACAAGCTCCCCTA | CGGCGCACAGGGCTCCAA | 6173 & 6174 |
| GPX3 | CAGGAAGAGCTTGCACCA | GGCGGTCAGATGTACCCA | 6175 & 6176 |
| GPX4 | CAGTGAGGCAAGACCGAA | CGAACTGGTTACACGGGA | 6177 & 6178 |
| GPX5 | GGACCCTGTAAAGGTCCA | GCTTCAAGTACGCCAGGA | 6179 & 6180 |
| GPX6 | GGCGAGGAGTACATCCAA | AGCCACTACCTGGACACA | 6181 & 6182 |
| GPX7 | CTACCGAGCCCTGCAGCA | GGGCACCAGTACCGGTGA | 6183 & 6184 |
| GPX8 | GTGGCCAGTGACTGCCAA | CAACACGCTGAAGTGGGA | 6185 & 6186 |
| GRB10 | CAACGCCCCTACAGACCA | CGAGGGAGTTCTCGGAGA | 6187 & 6188 |
| GRB14 | TCAGGCCAGAAAAGCAGA | GAAGAGGCAGTGGGGCTA | 6189 & 6190 |
| GRB2 | TAGCAAACAGCGGCACGA | ACTTGACAGAGAGGGAGA | 6191 & 6192 |
| GRB7 | CATCCTGCCGAGCGAGGA | GCGTGCAGCAATGGCGCA | 6193 & 6194 |
| GREB1L | CGAAACTTCCACCCCCGA | CCAGGAGCCTGATGAGCA | 6195 & 6196 |
| GREM1 | GCTGCAACAGTCGCACCA | GGGCTTGCAGAAGGAGCA | 6197 & 6198 |
| GREM2 | CCGAGCGCAAGTACCTCA | GGGCTTGCAGAAGGCGCA | 6199 & 6200 |
| GRHL2 | CCGACACCCCATCAGCAA | CGCCGTATGCTGCCGAGA | 6201 & 6202 |
| GRHL3 | CCTGAAGGGGCTGAGGAA | GCTCCCCCATGTCCAGCA | 6203 & 6204 |
| GRHPR | CAACATCAGCAGGGGCGA | GTCACATCCAGTCCAGCA | 6205 & 6206 |
| GRIA1 | CCGAGACCCTGACACGAA | AAGGGAGCCACAGCCACA | 6207 & 6208 |
| GRIA2 | TGCGGAAGTCCAAAGGGA | ACTGCGAGGTTAACCGCA | 6209 & 6210 |
| GRIA4 | GGAAGGACCCAGCGACCA | TCGCTCAACCGTCAGGAA | 6211 & 6212 |
| GRID1 | CTGTGACCTCACCAGCCA | CACCACAACTCCAGGGCA | 6213 & 6214 |
| GRID2 | ACGTGCCTGAGCACCGAA | TACCCAGATTGAGCCCCA | 6215 & 6216 |
| GRIK1 | GAAGTGGTGGCGTGGGAA | ACCAGTCCGGCAGCCAGA | 6217 & 6218 |
| GRIK2 | AGCTGCAAGAGGAAGGCA | TTCTGAACCCCCAGGGCA | 6219 & 6220 |
| GRIK3 | TCAAGGATGGGGCCACCA | GCTGCTCATGAAGGCCCA | 6221 & 6222 |
| GRIK5 | CCAGTACACGCTGGGCAA | TGGCCGTGTAGGAGGAGA | 6223 & 6224 |
| GRIN1 | ACGCCACGGTGAAGCAGA | AGGCCTCGAACTCCAGCA | 6225 & 6226 |
| GRIN2A | GCACAGTGAGACCAGCGA | GGCCTGAATAGGTGGGCA | 6227 & 6228 |
| GRIN2B | CCGGACATCACCACCACA | TGGTGACAAGGGCCCGGA | 6229 & 6230 |
| GRIN2D | ATGGCATCGCCCTGCACA | TGTAGAAGACGCCCGCCA | 6231 & 6232 |
| GRIN3A | GCGGACCACCAATGGGAA | GCTGCAGCTCCTGACGGA | 6233 & 6234 |
| GRIN3B | CCGACATGCACGCACACA | AGTCGGCGTCGATGGAGA | 6235 & 6236 |
| GRINA | GCCGTGGGCATCACCACA | GGAAGCAGGTGAAGAGCA | 6237 & 6238 |
| GRK5 | AGCGCTTAGAAGCCGGGA | CGCCCTTCACAGTGGAGA | 6239 & 6240 |
| GRM1 | CTGTACCGGGACACACCA | ATCGCAGAGGAGAGGCCA | 6241 & 6242 |
| GRM2 | CTTCGAACTGCCCCAGGA | GGAAGACACCACCCAGCA | 6243 & 6244 |
| GRM3 | GCCCTGCTGACCAAGACA | GCACCAGGATCAGACCCA | 6245 & 6246 |
| GRM4 | GGTGGACTTCCAGGACCA | ACACGGTGCACGTGACCA | 6247 & 6248 |
| GRM5 | CAAGCCAGACCTGGAGGA | AGAGGGCCGACTCGGACA | 6249 & 6250 |
| GRM8 | AGCCTGCCGTGTAAGCCA | CACCACAGCCCAGGGAGA | 6251 & 6252 |
| GRN | CTGCCGAGACAACCGACA | GCGGAAGCCAGCAGGACA | 6253 & 6254 |
| GRP | GGCCCTGGGCAATCAGCA | CGTTGAGAACCTGGAGCA | 6255 & 6256 |
| GRPEL1 | GAACCCTGTCGGAGCCAA | GGTCTCAGAGTGCGCCCA | 6257 & 6258 |
| GRWD1 | CACACGCTCTGTGGAGGA | GGATGTCCCAGATGCGGA | 6259 & 6260 |
| GRXCR2 | ACTGCCGAGGGTCGGGCA | TGCAGGCAGGGCACCTCA | 6261 & 6262 |
| GSC | GCACCTCCGCGAGGAGA | GACGCCTTCGACGACGA | 6263 & 6264 |
| GSG1 | CCAGAAGACTGGAGACCA | GAAGGTGGTGACAGCCGA | 6265 & 6266 |

FIG. 1 Cont.

| | | | |
|---|---|---|---|
| GSK3B | CGGTACTATAGGGCACCA | ACCAACTGATCCACACCA | 6267 & 6268 |
| GSN | GAGGTACCCCTGTCCAGA | GTGCACCAGCCTTAGGCA | 6269 & 6270 |
| GSPT1 | GATGGAGGAGGAAGAGGA | GGCCCAAGACAAGTACCA | 6271 & 6272 |
| GSR | ACCCCGATGTATCACGCA | CACACCCAAGTCCCTGCA | 6273 & 6274 |
| GSS | TGCAGCAGGAGCTAAGCA | AACCGGCTAGGGGCAGCA | 6275 & 6276 |
| GSTA3 | ACCTCTACGGGAAAGACA | AGAAGTTCCACCAGGCTA | 6277 & 6278 |
| GSTCD | GCAGTCAGCCCAAAGGAA | CCTGACATGATGGCAGCA | 6279 & 6280 |
| GSTK1 | GCAGCCTGCAGATACGGA | AGCAGCTCCATCCGGTCA | 6281 & 6282 |
| GSTM1 | ACCATATGCAGCTGGGCA | TGGGAAGGCGTCCAAGCA | 6283 & 6284 |
| GSTM3 | TCGAAGCCAATGGCTGGA | TGCGAGCGATGTAGCGCA | 6285 & 6286 |
| GSTM4 | GGGAGACAGAAGAGGAGA | AGTCAGGGCTGTAGCAGA | 6287 & 6288 |
| GSTO1 | ACAGTCAGGGTCAGCTGA | CATAGGGGTCATCCGGCA | 6289 & 6290 |
| GSTO2 | GTCCTGGAGACCAGCCAA | CACATCTCAACGCTACCA | 6291 & 6292 |
| GSTP1 | CTATGAGGCGGGCAAGGA | AACGCATCCAGGCAGCCA | 6293 & 6294 |
| GSTT1 | CCTCTTCCAGGAGGCCCA | TGGCCAGCACCCAGGGCA | 6295 & 6296 |
| GSTT2 | AGGTGGAACGCAACAGGA | TCAGCTCCTCCAGGGCCA | 6297 & 6298 |
| GSTZ1 | TAGGAGACGAGGTGACCA | GTAGGGTAGGGGGTGAGA | 6299 & 6300 |
| GTF2A2 | GGGAAACAGTCTTCAGGAGA | CCTGACCCTCTGAGCCA | 6301 & 6302 |
| GTF2B | GCCTGAAGGGAAGAGCTA | GTTGGAACAGAACCTGGA | 6303 & 6304 |
| GTF2F1 | CGCAGGAGAAGAAGCGCA | CGCCATGAAGAGGGCTGA | 6305 & 6306 |
| GTF2H1 | GCGTCAAAAGAAGCAGGA | CCCCTGCATGTAGGACCA | 6307 & 6308 |
| GTF2H3 | AGAAGACAGTGCGTTGCA | GAGAAGGCATCTGAGGCA | 6309 & 6310 |
| GTF3C1 | AGGCACAGCTCAGGCCAA | CAGACAGGTTCCGCACCA | 6311 & 6312 |
| GTF3C3 | CGCACTCACCCTGACGAA | CAAGTGGAGGGAGCTCCA | 6313 & 6314 |
| GTF3C4 | GCACACCTGGATCACAGA | TAAGAAGCACCGGAGCCA | 6315 & 6316 |
| GTF3C5 | GCAATGACGGGGCAGAGA | CAGGCCTCTTGGAGCGGA | 6317 & 6318 |
| GTPBP10 | GTTGTAGCCCAGAACAGA | GCTCCTACTCCAGCCACA | 6319 & 6320 |
| GTPBP2 | CATGCAGCAGCTGACGGA | AGTGTAGCAGCCTGACCA | 6321 & 6322 |
| GTPBP3 | GAGGGGGTCCTGGAGCAA | GATGTGCACCCAGGGCCA | 6323 & 6324 |
| GUCA2A | GCTCAAAGACCTCCAGGA | TCACCAGGGATGGGTGCA | 6325 & 6326 |
| GUCA2B | AGGCACAGTGGGCACCCA | GCTGGAAGCCTCCTGCGA | 6327 & 6328 |
| GUCY1A2 | GGTGATGTAGCCCAGCAA | ATGGGAGTACACTGGGCA | 6329 & 6330 |
| GUCY1A3 | CAGCTGTGGCAAGGGCAA | GATGACCTGCAGCGGTGA | 6331 & 6332 |
| GUCY1B3 | GAATCACGCATCAGCCCA | CAGGCTGGAGCTGGGGGA | 6333 & 6334 |
| GUCY2D | GAAGCAGTGCTGGGCAGA | GCTCCAGCATCCGAAGCA | 6335 & 6336 |
| GUK1 | CGGCGACTTCATCGAGCA | GCACACCCTGCAGGTCCA | 6337 & 6338 |
| GULP1 | CAGCACCTCCAGCAGGCA | TGCCATTGCGAGTAGGCA | 6339 & 6340 |
| GUSB | GCCGTACCTGATGCACGA | TGACAGCCACAGTGCGGA | 6341 & 6342 |
| GXYLT2 | CTGAGCACGAAATCCCCA | ACATGTCCTCCCAAGCCA | 6343 & 6344 |
| GYLTL1B | CAGGGCCTCCATTGAGCA | GTGTAGAGAGTGCCCGCA | 6345 & 6346 |
| GYPC | CCCCCACCATAATGGACA | GCCGGTACATGTAGCGCA | 6347 & 6348 |
| GYPE | GCACTAACTTCAGGAGCCA | CGAGCCATCGCCCACCAA | 6349 & 6350 |
| GYS1 | CGCAACATCCGTGCACCA | GAGGTGGCCGTGTCCACA | 6351 & 6352 |
| GYS2 | CCACCAACGACAGAAGGA | TGAGGACTGGAGGCCTGA | 6353 & 6354 |
| GZMA | ATGCTATGACCCAGCCACA | GGAGGCTTCCAGCACAA | 6355 & 6356 |
| GZMB | CCCTGGGAAAACACTCACA | CCCCACGCACAACTCAA | 6357 & 6358 |
| GZMH | GAGAGAAAGGCCAAGTGGA | TGAGACATAACCCCAGCCA | 6359 & 6360 |
| GZMK | CTGACACCCTGCGAGA | CCAGAGACTATAGCGTGGAAGA | 6361 & 6362 |
| GZMM | CGCTTCTGGAACGGCA | CTGGAGCTGAAGGACAGGA | 6363 & 6364 |
| H1F0 | TCAAGCGCCTGGTCACCA | CTTGGCTAGCCGGAAGGA | 6365 & 6366 |
| H1FOO | GCAGGGGCCAAACACCAA | GCCTTGATGGGCAGCCCA | 6367 & 6368 |
| H2AFJ | GTGGGCCGAGTGCACAGA | CCGCCGTAAGGTACTCCA | 6369 & 6370 |
| H2AFV | GGACAGTGGGAAGGCCAA | TACACGGCAGCAGTGGCA | 6371 & 6372 |
| H2AFX | GAAGGGCCACTACGCCGA | GCCAGCTCCAGGATCTCA | 6373 & 6374 |
| H2AFY2 | CACCCAACCACAGCCGAA | CGGAGCCCCACTGAGGGA | 6375 & 6376 |
| H2AFZ | GCAGAGAGCCGGCTTGCA | GCGCTGTACACAGCGGCA | 6377 & 6378 |
| H3F3A | GCTTCCAGAGCGCAGCTA | TGGCATGGATAGCACACA | 6379 & 6380 |
| H3F3C | CGTCGGTGCGCTGCAGGA | TAGCGTGGATGGCACACA | 6381 & 6382 |
| H6PD | GGGCCAAGTACCGAGAGA | GTCTGAGAGTGGACGCA | 6383 & 6384 |
| HABP2 | CTGCCCACTGCACCGACA | GGACCCATCAGGCAAGCA | 6385 & 6386 |
| HACL1 | CTGACAAGCAGGCCAGGA | CAAGCTTCAACCTGAGGA | 6387 & 6388 |
| HADH | TAGGAGCCGGTTACCCCA | CATGCCACCCATCCACGA | 6389 & 6390 |
| HADHA | CACCTGCAGAGGGAGACA | GCGCCATACAGATCCACA | 6391 & 6392 |
| HADHB | GGCCACTCTGCAGACCGA | GAGGAAGGACGGATGCCA | 6393 & 6394 |
| HAGH | GGTGTACGGGGGTGACGA | TAGAACTTCCCGCAGCCA | 6395 & 6396 |
| HAL | CGCAGCCACGGAGGACCA | CTTACAACAGAGCGCACCA | 6397 & 6398 |
| HAMP | GAGACACCCACTTCCCCA | CTTGCAGCACATCCCACA | 6399 & 6400 |
| HAND1 | GGAGACGCACTGAGAGCA | CCTTGGCCAGCACGTCCA | 6401 & 6402 |
| HAO1 | TGGGGCTCGACAACTCGA | AACACAGCCTTGGCGCCA | 6403 & 6404 |
| HAO2 | CGGGGTCCGAACTGGCAA | GGCAGCCTGTAAGGGCCA | 6405 & 6406 |
| HAPLN1 | GGAGTCAGGAACTACGGA | GGGTAGCGGACGCTGCCA | 6407 & 6408 |
| HAPLN2 | GGGATCCGCAGCTACGGA | GCACTGGTCTAGCCCCGA | 6409 & 6410 |
| HAPLN3 | GATCGCCAAGGTGGGACA | TAGGATGCGGGTGAACCA | 6411 & 6412 |
| HAPLN4 | CAACTACGGGTATCGCCA | AGCGGTCTAGCAGCTGCA | 6413 & 6414 |
| HARS | CGACCCCAAAGGGCGCAA | GTGCAGATGCCACAAGCA | 6415 & 6416 |
| HARS2 | AACTCAGGCTGGGGAGGA | AACATGCCCACCAGCCCA | 6417 & 6418 |
| HAS1 | CCAACCGCATGCTCAGCA | GGAACAGGCCGGAGACCA | 6419 & 6420 |
| HAS2 | GGATGACCTACGAAGCGA | CCTCTAAGGCAGCTGGCA | 6421 & 6422 |
| HAT1 | GGAGAAGAAACTGGCAGA | GTTGACAGGCTACCAGCA | 6423 & 6424 |
| HAUS3 | GAGCAAAGCACAGCAGCA | CGAGCTGCAGTCTAGCCA | 6425 & 6426 |
| HAVCR1 | CCCACGTCACCTATCGGA | ATACGCCACTGTCAGACA | 6427 & 6428 |
| HAVCR2 | CAACGTGGTGCTCAGGA | CGGCAGCAGTAGATCCCA | 6429 & 6430 |

FIG. 1 Cont.

| | | | |
|---|---|---|---|
| HAX1 | ATGGCCTATGGACCCCCA | GCCAAGACCCTCCTGGGA | 6431 & 6432 |
| HBB | GGCAAAGAATTCACCCCA | GGGCCAGGGCATTAGCCA | 6433 & 6434 |
| HBD | CATGGCAAGAAGGTGCTA | CACAGTGCAGCTCACTCA | 6435 & 6436 |
| HBEGF | GGCCACACCAAACAAGGA | ACTGGGAGGCTCAGCCCA | 6437 & 6438 |
| HBQ1 | CCACCTGCACGCGTGCCA | GGGCGAGGGTTACCAGCA | 6439 & 6440 |
| HBXIP | GCCTGTGGTGGAGAAGGA | GCTCCAAGGTCGCCTCCA | 6441 & 6442 |
| HBZ | CCCGCACTTCGACCTGCA | TGACCGGGTCCACGCGCA | 6443 & 6444 |
| HCAR2 | GCCAAGATCAAGAGAGCCA | GAACGCCAGGTCCACCGA | 6445 & 6446 |
| HCAR3 | GAGACAAATGGACCGGCA | ACACCACGGGGTCCAGCA | 6447 & 6448 |
| HCCS | AGGACTACCAGTTCACCA | TCCAACGCCACCAAGCGA | 6449 & 6450 |
| HCFC1 | TCACTACCACGCAGGCCA | GGGTGATGATGGCCGACA | 6451 & 6452 |
| HCK | GAGTACACGGCTCGGGAA | CACGCTCCAGAGCTCGGA | 6453 & 6454 |
| HCLS1 | CAGGCATGAGCAGGAGGA | GCCACAGCCCCAGCCCCA | 6455 & 6456 |
| HCN1 | ACCAACCTGACCCGGGAA | CCGTCACGGGTTGAGGGA | 6457 & 6458 |
| HCN4 | TGCAGCATGACCGGGAGA | GGAAGATGGCAGCAGGCA | 6459 & 6460 |
| HDAC1 | TGGCCCTGGATACGGAGA | GGGATGGCGTCCTCAGGA | 6461 & 6462 |
| HDAC10 | GGAGAACTCCACACCCCA | TCCTCTGGGGAGGCCACA | 6463 & 6464 |
| HDAC11 | GGGCATCGTGAAGCGGGA | CCAATGAGCCCCAGGCCA | 6465 & 6466 |
| HDAC2 | CCATAAAGCCACTGCCGA | CCAGCAACTGAACCGCCA | 6467 & 6468 |
| HDAC3 | CCTCAGCATCCGAGGGCA | CGGGCAACATTTCGGACA | 6469 & 6470 |
| HDAC4 | GGATCCACCAGCTGAGGA | GGGGCTCCTGCACAGACA | 6471 & 6472 |
| HDAC5 | GATGCCCATTGCCCACGA | GCGGTGACAGAGTAGCCA | 6473 & 6474 |
| HDAC6 | GGACCTTGGAGCTAGGCA | AATGGGGACACCAGGGCA | 6475 & 6476 |
| HDAC7 | GGACGTGCACCATGGCAA | ACCTCATCCACAGCCCCA | 6477 & 6478 |
| HDAC8 | ACGATCACAGCTGCCCAA | TGTGCAGGGACACGGTCA | 6479 & 6480 |
| HDAC9 | CTGGAACCCACGCACACA | AACAGAGGCAGCAGGGGA | 6481 & 6482 |
| HDC | TCCAGTCCAGGCCAGGAA | TGCAACTGAGGGAGCGCA | 6483 & 6484 |
| HDGFL1 | GCACATGACCCAGCCCAA | GGCTAATGGGCAGTCGGA | 6485 & 6486 |
| HDLBP | GCCAAGGCACCTTCCAGA | GGAGGGTCTTGGGAGCCA | 6487 & 6488 |
| HEATR2 | CGGCATGACGGATCCAGA | ACTGCAGCCAGGTGACCA | 6489 & 6490 |
| HEATR4 | AAGTCCCGAGCTGACGGA | GGTTCTCCAGGAGCAGCA | 6491 & 6492 |
| HEATR5A | GATGTGCAGACCTGGGCA | CAGCATGAGTAGGAGGCA | 6493 & 6494 |
| HEBP1 | CAATGCCCAAGGTCGCAA | TCATTGGGGAACACAGCA | 6495 & 6496 |
| HECA | GGATGGCAGCTGGCACCA | GATCACCGGCTTCCCACA | 6497 & 6498 |
| HELB | AGTGGAGGACCCAGCACA | CGAAGAGGCCTCGCTCCA | 6499 & 6500 |
| HELLS | GCCATGCTAGAAGAGGAA | CTATCCCAAGACATGCGA | 6501 & 6502 |
| HEPH | GGAGATGGTGGCCAGCAA | GGATCTGCATGCCCAGCA | 6503 & 6504 |
| HERC2 | TCGTGACACCCAACGGGA | GCCAGCTGCTTCCAGACA | 6505 & 6506 |
| HERC3 | CCCAAGCCAGCCCACAGA | CAGCTCCTGAGAGAGACA | 6507 & 6508 |
| HERC6 | GTGGGGAAAGAACAGCCA | TACGCCCACTGAGGGCCA | 6509 & 6510 |
| HES1 | CTGCAAGCTGGGCAGCCA | GTGTAGACGGGGATGACA | 6511 & 6512 |

| | | | |
|---|---|---|---|
| HES6 | CGGGATCCCCAATACCCA | CCCTCAGCAGGAGCCTGA | 6513 & 6514 |
| HESX1 | CTGCAGCTCATCAGGGAA | GGGTGATCCACCACGCTA | 6515 & 6516 |
| HEXA | CGAAAGGCTGTGGAGCAA | AGGGGTTGGGCCTGGACA | 6517 & 6518 |
| HEXB | GCGGTACTCAGAAACAGA | AGTCTCTCACCAACAGCA | 6519 & 6520 |
| HEXIM1 | AGAAGGGGGTGAGGAGGA | CCGAGAAGTCCCGCTGCA | 6521 & 6522 |
| HEY1 | ACGGCCTCACCCACGGAA | AGGCCGACAGGGAGGCCA | 6523 & 6524 |
| HEY2 | AGCCCTGCTCCAGCCCAA | AGGTGGAGAGAGGTGGCA | 6525 & 6526 |
| HEYL | GGGCATCTTCCACCCGGA | AGCCACGTAAGCAGCCGA | 6527 & 6528 |
| HFE | GGATTGGAGAGCAGCAGAA | GGTCACTGAAGAGGTCACA | 6529 & 6530 |
| HFE2 | CTGGGAACCATGTGGAGA | GTTCAGCTGAGAAGGCCA | 6531 & 6532 |
| HGF | GAGAAGGCTACAGGGGCA | AGCAGTAGCCAACTCGGA | 6533 & 6534 |
| HGFAC | CTTCAACCGCACGACGGA | CTGCGAGCGTGTGGCACA | 6535 & 6536 |
| HGSNAT | AGGGGCTGTGGACAGGAA | AGAGGGCAGTGGCGACGA | 6537 & 6538 |
| HHEX | GGAGAACCCTCAAAGCAA | GGAGGCAGGGGAGGGCGA | 6539 & 6540 |
| HHIP | CAAGTCAGAGGACCAGCA | AAGAGACGTTGCGAGCCA | 6541 & 6542 |
| HHIPL1 | CGACGTGGACCGTAAGGA | GCCACGGTCGAAGGAGCA | 6543 & 6544 |
| HHIPL2 | GGCAGGCTCACATGGCAA | GTCCACAGCACAACGCCA | 6545 & 6546 |
| HHLA1 | CCGAGTCCAACCAAGGCA | GAAGAGTGGCTGAGGACA | 6547 & 6548 |
| HHLA2 | AGCCAGGAGGAGCAGACA | GCACTGGGACAGCGCTCA | 6549 & 6550 |
| HIBADH | CACGATCTGGGAACCTCA | CCAGTCCCAACAGCTCCA | 6551 & 6552 |
| HIC1 | GTAGCAGCGAGGACCCCA | TGCCGCACGGAATGCACA | 6553 & 6554 |
| HIF1A | TGCACTGCACAGGCCACA | TCAGCACCAAGCAGGTCA | 6555 & 6556 |
| HINFP | CCTCTCAGGACAACCCCA | CCCCTGGGGCTTCAGACA | 6557 & 6558 |
| HINT1 | GAAGATCATCCGCAAGGA | TTCAGGCCCAGATCAGCA | 6559 & 6560 |
| HINT2 | CTGGACAAGAGCCTCCCA | GCCTGGCTAATCCGAGGA | 6561 & 6562 |
| HIP1 | CTGGCCAGCACAGAGGAA | ATCTGCAGACCCAGCGCA | 6563 & 6564 |
| HIRA | GAGACCTCCTGGAGAGCA | GCAGCTGGAGACTGGACA | 6565 & 6566 |
| HIST1H1B | CTCCTGCCGAGACAGCCA | GCTCCTTAGAAGCAGCCA | 6567 & 6568 |
| HIST1H2AE | AAGCTCGGGCAAAAGCTA | ATTCCAGCACCGCTGCCA | 6569 & 6570 |
| HIST1H2AL | CATCCGCAACGACGAGGA | ATGTTGGGCAGGACACCA | 6571 & 6572 |
| HIST1H2BB | CACCGGCATCTCATCCAA | GTAGTGAGCCAGGCGAGA | 6573 & 6574 |
| HIST1H2BC | ACAACAAGCGCTCGACCA | TGGCCAGCTCTCCGGGAA | 6575 & 6576 |
| HIST1H2BG | CATCCAAGGCCATGGGCA | GTAGTGGGCCAGACGGGA | 6577 & 6578 |
| HIST1H2BK | CAGCCGCAAGGAGAGCTA | CACCCGCGATGCGTTCGA | 6579 & 6580 |
| HIST1H2BO | TCCACCCCGACACCGGCA | TCGCCAGCGATGCGCTCA | 6581 & 6582 |
| HIST1H3B | CCAGCGCCTGGTGCGAGA | TGCAGCGCCATCACCGCA | 6583 & 6584 |
| HIST1H4B | GGAGAACGTGATCCGGGA | CCACATCCATGGCAGTGA | 6585 & 6586 |
| HIST1H4C | GCGGTGGCGTCAAGCGCA | AGGTGACGGCGTCTCGAA | 6587 & 6588 |
| HIST1H4H | GCGATAACATCCAGGGCA | TAAGTGACAGCGTCACGA | 6589 & 6590 |
| HIST1H4I | GTATCACCAAGCCAGCCA | GCGCGTAGACCACGTCCA | 6591 & 6592 |
| HIST3H2A | GCACCGGTTGCTCCGCAA | CGGCAGTCAAGTACTCGA | 6593 & 6594 |

FIG. 1 Cont.

| | | | |
|---|---|---|---|
| HK1 | GCACCAGACGGTGAAGGA | TGCGTAACCGCACGCCCA | 6595 & 6596 |
| HK2 | GCACCTGTGACGACAGCA | GGGTCCCATCCACACCCA | 6597 & 6598 |
| HK3 | GGTGGAGAAGATCCGGGA | AGGCAACAGCGGTGACCA | 6599 & 6600 |
| HKDC1 | GCACGTGTGAGGACAGCA | GTGCCGTCCACACCCACA | 6601 & 6602 |
| HLA-A | GCCTTCTGGAGAGGAGCA | TACAAGCTGTGAGGGACA | 6603 & 6604 |
| HLA-B | GACCAGACCAGCAGGAGA | CAGCGACCACAGCTCCGA | 6605 & 6606 |
| HLA-C | ATCACACTGACCTGGCA | CTTGTCCAGAAGGCACCA | 6607 & 6608 |
| HLA-DMA | ATTGACCGCTACACAGCAA | ATGAGAACAATGCCCACGA | 6609 & 6610 |
| HLA-DMB | CTCACAGCACCTCAACCAA | ATAGCAGGCCAGCATCACA | 6611 & 6612 |
| HLA-DOA | TGACTGCCAGGTGGAGCA | ACCAGGGTCTCCATGGCA | 6613 & 6614 |
| HLA-DOB | GAATGGGCAGGAGGAGA | CAGAAACAGGGCTCAGCA | 6615 & 6616 |
| HLA-DPA1 | AAGCACTGGGAGGCCCAA | TGCCCACGATGATGCCGA | 6617 & 6618 |
| HLA-DPB1 | GGAGCACACCAGCCTGGA | CCCAGCACGAAGCCCCCA | 6619 & 6620 |
| HLA-DQA1 | TGACTGCAAGGTGGAGCA | AAGCACCAACTGAACGCA | 6621 & 6622 |
| HLA-DQB1 | CCAGCCTCCAGAGCCCCA | GACGGATGATAAGGCCCA | 6623 & 6624 |
| HLA-DRA | CGACTGCAGGGTGGAGCA | TGATGCCCACCAGACCCA | 6625 & 6626 |
| HLA-DRB1 | GACCCAGCCCCTGCAGCA | GGATCAGGCCTGTGGACA | 6627 & 6628 |
| HLA-DRB5 | CCACAGGCCTGATTCAGAA | CCCGACTCCACTCAGCA | 6629 & 6630 |
| HLA-E | GCATGAGGGGCTACCCGA | GACTCAGACCCCTGGGCA | 6631 & 6632 |
| HLA-F | GAACAGACCCAGGACACA | TCCACATCACAGCAGCGA | 6633 & 6634 |
| HLA-G | TGGAGCTCGTGGAGACCA | TCCACAGCACAGCAGCGA | 6635 & 6636 |
| HLF | CAGAGCCCCATCAGACCA | AACCCACTGGGACCTGGA | 6637 & 6638 |
| HLTF | AATGCGCTAATGCACGCA | GGGCCATGGAACCATCCA | 6639 & 6640 |
| HMBS | GGAGTCTAGACGGCTCAGA | CGAGCAGTGATGCCTACCA | 6641 & 6642 |
| HMCN1 | GACGTGTAACGGAGGGCA | TCCACAGGAGGCAGAGCA | 6643 & 6644 |
| HMGA1 | AGGAAACCAAGGGGCAGA | CTCCGAGGACTCCTGCGA | 6645 & 6646 |
| HMGA2 | GAAGCCTGCTCAGGAGGA | AGTGGAAAGACCATGGCA | 6647 & 6648 |
| HMGB1 | GGATCCCAATGCACCCAA | CGCAACATCACCAATGGA | 6649 & 6650 |
| HMGB2 | CTCGCTATGACAGGGAGA | GGGCGATGTTCAGAGCAA | 6651 & 6652 |
| HMGCL | TCTCCCTGGGGGACACCA | CCACGACACTCACTCCCA | 6653 & 6654 |
| HMGCR | ACAACGCCCATGCAGCAA | GGTTGGTCCCACCACCCA | 6655 & 6656 |
| HMGCS1 | GCTCAGAGAGGACACCCA | AGTGGGACGCCGAGCGTA | 6657 & 6658 |
| HMGCS2 | TGGCCTCGGAGTACCCAA | CATCAGGCGAGCCAGAGA | 6659 & 6660 |
| HMGN2 | GAGAAAGGCTGAAGGGGA | AGCAGACAACCTCGCGGA | 6661 & 6662 |
| HMHA1 | GCCCCACGACATCAGCAA | GTGGTAGAGGCGGAAGGA | 6663 & 6664 |
| HMOX1 | GTGCCACCAAGTTCAAGCA | GATGTTGAGCAGGAACGCA | 6665 & 6666 |
| HMOX2 | CCACACTGGCCAGAGAGA | GTCCAGCAGCTAGGGCCA | 6667 & 6668 |
| HN1 | AAATCCCCCTGGCGGCAA | GCAGTTCACAAGCATGGA | 6669 & 6670 |
| HNF1A | CTACAGCCACAAGCCCGA | AAGCCCGGACTCACTGGA | 6671 & 6672 |
| HNF1B | AGCAAGTCTCCCCAGCCA | AGGTGCTGACTGGGGGCA | 6673 & 6674 |
| HNF4A | CTCGGAGCCACCAAGAGA | GCAGCTCCTGGAAGGGCA | 6675 & 6676 |
| HNMT | ACAAGAAGCTGCCAGGCA | CACCTGCACCTCCGCCTA | 6677 & 6678 |
| HNRNPA1 | CCCTGTCAAAGCAAGAGA | TAGCCATCCCCACTGCCA | 6679 & 6680 |
| HNRNPA2B1 | CAGGGTGGGGGCTACGGA | CTCCCACCATAACCCCCA | 6681 & 6682 |
| HNRNPA3 | GACCCATGAAAGGGGGCA | CCACCACTTCCACCACCA | 6683 & 6684 |
| HNRNPC | GTGAACCGAGGAAAAGCA | ACAGCCCGAGCAATAGGA | 6685 & 6686 |
| HNRNPD | GAGGCACCGAAGGGGGCA | AGAGTGTCGTGGGGAGGA | 6687 & 6688 |
| HNRNPF | ACCGACCTGTTCGGGAGA | AGGCCCCTCATGTGGACA | 6689 & 6690 |
| HNRNPR | GGCTCTAGGGGTGGCAGA | CCCCCACGATTGCCCCGA | 6691 & 6692 |
| HNRNPU | AGGAGGAGCCCCTGGGAA | GGATAGCCGATTCCACCA | 6693 & 6694 |
| HOMER2 | TGTCAACGGGACGGACGA | GCGCTCTGCGTCAAGGCA | 6695 & 6696 |
| HOOK3 | GGGCGGAGCTGTGCGAGA | AGAACCTGGGCCATCACA | 6697 & 6698 |
| HOXA1 | CAGCTCAACGAGACCCAA | TGGCCGGAGAGATGGGCA | 6699 & 6700 |
| HOXA11 | GCGCTGCCCCTATACCAA | GCATGCGGGACAGTTGCA | 6701 & 6702 |
| HOXA13 | ACGGGAATACGCCACGAA | TGACCTGCCGCTCAGAGA | 6703 & 6704 |
| HOXA3 | GCTATGGGACCCCACACA | CGGCACCCCCATAGTCCA | 6705 & 6706 |
| HOXA9 | GTCGGCCAGAAGGGGTGA | TCAACTGGAGGAGAACCA | 6707 & 6708 |
| HOXB1 | CACAAGGCAGCTGACAGA | AGCTCCAGGGTGGCGGCA | 6709 & 6710 |
| HOXB9 | GGACGCGCCTCCAGCCAA | GTAAGGGTGGTAGACGGA | 6711 & 6712 |
| HOXC10 | GCATGTACAGCGCAGAGA | CGCGGTAGTAGCTGGGCA | 6713 & 6714 |
| HOXC11 | CTTCCACCGTCACCGAGA | GGTCGAAGGCTTGAGGCA | 6715 & 6716 |
| HOXC13 | CGTCGAAGGCTACCAGCA | GGGAACCACGTCTGGGAA | 6717 & 6718 |
| HOXD11 | CCGCGAACTGGAACGCGA | GAGGTTGAGCATCCGAGA | 6719 & 6720 |
| HOXD13 | AACGAGGTGCCAGCGCGA | AGGACTGGTACCCCTCCA | 6721 & 6722 |
| HP | CCAAGAAGACACCTGCTA | ACACACCATACTCAGCCA | 6723 & 6724 |
| HPCAL4 | CCAGGATAAGGACGACCA | GCATGTCACACTGCAGCA | 6725 & 6726 |
| HPD | ACGCAGGTGCACACGGAA | GCGATGTGCTGGACCCCA | 6727 & 6728 |
| HPGD | GCTCAGGGCATAGGCAGA | CAGCCACATCGCACTGGA | 6729 & 6730 |
| HPGDS | AACGAAGGCCCCAAACCA | GGAGCTGGGGAGGGAGCA | 6731 & 6732 |
| HPN | AGGAGGCTCGAGTCCCCA | AATGCCACACAGCCGCCA | 6733 & 6734 |
| HPR | GCTATGGCGATGCGGGCA | CCATACTCAGCCACAGCA | 6735 & 6736 |
| HPRT1 | GACCAGTCAACAGGGGACA | ATACTGCCTGACCAAGGAA | 6737 & 6738 |
| HPSE | TGGCCCTACCAGGAGCAA | TCCAGGAGCAACTGAGCA | 6739 & 6740 |
| HPSE2 | TGCTGGCCAATCAGGGCA | AGCCCAGCCACATGCACA | 6741 & 6742 |
| HPX | CCAAGCCACGTGGACAGA | AGGTACAAGCCGGGACCA | 6743 & 6744 |
| HR | GTGCATGCCGACACACCA | CGGAACACGTGCCACACA | 6745 & 6746 |
| HRAS | ACGGGTGAAGGACTCGGA | GAGCCTGCCGAGATTCCA | 6747 & 6748 |
| HRC | GGACACAGGTCCACAGGA | AGCTTCCTGGAGCGCAGA | 6749 & 6750 |
| HRG | TCATGGACACCACCCCCA | GGTGGGTCACAAGGTCCA | 6751 & 6752 |
| HRH1 | AGCACCAGGCAAAGGCAA | TGATGTAGCCCAGCCAGA | 6753 & 6754 |
| HRH2 | CCACCATCAGGGAGCACA | GTTGGCATAGCCCAGCCA | 6755 & 6756 |
| HRH4 | GAGCCAGGAGATTAGCCA | GAATTGAACCACTGAAGCCA | 6757 & 6758 |

FIG. 1 Cont.

| | | | |
|---|---|---|---|
| HRNR | AGGGGTGAACGACACGGA | GAAGACTGACGGGAGCCA | 6759 & 6760 |
| HRSP12 | GGACCCTTCAAGTGGACA | GTGAAGTCACAGCCTGCA | 6761 & 6762 |
| HS2ST1 | CGGAGACGAAAACAAGGA | GGCCACAGAAGAACGGGA | 6763 & 6764 |
| HS3ST1 | CTACCCGTCCATCGAGGA | GGATGTGGCGCAGCGGGA | 6765 & 6766 |
| HS3ST6 | CATGTCCCCGGACACGAA | ACAGGGGGAAGTAGCGCA | 6767 & 6768 |
| HS6ST1 | GGGCTGCACGCTACAGGA | ACAGGTTGTAGCAGCCCA | 6769 & 6770 |
| HS6ST2 | GCTGAGACCGTCCAGGAA | CAGTGTAGCAGCTGGGCA | 6771 & 6772 |
| HS6ST3 | ATGTCCAGAGAGGGGCCA | AGTTATAGCAGCCCACCA | 6773 & 6774 |
| HSD11B1 | CTGGCACCATGGAAGACA | AAGCCACTTTCCCAGCCA | 6775 & 6776 |
| HSD11B1L | CAGCCTGACGGACAGCAA | CGCGATCTCGGAGGCCCA | 6777 & 6778 |
| HSD11B2 | GTGGGAAAAGCGCAAGCA | CATGGCCAGGCGTAGCGA | 6779 & 6780 |
| HSD17B10 | GCACCCCACTGCTGACCA | GCCTGTACGAGGTGAGCA | 6781 & 6782 |
| HSD17B11 | GGGCATGGAATTGGGAGA | GGCACCCAGTCCCTTGCA | 6783 & 6784 |
| HSD17B14 | TAGGGCCACAATCCGAGA | TGGCTTCGGAGGCCAGGA | 6785 & 6786 |
| HSD17B2 | GGAAGACTACGGCCAGGA | GCTGGATGTCCCGCAGCA | 6787 & 6788 |
| HSD17B4 | GCCTCAGTGGAGACTGGA | TAACACACGCCTGGCAGA | 6789 & 6790 |
| HSD17B6 | GAAAGAAGCCCCCAAGCA | AGTTCGCGGATGCACCGA | 6791 & 6792 |
| HSD17B7 | CACAGCAAAGGCAAGGAA | CTGTACCTGGACAGGCCA | 6793 & 6794 |
| HSD3B1 | CGCCCTTCAACCGCCACA | GTGCCGGTCCACAAGGGA | 6795 & 6796 |
| HSD3B2 | TATGGGGAAGGAGGCCCA | GCAGAGCCCTCAAGGCCA | 6797 & 6798 |
| HSD3B7 | CGACAAGGCTCAGCGCCA | CGTAGCGGCCTGTACCCA | 6799 & 6800 |
| HSDL2 | ACGTGAACACCAGAGGCA | CCCAGCATATCCATAGCA | 6801 & 6802 |
| HSH2D | GGAAGCCGTCAGCAGAGA | ACCGTGGATCTCCGGACA | 6803 & 6804 |
| HSP90AA1 | GGTGGTAGACTCGGAGGA | ATCTCATCACCAGAGGCA | 6805 & 6806 |
| HSP90AB1 | GCTGGCAGAAGACAAGGA | GGGAGGTATGATAGCGCA | 6807 & 6808 |
| HSP90B1 | CCGGTGTAGGAATGACCA | TGCTACAAGGAAGGCGGA | 6809 & 6810 |
| HSPA13 | GGACAGGAAGGAACCTCA | AACCCACTGTTCACGCGA | 6811 & 6812 |
| HSPA1A | CTGCCCTGATCAAGCGCA | CGTACACCTGGATCAGCA | 6813 & 6814 |
| HSPA1B | CGCCAACACCTTGGCCGA | ATGGTAGGGCCTGACCCA | 6815 & 6816 |
| HSPA1L | GCAGCGGCTGCTTCAGGA | AGCCCCAGGGACAGGGGA | 6817 & 6818 |
| HSPA2 | CCATCCTCATCGGCGACA | GGGGTCATGACACCGCCA | 6819 & 6820 |
| HSPA4 | GCTAGAGTGGAGCCACCA | GCAGGCGATAAGATGGCA | 6821 & 6822 |
| HSPA4L | AAGAACCATCCTGCCCCA | ACTGATGCGCTAGCCACA | 6823 & 6824 |
| HSPA5 | ATCAACGAGCCTACGGCA | CGAAGGTTCCGCCACCCA | 6825 & 6826 |
| HSPA6 | AGGAGGAGGTGGAGAGGA | GCTCCAGCCAGGCAAGGA | 6827 & 6828 |
| HSPA8 | AGAGAAAGCCCTTCGAGA | GAGTGACATCCAAGAGCA | 6829 & 6830 |
| HSPA9 | GGAGCTGCCATTCAGGGA | CATCAGCGGCAGTAGAGA | 6831 & 6832 |
| HSPB1 | CCACGCAGTCCAACGAGA | GGCGGCAGTCTCATCGGA | 6833 & 6834 |
| HSPB2 | CCAGCGCCTGGACCGCCA | GGGAGAGAGCAGCTCGGA | 6835 & 6836 |
| HSPB8 | CAGCTTCAAGCCAGAGGA | CCTCTGCAGGAAGCTGGA | 6837 & 6838 |
| HSPBAP1 | TCCTTGGGAGCCCACACA | GGGCTCAGTGTAACCGCA | 6839 & 6840 |
| HSPD1 | GTGGCAGTCAAGGCTCCA | CTGCACCACCAGTAGCAA | 6841 & 6842 |
| HSPE1 | CTGTAACCAAAGGAGGCA | AACCCGATCCAACAGCGA | 6843 & 6844 |
| HSPH1 | AGGACAGAGGCTGCAGCA | TGAGCACGTACAACTGGA | 6845 & 6846 |
| HTATIP2 | AGGCAAGAATCTCGCCCA | CTCTAACCACGGTCACCA | 6847 & 6848 |
| HTR1A | CAGTGAAGACGCTGGGCA | GTTGGAGTAGCCCAGCCA | 6849 & 6850 |
| HTR1B | TGGTGAACACCGACCACA | TGCGGCCATAGAGGGCGA | 6851 & 6852 |
| HTR1D | CAGTGCCCTGGAACGCAA | AGCAGGAGTCCCGGCAGA | 6853 & 6854 |
| HTR1E | TGGACAGGTACTGGGCCA | ACAGAGGGGGCATGGAGA | 6855 & 6856 |
| HTR1F | GCAGCCACTACCCTGGGA | GATACCCAAGCCATGCCA | 6857 & 6858 |
| HTR2A | AGGCAGGAGGACTATGCA | AGCAGGGCCCCAATGACA | 6859 & 6860 |
| HTR2B | CACCGGAAAAGGTGGCAA | AGGGACACCACATAAGCA | 6861 & 6862 |
| HTR2C | ACCAGAACGCACGCCGAA | GGGCACCACATGATCAGA | 6863 & 6864 |
| HTR3A | GCGGGATGAGATCCGAGA | GCCAGATGGACCAGAGCA | 6865 & 6866 |
| HTR4 | TCAACAAGCCCTACGCCA | AGGCCTGCTCTCGGAGGA | 6867 & 6868 |
| HTR5A | CTGCCAAACAGCCCCAGA | AGGGGATCCAGCAGAGCA | 6869 & 6870 |
| HTR6 | ACAGCACCATGAACCCCA | GGTGCGCAGTGATGGCGA | 6871 & 6872 |
| HTR7 | CTGTGGGTGGAGAGGACA | GGTACTGGCACTGGAGCA | 6873 & 6874 |
| HTRA1 | GCACCGGGACTTCCCAGA | CATCATTGGCGGAGACCA | 6875 & 6876 |
| HTRA2 | TGACCCTGAGTCCCAGCA | TCACATCACCAGGCCGCA | 6877 & 6878 |
| HTRA3 | GCAAGAGGTTGCGCCGAA | GCAGCTCACTCGAGTCCA | 6879 & 6880 |
| HTRA4 | GTGGAGAAGGTGGCGCCA | CCCCATTCTGGAGCACCA | 6881 & 6882 |
| HUS1 | AAGCTGGCTAATGGAGGA | CTGCAGAGACACCCTCCA | 6883 & 6884 |
| HUWE1 | TCCTACGGCAGTCCACGA | GACGGACATGCACAGCCA | 6885 & 6886 |
| HYAL1 | CCTGGATGAGCTGGAGCA | CCCAGCTCACCCAGAGCA | 6887 & 6888 |
| HYAL2 | CGGGGTACACCACAAGCA | CGCAGCTGGGGTTCACCA | 6889 & 6890 |
| HYDIN | GGTGCAGGGAGACAGCAA | TTCGGAGGGGCAGACGGA | 6891 & 6892 |
| HYOU1 | GGACAAGTCTGAGGCCCA | CCTCTGGCAAGTCAGGCA | 6893 & 6894 |
| IAPP | TGCCACATGTGCAACGCA | GATGAGAGAATGGCACCA | 6895 & 6896 |
| IARS | CCCACTGTGGGTCAGCGA | GAACCTGAGCATAGGGCA | 6897 & 6898 |
| IBSP | TACGAGGGGGAGTACGA | GCCGGATGCAAAGCCAGA | 6899 & 6900 |
| ICA1 | GACCCCAAGGCCCAGACA | GCAGTCAGGTCTGAGGCA | 6901 & 6902 |
| ICAM1 | CAAGAACCAGACCCGGGA | GACACTTGAGCTCGGGCA | 6903 & 6904 |
| ICAM2 | CAAACACTCAGCCCCGAA | GCAGGACAGATGTCACGA | 6905 & 6906 |
| ICAM3 | GTCCAGCTCACGAGGCAA | CGATAGTCACCACGCCCA | 6907 & 6908 |
| ICAM4 | CGGCACCCATTACACTGA | ATAGGTACGCAGCGCCCA | 6909 & 6910 |
| ICAM5 | CCTGCCCAAGTCACCAGA | CGCATTGGTGGCCACACA | 6911 & 6912 |
| ICK | CTCCAGGAGGACAAGCCA | GTCATCCAAGTCAGCCCA | 6913 & 6914 |
| ICOS | GGGGCAAATACTCTGCGA | CCAGAACTTCAGCTGGCA | 6915 & 6916 |
| ICOSLG | AGCCGCTACCGGAACCGA | TGACGTTGAACAAGCGCA | 6917 & 6918 |
| ID1 | AGGTGAGCAAGGTGGAGA | GCGGAGCCCGGACCGGCA | 6919 & 6920 |
| ID2 | AGGAGCTGGTGCCCAGCA | GATGCGAGTCCAGGGCGA | 6921 & 6922 |

FIG. 1 Cont.

| | | | |
|---|---|---|---|
| ID3 | CAGCTGAGGAGCCGCTGA | TCGGGACTCCGGGTACCA | 6923 & 6924 |
| ID4 | GGAGGCTGGTGCCCACCA | GCGCCAGCTGCAGGTCCA | 6925 & 6926 |
| IDE | GAGGTGCTCACAGCGGAA | ACTATGGCAACCCGGACA | 6927 & 6928 |
| IDH1 | GGTTAGCCCACAGAGCAA | GTCATGAAGCCAGCCTCA | 6929 & 6930 |
| IDH2 | GGGGAAGCTGGATGGGAA | GCTGAGGCCGTGAATGCA | 6931 & 6932 |
| IDH3A | ATGGGACGGCTCCAGACA | CGCAGCATCATCACGGCA | 6933 & 6934 |
| IDH3B | AGAGCAGACAGAAGGGGA | CCTCACAGCACTGCAGGA | 6935 & 6936 |
| IDH3G | CCGGCAAGAGTATCGCCA | GGCCGTTGATGACGCGGA | 6937 & 6938 |
| IDI1 | GCCCTTGGAGTGAGGCGA | GGAACCTCTTCCAAGGGA | 6939 & 6940 |
| IDO1 | AAAGGCAACCCCCAGCTA | TGGAGGAACTGAGCAGCA | 6941 & 6942 |
| IDS | ATGGAGCCAGGCAGGCAA | CACGGGGATTACCAGGGA | 6943 & 6944 |
| IDUA | GAGCAGCTCTGGGCCGAA | CGCTCGCGTAGATCAGCA | 6945 & 6946 |
| IER2 | GAAGAGGAGGGAGCGTCA | GCAGTTCAGGAGGCCGGA | 6947 & 6948 |
| IER3 | GACGCCCCTAACGCCGCA | GCTGAGGTCCAGAGCGTA | 6949 & 6950 |
| IER3IP1 | TGGGGAACAGACCAGGGA | CAAGTGCAAGGTCAGCCA | 6951 & 6952 |
| IER5 | GGAGATGGAGACCGGGAA | TCCGTAGGAGTCCCGAGA | 6953 & 6954 |
| IFI16 | CCTTCAGAGGCCAGCACA | GATGGAGGCATCTGAGGA | 6955 & 6956 |
| IFI27 | TGCAGTCACTGGGAGCAA | CTCGCAATGACAGCCGCA | 6957 & 6958 |
| IFI27L2 | GCAGCTGGACTCTCCACA | GGGTTCAGCTGGGAGAGA | 6959 & 6960 |
| IFI30 | CATGCACGCCAACGCCCA | GGCAGACAAGGGTAAGGA | 6961 & 6962 |
| IFI35 | GGGAGCTACTGCCAGGGA | ACCAGTACCGAGCGGGGA | 6963 & 6964 |
| IFI44 | GCCTGTGCAGGGATGACA | GCCACATGTACCACACCA | 6965 & 6966 |
| IFI44L | TAACCGAGCGGTATAGGA | CTGCCCCATCTAGCCCCA | 6967 & 6968 |
| IFIH1 | AGGAGTCAAAGCCCACCA | TGACGAGACCATAACGGA | 6969 & 6970 |
| IFIT1 | ACCTGGACAAGGTGGAGA | ACAGCCTGCCTTAGGGGA | 6971 & 6972 |
| IFIT2 | GCCTTGGAGAAAGCCCCA | GCCCTATAGCAGCACCCA | 6973 & 6974 |
| IFITM1 | CCGTGATCAACATCCACA | GCCCAGAATCAGGGCCCA | 6975 & 6976 |
| IFITM2 | CAGCGGCCAGCCTCCCAA | TGCTATGAAGCCCAGGCA | 6977 & 6978 |
| IFITM3 | TCCACATCCGCAGCGAGA | GGCCCAGATGTTCAGGCA | 6979 & 6980 |
| IFLTD1 | CAGCAGCATCTGAAGCAA | ATAGGGGTGTACCACGCA | 6981 & 6982 |
| IFNA1 | GAGGAGAGGGTGGGAGA | CAACCTCCCAGGCACA | 6983 & 6984 |
| IFNA10 | GGTTGGGGTGGAAGAGA | CAACCTCCCAGGCACA | 6985 & 6986 |
| IFNA13 | GCCTGGATAACAGGAGGA | AGGACAGAGATGGCTGGA | 6987 & 6988 |
| IFNA14 | TCCAGAAAGCTCAAGCCA | ACACAGGCTTCCAGGTCA | 6989 & 6990 |
| IFNA16 | CCTGGCACAAATGGGAAGA | TCTCATCCCAAGCAGCAGA | 6991 & 6992 |
| IFNA2 | GGTGGGGGTGACAGAGA | CAACCTCCCAGGCACA | 6993 & 6994 |
| IFNA21 | GGGAACAGAGCCTCCTAGA | CAGCCAGGATGGAGTCCA | 6995 & 6996 |
| IFNA4 | CTGAATGACCTGGAAGCA | CCTCACAGCCAGGATGGA | 6997 & 6998 |
| IFNA5 | GAGGTTGGAGTGGAAGACA | CAACCTCCCATGCACA | 6999 & 7000 |
| IFNA6 | GCAGCTGAATGACCTGGA | TCTCACAGCCAGGATGGA | 7001 & 7002 |
| IFNA8 | GGAAGTGGGGGTGATAGA | CAACCTCCCAGGCACA | 7003 & 7004 |
| IFNAR1 | CCGCAGCCGCAGGTGGAA | AGTCACATTCCCGACAGA | 7005 & 7006 |
| IFNAR2 | CCCGGAGTCCGAGGAGGA | TCTCACAGGGCCCACTCA | 7007 & 7008 |
| IFNB1 | AGCAGTTCCAGAAGGAGGA | AGCCAGGAGGTTCTCAACA | 7009 & 7010 |
| IFNG | GAATGTCCAACGCAAAGCA | TTGCAGGCAGGACAACCA | 7011 & 7012 |
| IFNGR1 | ACTCACGCAGAAGGAAGA | AGTTGTAACACCCCACACA | 7013 & 7014 |
| IFNGR2 | GAGCTGGGAGCACTCCA | CCGTGGAGGTATCAGCGA | 7015 & 7016 |
| IFNK | ATGAAACCCTCAGAAGCCA | GGACAATCTCCCAGGCACA | 7017 & 7018 |
| IFNL1 | GCTGCACCGGCTCCAGGA | CTCGCGTGAGGAGGCGGA | 7019 & 7020 |
| IFNL2 | TGGACCAGCCCCTTCACA | TGGAGCCGGTACAGCCAA | 7021 & 7022 |
| IFNW1 | TAAAAGGGAGCCAGTTGCA | CATGTTCCAGGCAGCAGA | 7023 & 7024 |
| IFRD1 | GCCTTGGCAACAGATGGA | CCTCCACTGCCCTCAGGA | 7025 & 7026 |
| IFT88 | CGCATAAAGTCAGGCAGA | CCACTATCACCGCTAGCA | 7027 & 7028 |
| IGF1 | CCACAGGGTATGGCTCCA | TGGCGCTGGGCACGGACA | 7029 & 7030 |
| IGF1R | CCAGGAACAACGGGGAGA | CCAGCTGTTGGAGCCGCA | 7031 & 7032 |
| IGF2 | CCGGACAACTTCCCCAGA | CACGCAGGAGGGCAGGCA | 7033 & 7034 |
| IGF2BP1 | AGGCTCCCGAGCAGGAGA | TGATGGAGGCGCTGGCAA | 7035 & 7036 |
| IGF2R | ATCAGCGCTCCACAGCCA | GGGCCAGAGACTTGCAGA | 7037 & 7038 |
| IGFALS | CTTCCAGGGCCTGGGCAA | CCAAGAGGCTGTTGGGCA | 7039 & 7040 |
| IGFBP1 | GGCCCCTTCTGAAGAGGA | TGGAGAGCCTTCGAGCCA | 7041 & 7042 |
| IGFBP2 | CTCCCTGCACATCCCCAA | GGGGTTCACACACCAGCA | 7043 & 7044 |
| IGFBP3 | CAAGTTCCACCCCCTCCA | CCGCTTGGACTCGGAGGA | 7045 & 7046 |
| IGFBP4 | GGATGGGCAGCGTGGCAA | CCAGCTGGTGGCAGTCCA | 7047 & 7048 |
| IGFBP5 | GCCCAATTGTGACCGCAA | CTTGTCCACGCACCAGCA | 7049 & 7050 |
| IGFBP6 | GCAGAGACCAACAGAGGA | GCTGCAGCACTGAGTCCA | 7051 & 7052 |
| IGFBP7 | GCGAGCAAGGTCCTTCCA | TGTCCCGGTCACCAGGCA | 7053 & 7054 |
| IGFBPL1 | ACGGTCGCTCGTACCCCA | AGCCCTCACTTCACAGGA | 7055 & 7056 |
| IGFL1 | TGCCAGCCACACAAGAGA | GGGTCCTGGCCAAGGGCA | 7057 & 7058 |
| IGFL2 | CCCGCTGGCTCAGAACCA | GCAGGGCCAGAAGGTGCA | 7059 & 7060 |
| IGFL3 | TGTGCCAGCCGACACCCA | TCATACCCAGAACCCTCA | 7061 & 7062 |
| IGJ | CTACAGAAGTGGAGCTGGA | CCACCATATACGAGTGGGA | 7063 & 7064 |
| IGLL1 | TGAGGAGCTCCAAGCCAA | ACCGTCAAGATTCCCGGA | 7065 & 7066 |
| IGLON5 | GACTGCTGAGCAGCGGCA | CCAGGGATCCTGGGCGCA | 7067 & 7068 |
| IGSF1 | GGCTCAGAGACAGACGGA | GGAACGGGCAGTTCCACA | 7069 & 7070 |
| IGSF11 | CACAGAGTCAGTCAGCCA | TGTTGACCCGGGACCAGA | 7071 & 7072 |
| IGSF21 | GCTCCACCGACACGCACA | GTGGGGCCAATGGAACCA | 7073 & 7074 |
| IGSF22 | GAATGCCCCTACCCAGGA | ACTGAGCTGGATGGCACA | 7075 & 7076 |
| IGSF3 | TCAGCCTCACCGTCCAGA | GGGTCTCCAGAACCGACA | 7077 & 7078 |
| IGSF6 | ACAGGAGGAGGGACCACA | AGAGGAGTATGAAGGCCA | 7079 & 7080 |
| IGSF8 | GGTGGAGCGACCAGAGGA | GTCGGCATGCTGCACCCA | 7081 & 7082 |
| IHH | GGCTGACAATCACACGGA | AGAAGGCCAACTGAGCCA | 7083 & 7084 |
| IKBKAP | ACTGGACGACTGACCGGA | GTGCACATGGGAGGCGGA | 7085 & 7086 |

FIG. 1 Cont.

| | | | |
|---|---|---|---|
| IKBKB | CTCAGCAGCTCAAGGCCA | CGCCCACAGAGCTCCACA | 7087 & 7088 |
| IKBKE | TCAGCAGCAGCCTGGGAA | GGGAGCATCTGGAGAGGA | 7089 & 7090 |
| IKBKG | TTCCAGGCTGAGAGGCA | GCCTGGGAGACCTCGA | 7091 & 7092 |
| IKZF2 | GCGATTCAGCTACCCAGA | CTGGGGCCACTTCAGCGA | 7093 & 7094 |
| IKZF4 | CGCCAAAGAGGACCCCAA | TGAAGCCATGGCAGCCCA | 7095 & 7096 |
| IL10 | CCCCAAGCTGAGAACCA | AGGGAAGAAATCGATGACA | 7097 & 7098 |
| IL10RA | GCTGCAGTGACCTGGGAA | GGCTAGAGATGAGGGGCA | 7099 & 7100 |
| IL10RB | AGCTGGGGAATGGAGTGA | GCAAGGCGAAGCAGCCGA | 7101 & 7102 |
| IL11 | AGGCTGCGAGCGGACCTA | GCAGGGCCAGGCGGGACA | 7103 & 7104 |
| IL11RA | GCTACACACGCAGCCAGA | ACTGAGGCCAAGAACCCA | 7105 & 7106 |
| IL12A | AGGTGGAGTTCAAGACCA | AGGGCCTGCATCAGCTCA | 7107 & 7108 |
| IL12B | GAACTTGCAGCTGAAGCCA | CCTGGACCTGAACGCAGAA | 7109 & 7110 |
| IL12RB1 | AGGCCAAGGCCACCAGGA | TGGTTCAGGCCAGGACCA | 7111 & 7112 |
| IL12RB2 | CTGCTCCAACTGGCCACA | GGGAGCACCGTCCAGGGA | 7113 & 7114 |
| IL13 | GCATGTCCGAGACACCA | GAAGACGGGCAGCACA | 7115 & 7116 |
| IL13RA1 | CCCGAGGGAGCCAGCTCA | TGCTACACTGGGACCCCA | 7117 & 7118 |
| IL13RA2 | CAAGGGCATTGAAGCGAA | GCATGATCCAAGCCCTCA | 7119 & 7120 |
| IL15 | GGCTTCCTAAAACAGAAGCCA | TTGCAACTGGGGTGAACA | 7121 & 7122 |
| IL15RA | GGCACCCCCTCTCAGACA | TGAGGTAGCATGCCAGGA | 7123 & 7124 |
| IL16 | TCTCAAGGGGACCACGCA | CCAGTGTCACCGTGCAGA | 7125 & 7126 |
| IL17A | CGCTGATGGGAACGTGGA | CCCTGCGCAGGACCAGGA | 7127 & 7128 |
| IL17B | CGCATGGAGGAGTATGAGA | GGACATCCACAGCTGCAA | 7129 & 7130 |
| IL17C | AGGACCGCTATCCACAGA | TGAACGGGGCAGCACGCA | 7131 & 7132 |
| IL17D | GCTGTTCGGCGAGGAGGA | GACGCAGGTGCAGCCCA | 7133 & 7134 |
| IL17F | GGAAGTTGTACAGGCCCA | AGGTGCAGCCAACAGTCA | 7135 & 7136 |
| IL17RA | GGTACCCGCTCATGGACA | ACCAGTCGGGACAGCGGA | 7137 & 7138 |
| IL17RB | GTGGCAAGAGCGAGGGCA | GGGCAGACACTGAGAGCA | 7139 & 7140 |
| IL17RC | CAAAACCCCGGTGGCACA | GTCAGGTTCCAGAGGCCA | 7141 & 7142 |
| IL17RE | GGATACCCAAGCCCAGCA | CTGGACATCTGACCGCCA | 7143 & 7144 |
| IL18 | CGGGCAGATCACCAGA | CCAGGCTAGAGCGCAA | 7145 & 7146 |
| IL18BP | GCTAAGCAGTGTCCAGCA | GGGGCAAGGTTGCCCTCA | 7147 & 7148 |
| IL18R1 | GGCTGATATCCCAGGCCA | CTAGGCACACTACTGCCA | 7149 & 7150 |
| IL18RAP | CCCAGTCCGTCCAACTGA | GGTAGGTCCGGTACAGCA | 7151 & 7152 |
| IL19 | TGCCACCAGAGTCATCCA | GTCGAGCTCTCCCAGGGA | 7153 & 7154 |
| IL1A | TCTGGGAAACTCACGGCA | CCCTGCCAAGCACACCCA | 7155 & 7156 |
| IL1B | GAACTGCACGCTCCGGGA | AGGACATGGAGAACACCA | 7157 & 7158 |
| IL1R1 | GTTGCAGGAGACGGAGGA | CAGCCACATTCATCACGA | 7159 & 7160 |
| IL1R2 | TAAGTGTGAGGGGGACCA | ACACAGCGGTAATAGCCA | 7161 & 7162 |
| IL1RAP | GGGACCTTGAGGAGCCAA | GGCCGGAACCACAGCACA | 7163 & 7164 |
| IL1RAPL2 | ATGAGATACCAGCCACGA | TGAGTAGCGTCAGAGGCA | 7165 & 7166 |
| IL1RL1 | AGTGGAGGGAGGACCACA | TTCTGGGCAGCCAAGGGA | 7167 & 7168 |
| IL1RL2 | CCCTGATCCAGGACGGGA | TGCAGCAGCTGGACCGGA | 7169 & 7170 |
| IL1RN | GACCTGAGCGAGAACAGA | GGGCAGGCGGCAGACTCA | 7171 & 7172 |
| IL2 | GCCCAAGAAGGCCACAGA | TCAGATCCCTTTAGTTCCAGA | 7173 & 7174 |
| IL20 | GTGCAAGCCAAAGATGGA | ATGGCGCAGGAGGCAGCA | 7175 & 7176 |
| IL20RA | GCACACAGACTCGGAGGA | CCCTCCTCTCCGAGCCCA | 7177 & 7178 |
| IL20RB | GGCCTACTGGAGGAGGGA | CGACCACAAGGATCAGCA | 7179 & 7180 |
| IL21 | GCTGAAGTGAAAACGAGACCA | GTCCCCAAGAAGATGACCA | 7181 & 7182 |
| IL21R | CCGGCCTGGATATGGACA | GTGGCGGAGGAATGACCA | 7183 & 7184 |
| IL22 | CCCTATATCACCAACCGCA | TCAGATTGAGGGAACAGCA | 7185 & 7186 |
| IL22RA1 | GGGGAGGAAGGGACACCA | CACACAAGGGACTCCAGCA | 7187 & 7188 |
| IL22RA2 | AAGTGGATGCTGGCAGCA | TGAGTAGCTCCCAGCCGA | 7189 & 7190 |
| IL23A | CCCAAGGACTCAGGGACA | GCTGAGGCCCAGTAGGGA | 7191 & 7192 |
| IL23R | AACGCACTAGGCATGGAA | TGACGGCTGCAGAAGGTA | 7193 & 7194 |
| IL24 | CCATCAGAGACAGTGCACA | GGGAACAAACCAGTGCCA | 7195 & 7196 |
| IL25 | CCCCCAGGACCTGTACCA | GTGGTAGAGCAGCTCCGA | 7197 & 7198 |
| IL26 | CATTGCCAAGCACAAGCA | AGCGTCAACAGCTTGGGA | 7199 & 7200 |
| IL27 | CCCGGAGGAGGAGGAGGA | GCCCAGCCTTGGACAGCA | 7201 & 7202 |
| IL27RA | AGAGGTCCCAAGGCACCA | CAGCTCACAGGGACCCCA | 7203 & 7204 |
| IL2RA | CACGGGAAGACAAGGTGGA | GTTGTGACGAGGCAGGAA | 7205 & 7206 |
| IL2RB | CCTGAAGTGTAACACCCCA | GCGAGATCTCAGGTGCCA | 7207 & 7208 |
| IL2RG | GGACTGACTGGGACCACA | ACCACGGCTTCCAATGCA | 7209 & 7210 |
| IL3 | AGGCCAAACCTGGAGGCA | CGGCCGTGGCCAGGGGCA | 7211 & 7212 |
| IL31 | CTCACTCAGGCCCCTCGA | CAGGGCTGAGACACGGCA | 7213 & 7214 |
| IL32 | TGAGGAGCAGCACCCAGA | CTGCATGGACCAGGGCCA | 7215 & 7216 |
| IL34 | CCCCAGGGCCAAACCTGA | GGGCTGCAAGACTGAGGA | 7217 & 7218 |
| IL37 | CTGGCTGCCCAAAAGGAA | GTCACCCCAACAGGCTCA | 7219 & 7220 |
| IL3RA | CAGGCGTCAACAGTACGA | GAACCGCTGGAGAGTCGA | 7221 & 7222 |
| IL4 | CCACGGACACAAGTGCGA | CGGTCAACTCGGTGCACA | 7223 & 7224 |
| IL4I1 | GACTCCAGTACAGCCGCA | TCGCCGTCAGCAGCACCA | 7225 & 7226 |
| IL4R | GGAGGAGGAGGTAGAGGA | TCCCAGGGCATGTGAGCA | 7227 & 7228 |
| IL5 | GTATGCCATCCCCACAGA | ACAGTACCCCCTTGCACA | 7229 & 7230 |
| IL5RA | CTGCAGAACGACCACTCA | GCCAACAAGCCAGGTGCA | 7231 & 7232 |
| IL6 | GAAAGCAGCAAAGAGGCA | CCAGATTGGAAGCATCCA | 7233 & 7234 |
| IL6R | TCCACCCCCATGCAGGCA | GGAGCGTTCCGAAGGCCA | 7235 & 7236 |
| IL6ST | GCGCTGTGGAGACGCGGA | ACAAGGCTTGCACTAGCCA | 7237 & 7238 |
| IL7 | GCTCGCAAGTTGAGGCAA | TGGGCTTCACCCAGGGCA | 7239 & 7240 |
| IL7R | TAGCTCAGGGGAGATGGA | ATCGGGGAGACTGGGCCA | 7241 & 7242 |
| IL8 | AGCCACCGGAGCACTCCA | AGGCTGCCAAGAGAGCCA | 7243 & 7244 |
| IL9R | CTGGAGACCCAGCAAGGA | ACCGAGCCTTGCTGAGGA | 7245 & 7246 |
| ILDR1 | CCCTCATCCAGTGAGGCA | GGAGGGCAAGGGAGGAGA | 7247 & 7248 |
| ILDR2 | CTGCCCATGCTGCCCAGA | ACACCGGAGACAGAGGGA | 7249 & 7250 |

FIG. 1 Cont.

| | | | |
|---|---|---|---|
| ILF2 | ACAGGCGCTGCTTGCAGA | GTGAGAGGATTCGGACGA | 7251 & 7252 |
| ILF3 | GGCGGCTCCTCATACCAA | TAGGAGCTGGGAGGGCCA | 7253 & 7254 |
| ILK | GCTGGCAGGGCAATGACA | GGTGGAGACTGGCAGGCA | 7255 & 7256 |
| ILVBL | CCTCAGCCACAGCAGCAA | CCCACATCTCCCTGCACA | 7257 & 7258 |
| IMMT | AGAGCTCTGCCCTGAGGA | GCTAGCTCCAGATCACCA | 7259 & 7260 |
| IMP3 | GTGGAGCAAGGGCACGTA | CTTGGACGAGTCCACCCA | 7261 & 7262 |
| IMP4 | GAAGACAGACCACCGCAA | GTAAGGGTGCCAGCGCCA | 7263 & 7264 |
| IMPA2 | GCTGCATGCCAAGGCGCA | GTCGAGGGGTCCACCCGA | 7265 & 7266 |
| IMPDH1 | TGACAGCAGCCCAGGCCA | TGGAGGCTCCAAGGGCCA | 7267 & 7268 |
| IMPDH2 | TGCCAAGAGCTTGACCCA | TGGAGGCTATGGACGCCA | 7269 & 7270 |
| IMPG1 | GGTACCAGAGCTCAGCGA | GGTCGTTGGAGAAGGCCA | 7271 & 7272 |
| IMPG2 | CTCCACCCTGCTAGAGGA | GCCAAGCCACACTAACCA | 7273 & 7274 |
| INCENP | GCACCTGGAGGATGAGGA | AGGTCGGGGTCATGAGCA | 7275 & 7276 |
| ING1 | TCGACCCCAACGAACCCA | GCACTTGGGACAGTACCA | 7277 & 7278 |
| ING2 | TCCTGACCGGGGAGCGGA | CATGTCGTGGGGCAGCGA | 7279 & 7280 |
| ING3 | AACTCCGGCGACAGCGA | GTGAAGCGGTCCCGCAGA | 7281 & 7282 |
| ING4 | TGGATCCCAACGAACCCA | TTGGGAGCAGCGTGGGCA | 7283 & 7284 |
| ING5 | CAGGAGGACATCAGAGGA | CGTGGTAAGGTCCACGCA | 7285 & 7286 |
| INHA | CCCAGTGGAGGGGAGAGA | TCCACCGTTCCCAGCCCA | 7287 & 7288 |
| INHBA | CCACCAAGCTGAGACCCA | ACCCACACTCCTCCACGA | 7289 & 7290 |
| INHBB | TGGTGAACCAGTACCGCA | GCACGTCCCGCTTGACGA | 7291 & 7292 |
| INHBC | GGCAGTGCCCACTACACA | GGCCGTGGGTACACAGCA | 7293 & 7294 |
| INHBE | CACTCCTCGGTCCCACCA | TGGTGCTCAGCCAGGAGA | 7295 & 7296 |
| INMT | CGATGTCCACCTGGGCAA | CCACCATGTAGGACGGGA | 7297 & 7298 |
| INPP4A | GAACGTGCATGCCCGGAA | GCTCCAGTGTCACCGACA | 7299 & 7300 |
| INPP4B | CCCCAAGACCAACCCCCA | TCCCCACATTGGCCCACA | 7301 & 7302 |
| INPP5A | TCCGAGACAACAACGGCA | AGCACCAGCTCCTTGGCA | 7303 & 7304 |
| INPP5D | CACAGGAGTCAAGGCCCA | GAAGGAACTCAGGGACCCA | 7305 & 7306 |
| INPP5F | TTCTGCAACAGGCCCACA | AAGCATGCTGGAAGCGGA | 7307 & 7308 |
| INPPL1 | TGGAGCGGGAGAAGCACA | GGTCACACCATGAGGGCA | 7309 & 7310 |
| INS | CTAGTGTGCGGGGAACGA | CCAGGGCCAAGGGCTGCA | 7311 & 7312 |
| INSIG1 | CCCTGCTGCGGGACAGCA | GTCAAGGACAGCTGGACA | 7313 & 7314 |
| INS-IGF2 | GTCTGGACGCCACAGCCA | AAGAGGACCGGGGAGTCA | 7315 & 7316 |
| INSL3 | GACCGGAGGCGACCGTGA | GGCAGGGGCTGCAGGCCA | 7317 & 7318 |
| INSL5 | GAGGAAAATCCAGCGCAA | GGGCATCTGTCCACCCCA | 7319 & 7320 |
| INSL6 | ACTCTGCGGCCATGCCAA | GTGCAATCAACCGTGAGA | 7321 & 7322 |
| INSM1 | CAGCAAGGGCGCTCAGGA | GCACGGGCACCTGCAGGA | 7323 & 7324 |
| INSR | CGGTCAACGAGTCAGCCA | TGGACACCACTCCCAGGA | 7325 & 7326 |
| INTS3 | CTACCTGAGGGCCAGCAA | AGGGCGTGAGGTGGCACA | 7327 & 7328 |
| IP6K1 | CCAGCTGGACACAGGGCA | GCCTGCCGCTCCAGCACA | 7329 & 7330 |
| IP6K2 | CTGACTGAGCTCAAGGCA | AAGTCGATCATGCGCACA | 7331 & 7332 |
| IPCEF1 | GAAGCTGACAGCCAGGAA | GTCATCAGGGGCAGGCGA | 7333 & 7334 |
| IPO11 | CAGTGGGAGACACAGCCA | TGATGAGCCCTGCACGCA | 7335 & 7336 |
| IPO4 | CAGGAAACCAGAGCCCCA | AGAAGCTCGGGAGCCACA | 7337 & 7338 |
| IPO7 | CCCAACAGCTTGAGGGAA | AAGGGGTAGTAGCTGCCA | 7339 & 7340 |
| IPO9 | GTGGACAAGCCGACAGCA | ACTTAGAGCGGGTGCGGA | 7341 & 7342 |
| IQGAP1 | GCCTGGAGATGAGAATGCA | TGGCATCACGGATAGCA | 7343 & 7344 |
| IQGAP2 | CCACAAGCTCAGGACCCA | TGCCATTCGGAACCAGGA | 7345 & 7346 |
| IRAK1 | TCAACCCTGCCCGACAGA | GGAGGGAGCTGGACGACA | 7347 & 7348 |
| IRAK2 | CACAGGCACGGGAAGCCA | TGCAGGTACTCGACGGCA | 7349 & 7350 |
| IRAK3 | GGCCTGAGGATAGACAGA | CACAAGAAGAACTGGGCA | 7351 & 7352 |
| IRAK4 | AGGGTGCAGCTAATGGCA | TCCACAGCTGGAAGTCCA | 7353 & 7354 |
| IREB2 | GGCTGCCAAAGGACCGTA | CTCTACCGGAGAGGCCCA | 7355 & 7356 |
| IRF1 | AGCTGTAAGGAGGAGCCA | GGATGGAGGGCAACCGGA | 7357 & 7358 |
| IRF2 | CGGCCTTCTAAGAAAGGA | GTTGAAGTCAGGACCGCA | 7359 & 7360 |
| IRF3 | CTTCACGGAAGGAAGCGGA | ACAACCTTGACCATCACGA | 7361 & 7362 |
| IRF4 | GCCAGCTGGACATCTCAGA | AGGGGTGGCTCATGGA | 7363 & 7364 |
| IRF5 | CAGACCAACACCCCACCA | GTCGAGCTGCTACAGGCA | 7365 & 7366 |
| IRF6 | CCCACCAGAAAGGACAGA | GAGATCTGCAGGCGGACA | 7367 & 7368 |
| IRF7 | GGAACTGTGACACCCCCA | TGGACAGGCAGAGGCTGA | 7369 & 7370 |
| IRF8 | CTTCCGAGAGCTGCAGCA | ATCACAGAGCCGGCTCCA | 7371 & 7372 |
| IRF9 | CATCCTAGTGGCCAGCAA | TCTGAAGAGCTCCACGCA | 7373 & 7374 |
| IRG1 | GGAGCATGAAGCCCGTCA | GAGGGTACTCCAGCTCCA | 7375 & 7376 |
| IRGM | AGCCTCAGCAGATGGGAA | GGACATCCCATTGCCAGA | 7377 & 7378 |
| IRS1 | TACGTGGACACCTCGCCA | AAGGCGCTCATGCCCCCA | 7379 & 7380 |
| IRS2 | CGACTTCAGCTCCCCCAA | CGGCTGCAGAGACGACGA | 7381 & 7382 |
| IRS4 | GGGCTCAGGAGGAAACCA | TGGCCACCACCTGAGCCA | 7383 & 7384 |
| IRX6 | CGACTCTCAGTCCCCAGA | TCCAGACGGGTACTGGCA | 7385 & 7386 |
| ISCA1 | GCAGCCCTCACCCTGACA | CCCCTGGTTCGGACACCA | 7387 & 7388 |
| ISCU | GGAAAGACGGTGGAGGAA | CCAGCATGGAGCAGTGCA | 7389 & 7390 |
| ISG15 | GCAAGTGAGCGGGCTGGA | CAGGGGCTTGAGGCCGTA | 7391 & 7392 |
| ISG20 | GGGTCACCCCTCAGCACA | TCAGGTCATGACCCACCA | 7393 & 7394 |
| ISG20L2 | CCCAGAAGTTGCCACGGA | CAATGCTACATCGAGCCA | 7395 & 7396 |
| ISLR | GACAACGAGGTGCAGCCA | GCCTCAGGGTTCCCAGCA | 7397 & 7398 |
| ISLR2 | CGTACCTCGAGTCCGAGA | TGGACTGGGACTCCACCA | 7399 & 7400 |
| ISM1 | CCGCATCAAGCGCAAGGA | GGGACAGCATGGAGCGGA | 7401 & 7402 |
| ISM2 | GCAGTGGGAACTGCAGCA | TGCCAGGACAGGAGGGCA | 7403 & 7404 |
| ISOC1 | AGTTGGCCGAGGAGTCGA | ATCCCGGTTCGAGCGAGA | 7405 & 7406 |
| ITCH | CAATGGGAAGACCCCAGA | GCTGACACCAGAACCGGA | 7407 & 7408 |
| ITGA1 | ACTGCCATATGGAGGGAA | GGGTGACACGGTACTGCA | 7409 & 7410 |
| ITGA10 | CCTCAGAGAGAGAGCCCA | GACCTGGCTCAGGAGAGA | 7411 & 7412 |
| ITGA2 | AGAGTTGCCCCGAGCACA | GCTTCAAGGGCAGGGCTA | 7413 & 7414 |

FIG. 1 Cont.

| | | | |
|---|---|---|---|
| ITGA2B | GATGGACGCAGCCAACGA | CCAGCTCACACAGCACCA | 7415 & 7416 |
| ITGA3 | CAGGCCATCATCCCCACA | GATGGGGCACTCTAGCCA | 7417 & 7418 |
| ITGA4 | AGCCAGCATACTACCGAA | GCATTGAGGTCCACAGCA | 7419 & 7420 |
| ITGA5 | GCCTCAGAAGGAGGAGGA | TTCCAGAGCCTGGGGACA | 7421 & 7422 |
| ITGA6 | GGCTGCCAAATGCAGGCA | GCATCAAGATCCCAGCGA | 7423 & 7424 |
| ITGA7 | CATGCAGTCTGAGCGGGA | TGAGGAAGGCAGAGCCCA | 7425 & 7426 |
| ITGA9 | GATGGCTGACGTGGCCAA | CGCTTCACATGGGCCACA | 7427 & 7428 |
| ITGAE | CATGCCCACAGAGGGAGA | CAGTGTAGCGGTCCAGGA | 7429 & 7430 |
| ITGAL | TGGCAGAGGTGTCCCGAA | ATGGAGGGGCTTCAGGCA | 7431 & 7432 |
| ITGAM | CGAGTACGTGCCACACCA | CAGCAGGGTGAACACGGA | 7433 & 7434 |
| ITGAV | GCAAGGTGAGCGGGACCA | GCACTGAGCAACTCCACA | 7435 & 7436 |
| ITGAX | GGGTCAAGACCTCACCCA | ACCCCCACCCAGAGCACA | 7437 & 7438 |
| ITGB1 | AGGTAGAAAGTCGGGACA | ATTCCAGCAACCACACCA | 7439 & 7440 |
| ITGB1BP1 | CAGTTCCCAAAGTAGCGA | GTGTCGAGGCTGGCCACA | 7441 & 7442 |
| ITGB1BP2 | TGGCATCCAGACCCTGGA | GGCCATATACAGTCACCA | 7443 & 7444 |
| ITGB1BP3 | GAGTGCAAGTGGAGGAGA | CCACACCGTTGGCCTCCA | 7445 & 7446 |
| ITGB2 | TGAGCGCTACAACGGCCA | GCATACGTTGCAGCGGCA | 7447 & 7448 |
| ITGB3 | GGGAGCCCTACATGACGA | CGGCAAGGCCAATGAGCA | 7449 & 7450 |
| ITGB4 | GGAGGACCAGAAGGGCAA | CCGTTGAAGCTGCAGCGA | 7451 & 7452 |
| ITGB5 | GCAGTGCCAATGCACGGA | TCCCAGAGTGGAGCAGCA | 7453 & 7454 |
| ITGB6 | ATCCCTCCTGCAGCGGAA | TCCAGCCGCTCCTGCACA | 7455 & 7456 |
| ITGB7 | ATGCGAGAGACACCGGGA | AGATAGGGGCCAAGGCCA | 7457 & 7458 |
| ITGB8 | TTCAGCAGCAGCCCAGCA | GTTCACAGAAGCGGCCGA | 7459 & 7460 |
| ITGBL1 | TGTCAGCTGAGGAGAGCA | CGGCGATCTCCTGGAGGA | 7461 & 7462 |
| ITIH1 | CCACGATGGTGGTGAGGA | TCGATGAGTCCAGCCCCA | 7463 & 7464 |
| ITIH2 | AGAAGCCAGAGGCCAGCA | AGCTGTAGAGCTGAGGCA | 7465 & 7466 |
| ITIH3 | CTGGCGACAAGAGAGGCA | GCACGGCCCTGTTCCACA | 7467 & 7468 |
| ITIH4 | CCGGCCTGAAGATGACCA | CTCCAACGTGGCTGGAGA | 7469 & 7470 |
| ITIH5 | CCCCTCCAAATGGCCACA | GGCGTTGGCAGACACGGA | 7471 & 7472 |
| ITK | GCCTACCTGGAAGAGGCA | GCACACCAAATGACCACA | 7473 & 7474 |
| ITLN1 | GGACGGCAACTGGGCCAA | CCAGTGCTGCATGGGGGA | 7475 & 7476 |
| ITLN2 | GGATGGCAACTGGGCCAA | CCAATGCTGCATGGGGGA | 7477 & 7478 |
| ITM2A | AAACTGGCGAGTGGCAGA | AGAGGTCTCTGCGACGAA | 7479 & 7480 |
| ITM2B | GGACTGCAAGGACCCAGA | AGCTGGGGCATCTGCAGA | 7481 & 7482 |
| ITPA | ACCCAGAGGCTGCCAGGA | CCCGGAAGCGATGGGAGA | 7483 & 7484 |
| ITPK1 | AGGAGGGCCTGAACGCCA | GTGAGGGCCTCTGGACCA | 7485 & 7486 |
| ITPR2 | CGTACGACCTTGCGCCAA | CACTGTCCTGCACCCCCA | 7487 & 7488 |
| ITPR3 | GTGGTCTGGAGAGGGACA | TTCACGCGGACCAGCACA | 7489 & 7490 |
| ITSN1 | ACGACTACACCGCGCAGA | TGGATGGGAAGAGCCCCA | 7491 & 7492 |
| IZUMO1 | CCACCCTGACCAAGCCCA | TGGAATTCACAGAGCCCA | 7493 & 7494 |
| IZUMO2 | GGGCCGTGCTGATGGGCA | AGGACGCCACAAGGTCCA | 7495 & 7496 |
| IZUMO4 | GCGAAACATCTTCCGGGA | AGTTCAGGAGGCCCTGGA | 7497 & 7498 |
| JAG1 | GGTGCCAAGTGCCAGGAA | GCAAGGTCGAGGGCCACA | 7499 & 7500 |
| JAG2 | GCGACCAGTACGGCAA | CGGGGTAGGGGACACA | 7501 & 7502 |
| JAGN1 | GCTCTACCGCCATGGCAA | GCCAGGCATGCACTTGCA | 7503 & 7504 |
| JAK1 | CTGCAGGTATGACCCCGA | AGGCTTCCCGAAGGCAGA | 7505 & 7506 |
| JAK2 | TGGCAGCAACAGAGCCTA | CACTGCCATCCCAAGACA | 7507 & 7508 |
| JAK3 | GATGGGATGTGAGCGGGA | GGGTGAGCAGTGAAGGCA | 7509 & 7510 |
| JAKMIP3 | TGATGCCCTGCAGCAGGA | TCCACTGCTCCACGGCCA | 7511 & 7512 |
| JAM3 | GGTGTGAGGAGCAGGAGA | CCAACGTGATCAGGGCCA | 7513 & 7514 |
| JARID2 | CCTGGATGAGCTCAGGGA | CGCAGAGCACACTCCAGA | 7515 & 7516 |
| JAZF1 | GGACCACAGAGAGTGCCA | ACATCCAGGAACTGGGCA | 7517 & 7518 |
| JHDM1D | GAGGCAGGCAGACAGCAA | TATCAGGGACCTCCACCA | 7519 & 7520 |
| JKAMP | CGGGGAAAAAGAGTTCCA | CACCAACTGGATCACTCA | 7521 & 7522 |
| JMJD1C | AGGCTGTCTCACAGGGCA | GGTAGTATCGGCAGCAGA | 7523 & 7524 |
| JMJD4 | CATGCCCGACTGGCACCA | GCGCAACCAAGGAGGCCA | 7525 & 7526 |
| JMJD5 | AGATCGCTGGCTGCCGAA | GGCTGCAGTAGTCGGGGA | 7527 & 7528 |
| JMJD6 | GAAGCAAGAGCACCCCGA | GAGTCGGAGTCTGACGAA | 7529 & 7530 |
| JMJD8 | CACTACTCCCCACCCCCA | CCAGCGCTTACGACCGTA | 7531 & 7532 |
| JMY | CGAGATGACCGAGCAGGA | GGTGAAGAGCACCTGGGA | 7533 & 7534 |
| JSRP1 | GAGGCAGCACTCCAAGCA | GGGCCTCGAACTTAGGCA | 7535 & 7536 |
| JUN | GCAGGCCCTGAAGGAGGA | CCATGTCGATGGGGGACA | 7537 & 7538 |
| JUNB | TCAAGGAGGAACCGCAGA | GCAGCCGCTTGCGCTCCA | 7539 & 7540 |
| JUP | GCGTGCTGGTGACAAGGA | GCACAGAGTTCTGGGCCA | 7541 & 7542 |
| KAL1 | GCGTGTGCCCACAACAGA | ACCTGCTTCGCCCAGGCA | 7543 & 7544 |
| KALRN | CTCCAAGGCAGTGCACCA | CCGGGCTCGATGTAGGGA | 7545 & 7546 |
| KAT2A | AGCGCAAACAGGCCCAGA | CCAGGAACGCTCTCCACA | 7547 & 7548 |
| KAT2B | CCAGGGATGAGGCGGCAA | CTGTAGGCCAACCAGCCA | 7549 & 7550 |
| KAT6B | CCCCAGCACCAAAGGCAA | TAGGAGAGACGGCCCAGA | 7551 & 7552 |
| KATNA1 | AGCAAAAGGCAGGGAGGA | ATTGCCATCAAGGACGCA | 7553 & 7554 |
| KATNB1 | CGCTGTGGCCATCAACGA | GCAGGACGGTGGTGCACA | 7555 & 7556 |
| KAZALD1 | GGAAGGATGGCTTGGACA | CCTCATCACTGGGACGCA | 7557 & 7558 |
| KBTBD11 | AGTGCCCGTGCAGCAGCA | CAGGCAGTGGTATCGGGA | 7559 & 7560 |
| KCNA1 | CCGAGAAACTGAGGGGGA | GTAGAGGAACTGCGGCGA | 7561 & 7562 |
| KCNA3 | CGAGCTGGCCGAACGACA | GCAATCCCAGCTCCCGCA | 7563 & 7564 |
| KCNA6 | ACGGGGACATGTACCCCA | TGGAGACGATGACGGGCA | 7565 & 7566 |
| KCNAB1 | TACTGGGGCACCTCGAGA | TCCACAGGCAAGTGGAGA | 7567 & 7568 |
| KCNC2 | CCCAAACATGGTCAGGCA | GAGCTTGCCTGAGGAGCA | 7569 & 7570 |
| KCND1 | GGTGCCCAAGAACGACGA | AAGCCCAGCTCAGAGGCA | 7571 & 7572 |
| KCNE1 | CAGTGACGGCAAGCTGGA | GCCAGGCATCGGACTCGA | 7573 & 7574 |
| KCNE3 | TGGGGCCAGACAACCAGA | AGCGGGTGTATCCCAGGA | 7575 & 7576 |
| KCNG2 | CCGTGGGCTACGGCGACA | GCTCGGAGTAGGAGCGCGA | 7577 & 7578 |

FIG. 1 Cont.

| | | | |
|---|---|---|---|
| KCNG4 | CTACGTGGCCGAGAAGGA | TGAGGATCCCGCTCAGGA | 7579 & 7580 |
| KCNH1 | AGGCTGGCAGCTGAGAGA | TGGCAGGACTCTCACGCA | 7581 & 7582 |
| KCNH2 | GGTCCTACACCAACGGCA | AGTACAGGGCGGTGAGCA | 7583 & 7584 |
| KCNH4 | TGTGCGTCCAGACCACCA | CTCAAGTCCAGGAGCGCA | 7585 & 7586 |
| KCNH8 | GGAGCAGCCCCCAACGAA | TCCGAAGAGGAGCAGACA | 7587 & 7588 |
| KCNIP2 | CTCAAGGAGACTCCAGCA | CTCCCGGAGTGCAGGGTA | 7589 & 7590 |
| KCNIP3 | GGGAGATGCCACCACCTA | AGCAGGATGGAGAGGCCA | 7591 & 7592 |
| KCNJ1 | ACCTGCCAAGTCCGGACA | AGGCACATGGCACAGTGA | 7593 & 7594 |
| KCNJ11 | ACCAGGTGGACATCCCCA | CGCCTTCCAGGATGACGA | 7595 & 7596 |
| KCNJ12 | CGCTGGACCAGATCGACA | CCACCATGCCTTCCAGGA | 7597 & 7598 |
| KCNJ2 | GCCAAGATGGCAAAGCCA | GAACATGAGCTTCCACCA | 7599 & 7600 |
| KCNJ8 | GGCTCACAGAAGGGCAGA | ACCACCTGGATGCGCACA | 7601 & 7602 |
| KCNK15 | CACCATCGGCTTCGGCGA | AGGTTGAGGAAGGCGCCA | 7603 & 7604 |
| KCNK2 | GGAGTGCCCTGGACGCCA | ATGCTCAGGACAGCAGCA | 7605 & 7606 |
| KCNK5 | GCGCAGATCACGTGCACA | AGATCCAGAGCTCCACGA | 7607 & 7608 |
| KCNK7 | TCAGCTCGCTCAGCACCA | AGGTCTCCACTGCCAGCA | 7609 & 7610 |
| KCNMA1 | CTGGGGTCAACATCCCCA | TCCAGGACACTGACGGCA | 7611 & 7612 |
| KCNMB1 | CTCGGGGGAACGAAACCA | CGCCAGGATGGACAGGTA | 7613 & 7614 |
| KCNMB2 | CCGAAGAGTCTCAATGCA | AACGTACACCTGGAGGCA | 7615 & 7616 |
| KCNN3 | TGGAGCATCTCACCGCCA | GGCCTCGATGATGGCAGA | 7617 & 7618 |
| KCNN4 | ACGCTTCCTACCGCAGCA | CCACGTCACCATAGCCGA | 7619 & 7620 |
| KCNQ1 | ACAGCTGCGGGAACACCA | GCTCAATGACGTCCCGCA | 7621 & 7622 |
| KCNQ2 | GCAGCACAGGCAGAAGCA | GCAGGTCTGTGCGCGAGA | 7623 & 7624 |
| KCNQ3 | CGTATGTGGAGAGGCCCA | TGACCGACATCAGGGACA | 7625 & 7626 |
| KCNQ5 | GGGTCCCGAAGAGACAGA | TGAGGCAAGCTGAGGGCA | 7627 & 7628 |
| KCNT1 | GGAGGACTACATGGCGGA | GGCGGAACATGAAGGCCA | 7629 & 7630 |
| KCTD11 | GGGACCCCTGCACCCACA | CATACTCCACCTCGGGGA | 7631 & 7632 |
| KCTD8 | GCTCAACGAGAGCCGCGA | CCGAGGAGTTACACGCCA | 7633 & 7634 |
| KDELC1 | CATGTGGCCAAATCCCCA | CTGGATCCACAGCAGGGA | 7635 & 7636 |
| KDELC2 | GAGACAGCCGAGAGGAGA | CCAGACTGTCGCCCAGCA | 7637 & 7638 |
| KDELR3 | TCTCTGGGAAGAGCCAGA | GGCCAATGACTGGGACCA | 7639 & 7640 |
| KDM1A | CTGAAGCAGCAGCCACCA | GGATCCCAGAACACCCGA | 7641 & 7642 |
| KDM2B | GGCCAGGTCAGATGGACA | GATGATGAGCCGCAGGGA | 7643 & 7644 |
| KDM3A | GGCCTCAAGGACTAACCA | GGTCTTGCAAGCACAGCA | 7645 & 7646 |
| KDM3B | GGCCAATGTTGGGGACCA | TCTCCCGTACACCACGCA | 7647 & 7648 |
| KDM4B | GCCAGGTGGTCATCACCA | GGGTCCCAGCTGGACACA | 7649 & 7650 |
| KDM5A | GCAGGCTCTAGCCACAGA | GAGCCGCCTGTTCCACCA | 7651 & 7652 |
| KDM5B | CCTGCAGCCAGAAGGAGA | GCCATCTCTGGGGAGACA | 7653 & 7654 |
| KDM5C | GCCCTCACTTGCAGCAGA | GTGCGGACAACTGGCACA | 7655 & 7656 |
| KDM6A | CCACCTCCAAGACCACCA | AGAGCTCCAGCAAGGCCA | 7657 & 7658 |
| KDM6B | GGGTAACATCCACGGGCA | CTCGTGCACCGCGAACCA | 7659 & 7660 |
| KDR | AGCCCAGTCAGAGACCCA | ACAGGTGAGGTAGGCAGA | 7661 & 7662 |
| KDSR | CCACCAGACACAGACACA | TACTGGAGCCATCCCACA | 7663 & 7664 |
| KEAP1 | CCATGAAGCACCGGCGAA | GCTCCATGGTGACAGCCA | 7665 & 7666 |
| KEL | GAGGCTGTTACGGCACCA | CACCACGTGCACAGCGGA | 7667 & 7668 |
| KERA | GCAGCTAAACATGGCCAA | GAGCACTGATTCGGGGAA | 7669 & 7670 |
| KHDRBS2 | CCCCCACCACCTGGACGA | GGGCTCGAGGGGTAGGGA | 7671 & 7672 |
| KHNYN | GCGGCTCCACAATGGGAA | GTCACCCCGGTCTCCACA | 7673 & 7674 |
| KHSRP | CGTAGAGATCTCCCGGCA | GCCTGGTCCAACTGGGCA | 7675 & 7676 |
| KIAA0100 | TGGGAAGGGTGTGGCACA | ACTCCAGACAGGGCAGCA | 7677 & 7678 |
| KIAA0182 | GCTCCGTGCCATGAAGCA | CCAACCGGCTTCTCCACA | 7679 & 7680 |
| KIAA0195 | GCTGTGGACACACAGGGA | CCACAAGGACCAGGGACA | 7681 & 7682 |
| KIAA0226L | TCCACCACTCAAGAGGGA | TACCGGAGCCGCTTCACA | 7683 & 7684 |
| KIAA0319 | CTGCTGAAGTGGCCCGAA | AGGGGGTCGCAGTGACCA | 7685 & 7686 |
| KIAA0556 | GGTGAACAGGACCCAGGA | CTTCACGCCTCGGAAGGA | 7687 & 7688 |
| KIAA0664 | GGTGTTCGGGGAAGACCA | CGTTCTCCAGGAAGCGCA | 7689 & 7690 |
| KIAA0754 | GCTCAGGGGTTAGAGGGA | TGCAGCCAGCCCTTCAGA | 7691 & 7692 |
| KIAA0922 | CGCCCTACCTCACAAGCA | GGGGTTGATGGGGCAGCA | 7693 & 7694 |
| KIAA0947 | GGACTCCAGTGGGACACA | ACAGCCAGGGCCTCACCA | 7695 & 7696 |
| KIAA1024 | CTCCAACTCGCCCAGAGA | TGAACACCTGCTCCACCA | 7697 & 7698 |
| KIAA1199 | TACGTCTCCAGAGGCCCA | TCACCACAGGGATGGGCA | 7699 & 7700 |
| KIAA1324 | GCAGTCGGTGATGGCAGA | GGTCCTCTGGAAGGCCCA | 7701 & 7702 |
| KIAA1468 | GAGGCCAGATGATGAGCA | GAACCAAGGAGCTACGGA | 7703 & 7704 |
| KIAA1549 | GCAGGGCACAGATGCAGA | CTCAGCGTCGGCAGGACA | 7705 & 7706 |
| KIAA1598 | TGCGTCGCAGAAAGGTGA | CACTGGATACAGAACCCA | 7707 & 7708 |
| KIAA1804 | GGAAGTGGTCGTGAGCCA | GCAGAGTGGCAGTGCAGA | 7709 & 7710 |
| KIAA2022 | CCTTGGGGAAGGAGAGCA | TCTGCCATACCAGAGGCA | 7711 & 7712 |
| KIF11 | GATGGCAGCTCAAAGCAA | AGACACTGGAAGACAGCA | 7713 & 7714 |
| KIF14 | GACCCAGACCAAGACAGA | GCCGTAGAGCAGCGCTCA | 7715 & 7716 |
| KIF15 | GGAAGCCCTGATTCAGGA | TGGGGATCCTCAGCAGCA | 7717 & 7718 |
| KIF18B | CCTGCTCCAAGCAGCCAA | CACAGCTCCTGAGCCAGA | 7719 & 7720 |
| KIF1A | TCAGTGCCAGCGAGAGCA | CGTACCGCCCTTCAACCA | 7721 & 7722 |
| KIF1B | CGCCATCACACCTAGCGA | GCAGGCACTTGGTAGCCA | 7723 & 7724 |
| KIF1C | GGCCCAGGATCATGAGGA | AGCCAGCGAAGACGACCA | 7725 & 7726 |
| KIF20A | GCGCCTTGGTACCAACCA | AACGCCGTGAGCGTAGGA | 7727 & 7728 |
| KIF20B | GGGCTAACCAATTCAGGA | GTTCGAGGCAGAATGCCA | 7729 & 7730 |
| KIF21A | CCCGAAGGAGAACCACCA | GGTAAGCCAGGTGGGGGA | 7731 & 7732 |
| KIF22 | GCCCAGAAGGCTGAGGAA | GCTGTAGGGGCATCACCA | 7733 & 7734 |
| KIF23 | CGCTCTGCAGGAGACAGA | GTGATGGCATGAGGGACA | 7735 & 7736 |
| KIF27 | CAGGCTGGTGTCAGCCAA | CACAACACTGGTAACCCA | 7737 & 7738 |
| KIF2A | GGGATTACAGGAACGGGA | AACACTGCATGGCTCCGA | 7739 & 7740 |
| KIF2C | GGCGCTGATTCCAGGCAA | GCTTGCTGGGCCAGAGCA | 7741 & 7742 |

FIG. 1 Cont.

| | | | |
|---|---|---|---|
| KIF3B | CCATTGAGCCAGCACGCA | GCAATGGCTGGACCCTCA | 7743 & 7744 |
| KIF3C | GCGTCAGTAGCAGCCAGA | AGACAGCTGGAGGGGACA | 7745 & 7746 |
| KIF4A | CGGACCCAGGATTCCGAA | GACAGCACCTGCTCCACA | 7747 & 7748 |
| KIF5A | CTCTACCTGCAGGCCACA | CCTCATAGCCACACGGCA | 7749 & 7750 |
| KIF5B | GAGGGCATTCTGCACAGA | CTCCACCTCGCACTGCCA | 7751 & 7752 |
| KIFAP3 | GAAACACAGGCTCCAGCA | ACCATCTCCAGCCACTGA | 7753 & 7754 |
| KIFC2 | GGCGTGAGCTACAGCAGA | CAGATGACAGTGCCCCCA | 7755 & 7756 |
| KIFC3 | TGCAGAGCGTGGACGACA | AGCCAGCCAAGTCCACCA | 7757 & 7758 |
| KIR2DL1 | ACCCCCGACACCTGCACA | AGCACCAGCGATGAAGGA | 7759 & 7760 |
| KIR2DL3 | CGGAACATTCCAGGCCGA | CGTATGGAGAGTCACGGA | 7761 & 7762 |
| KIR2DL4 | CAGGAGGTGACATACGCA | AACGCTCTGGGCTCAGCA | 7763 & 7764 |
| KIR3DL1 | GTGCGCAAGGTCAACAGA | CGTAGGGAGAGTGACGGA | 7765 & 7766 |
| KIR3DL2 | AGGCAGGAGAGAACGTGA | CCTTGGGCACTGCACGGA | 7767 & 7768 |
| KIR3DL3 | CGGTTCAGGCAGGAGAGA | TTGACCCTCAGCACCGCA | 7769 & 7770 |
| KIRREL | GTCGGTGACTCAGGCAGA | AGCGTGGATAGCACCCCA | 7771 & 7772 |
| KIRREL2 | GGCCGATTCTGCAGGCAA | CCACCGACGGAAGACGCA | 7773 & 7774 |
| KISS1 | AGCCAGCTGCTACTGCCA | CGCCCTGGGGTGCGGGGA | 7775 & 7776 |
| KISS1R | GGCTACGTCCGGACCCAA | GAAGAGCGGCACGAGCCA | 7777 & 7778 |
| KIT | GGATGGCACCTGAAAGCA | AGGGCTGAGCATCCGGAA | 7779 & 7780 |
| KITLG | ACTGAAGGGATCTGCAGGA | ACATCCATCCCGGGGACA | 7781 & 7782 |
| KLC1 | AGGACACGACCACCCGGA | TCACGAATAGCCAAGGCA | 7783 & 7784 |
| KLF1 | CGCATCTGCGCACGCACA | CGCGAATCTCCAGCCGCA | 7785 & 7786 |
| KLF10 | GAGGACGCACACAGGAGA | CCGGTCACACATGGGGCA | 7787 & 7788 |
| KLF15 | GGTCAACATCCAGGGGCA | CCCATGAGGAGACCGGCA | 7789 & 7790 |
| KLF17 | CCCTCAGCAAGAGATGACGA | GGAAGCCGAGACTGGCA | 7791 & 7792 |
| KLF2 | CCGAAAGCACACGGGCCA | ATGTGCAGCGCCAGGTGA | 7793 & 7794 |
| KLF3 | CGCGGCATGGAATACGGA | CCTCCGATAAGGAGACCA | 7795 & 7796 |
| KLF4 | CCAGCAGGACTACCCCGA | GCATCTGATCGGGCAGGA | 7797 & 7798 |
| KLF5 | GGCCACCTGTACCAGCTA | GCAGTCTGCGGAACAGCA | 7799 & 7800 |
| KLF6 | GCGGACGCACACAGGAGA | CCTGTCACAGTGGGAGCA | 7801 & 7802 |
| KLF7 | AGCCGTCAACCAGGCCCA | ACCGTGCCATCCACGGCA | 7803 & 7804 |
| KLF9 | CGCCTCCGAAAAGAGGCA | CAGCTCGTCTGAGCGGGA | 7805 & 7806 |
| KLHDC3 | CCGAAGGGGAAGGGGCCA | ACGGCCAGTTTGCACAGA | 7807 & 7808 |
| KLHDC4 | CTGAAGCCAGAGGACGGA | CGTCACAGACACCCCCGA | 7809 & 7810 |
| KLHDC8A | AGGTCGCCTCTACCGGCA | GCCACTATGACCCGTCCA | 7811 & 7812 |
| KLHL11 | TGACGCAGTGGAGAGACA | CGAGGCAATAGTGACACA | 7813 & 7814 |
| KLHL22 | CAGCTGCACGTCTGGACA | GAGCGGCCACCTAACACA | 7815 & 7816 |
| KLHL22 | GCACAGGCTACGTGCACA | CGGCTCAAGGAGCAGGGA | 7817 & 7818 |
| KLHL24 | ATGGAGAAGCCACAGACA | CACAGCCATGATAGGACA | 7819 & 7820 |
| KLHL4 | GCCACTCTTGAAGGACCA | TGGACATTGGAGCACACA | 7821 & 7822 |
| KLHL6 | AACGCACCAAGCCCAGGA | CAGGTCACCTCTGCCACA | 7823 & 7824 |
| KLK1 | ACACCTGGAAGGTGGCAA | ACAGCACTCTGACGGCGA | 7825 & 7826 |
| KLK10 | GCCTGACCTGCTCCAGCA | CCGGTCCAGTCCAGCACA | 7827 & 7828 |
| KLK11 | GCAGGAAGGGGGCAAGGA | CGGGTGATCGCACACGGA | 7829 & 7830 |
| KLK12 | CCGTCCGCGTAACCAGCA | CTCCCGGGATACACACCA | 7831 & 7832 |
| KLK13 | CACCACCACCAGCCCCCA | CCCAGAGTCACCCTCACA | 7833 & 7834 |
| KLK14 | GCCCATTGAGGTCACCCA | GCACACCTCATCCGGGGA | 7835 & 7836 |
| KLK15 | CAGAGCAACTACGGACCA | GCTGGACTAGGCGCAGCA | 7837 & 7838 |
| KLK2 | CAGCCACAGCTTCCCACA | CAGGCTCTGACAGGCGGA | 7839 & 7840 |
| KLK3 | ACCACCTGCTACGCCTCA | AGGGTGAACTTGCGCACA | 7841 & 7842 |
| KLK4 | CTGACACCATCCGGAGCA | CGTTCACGCACTGCAGCA | 7843 & 7844 |
| KLK5 | GGATGCTTACCCGAGACA | AGGACACGAGTCCCTGCA | 7845 & 7846 |
| KLK6 | ACACCACCAGCTGCCACA | ATCTGGCCAGGGTAGGCA | 7847 & 7848 |
| KLK7 | CACTACCACGAGCCCAGA | GTCGGGGATGCCAGCGCA | 7849 & 7850 |
| KLK8 | TGACACGTGCCAGGGCGA | ACAGGGGTCTGAGCCCCA | 7851 & 7852 |
| KLK9 | ATGGGAGGGTCCGGAGCA | TGGGCAGGCGGATCAGCA | 7853 & 7854 |
| KLRB1 | CCCACAGACTCAGGCCCA | CCAAGGTGAACCCTGACA | 7855 & 7856 |
| KLRC1 | CAGCTCCAGAGAAGCTCA | TCGTTACCACAGAGGCCA | 7857 & 7858 |
| KLRC2 | TACTGCCACCTCCAGAGA | ACACAGTGGCCATCAGGA | 7859 & 7860 |
| KLRC3 | CAAAGTGGCAGCAAAGGA | GGCCATCAGGACAATGCA | 7861 & 7862 |
| KLRC4 | CACCTCCAGAGAAGCTCA | TCTTCGAAGCACAGGCCA | 7863 & 7864 |
| KLRD1 | GCATTTACTCCAGGACCCA | GAAGCACAGAGATGCCGA | 7865 & 7866 |
| KLRG1 | CCTAGCCAGAGACTCACA | TTCCCACCTCCAGCCAGA | 7867 & 7868 |
| KLRK1 | CTCGACACAGCTGGGAGA | TACAGCGATGAAGCAGCA | 7869 & 7870 |
| KMT2A | CCCTCCACTAACTCCCGA | TCCAGAATGGAGTGGCGA | 7871 & 7872 |
| KMT2B | TGGAGGGCAGATGGAGGA | TCCCGGAGAGGGAGGGCA | 7873 & 7874 |
| KMT2D | CACCTGAGGAGTCACCCA | TCAGGTGGAGGGGACAGA | 7875 & 7876 |
| KNDC1 | TGCCGGTGAACAGCGACA | GCGTTCTGCGCGAGGACA | 7877 & 7878 |
| KNG1 | CCGTGGGGAAGAGGAGCA | ACAGCCGAGGCAGTCGTA | 7879 & 7880 |
| KNTC1 | AGGTGAGGAGCCCAAGCA | GGCACTGTCACTGGGACA | 7881 & 7882 |
| KPNA2 | CCTGCTCACCAACCCCAA | AGTTGGTCACGGCCCACA | 7883 & 7884 |
| KPNB1 | TGGAAGGACCAGAGCCCA | TGGCAGCTTCAGGAAGCA | 7885 & 7886 |
| KPTN | GCTTCCTGAGGCCCAGCA | CGCCCTTCAGGGAGACCA | 7887 & 7888 |
| KRAS | GGAGCTGGTGGCGTAGGCA | CAAAGAAAGCCCTCCCCA | 7889 & 7890 |
| KRBA2 | GGAAGGAGCAAGCCGTGA | CGGGGCAAGTTTGAGGAA | 7891 & 7892 |
| KREMEN1 | ACACCTATGCCACGGGGA | TGGAAGCGGGCTAGGACA | 7893 & 7894 |
| KREMEN2 | GACGCCGCTGAGGACCCA | TTTCCCGGAGCCAGCAGA | 7895 & 7896 |
| KRIT1 | AGCCCTAGAGAAAGCAGA | CTGGAGCTCCTAGACCAA | 7897 & 7898 |
| KRT1 | CTGGAGAATGTGCCCCGA | CCGCCACCTCCAGAACCA | 7899 & 7900 |
| KRT13 | CGCTCCAAGGCCTGGAGA | CTGCAGGGCATAGCGGCA | 7901 & 7902 |
| KRT14 | GGCAGCGTGGAGGAGCA | GATGACTGCGATCCAGAGGAGA | 7903 & 7904 |
| KRT15 | GTGAGCTCCGATGCGAGA | GGCTGCGGTAAGTAGCGA | 7905 & 7906 |

FIG. 1 Cont.

| | | | |
|---|---|---|---|
| KRT17 | GCTGGTGCAGAGTGGCAA | GGATCTGGGACAGCTGCA | 7907 & 7908 |
| KRT18 | GGAGAACAGCCTGAGGGA | CTGACTCAAGGTGCAGCA | 7909 & 7910 |
| KRT19 | GGGCACCGATCTCGCCAA | GTGAACCAGGCTTCAGCA | 7911 & 7912 |
| KRT31 | AGCTGTCCCAGGTGCAGA | GGGCACGCACATCCAGCA | 7913 & 7914 |
| KRT4 | ACTGGAGGCATCAGCGGA | GCTGCTGGAACTGCCAGA | 7915 & 7916 |
| KRT5 | GAGGGCGAGGAATGCAGA | CCCACACTGAGCCCACCA | 7917 & 7918 |
| KRT7 | GGGAACCATGGGCAGCAA | ACTCCTGCGACTGGCGGA | 7919 & 7920 |
| KRT73 | CCAGTCCCACATCAGCGA | CCTCATACTGGGCACGGA | 7921 & 7922 |
| KRT79 | AGAGCGAGGAGAGCAGGA | ACGGTGCTATAGCCCACA | 7923 & 7924 |
| KRT8 | GCTGCGTGAGTACCAGGA | GCTGGTGCGGCTGAAGGA | 7925 & 7926 |
| KRT80 | TGGACTCGCCCTCAGCCA | AGGCCTGATCTGGAGGCA | 7927 & 7928 |
| KRTAP12-1 | CCCAGCCCCTGCCAGGCA | GCAGGAAGGCTGGCAGCA | 7929 & 7930 |
| KRTAP5-1 | AAGGGAGGCTGCGGGTCA | GCAACTGGACTGGGAGCA | 7931 & 7932 |
| KRTDAP | ACTCTGCCCAGGGAGCCA | GCCTCGGGTCGTGACGCA | 7933 & 7934 |
| KTN1 | TGCCCCTCCACCAAGAGA | ACCACAGGACTTGAGTCA | 7935 & 7936 |
| KYNU | CAAGCGACAATGAAGGCA | GGAACTGGAGCCACTCGA | 7937 & 7938 |
| L1CAM | GGAGAGGATGTTCCGGCA | GGATGAGCAGGACGAGGA | 7939 & 7940 |
| L3MBTL2 | CACACCGCTGAAGGCCAA | GAGGGTCGTCCTCCAGCA | 7941 & 7942 |
| L3MBTL3 | GGCGAAGCTGTTCAAGGA | CCTCCGCGACGGTGAGGA | 7943 & 7944 |
| L3MBTL4 | GTGAACAGTCAGCCCAGA | GGGCTGACACCGTGGACA | 7945 & 7946 |
| LACE1 | CCATGGACCTCTGGACCA | ACATACAGGCCCCTTGGA | 7947 & 7948 |
| LACRT | ACCTCAAGCAGGCAGGAA | CTGGCACGCCTCCGTGCA | 7949 & 7950 |
| LACTB | CCCAGTCCCTAACACAGA | AGCAGGACACTACTGGCA | 7951 & 7952 |
| LAD1 | CCACCACCAAGGAGCAGA | GGAGTGTGACGGGTGGGA | 7953 & 7954 |
| LAG3 | GGATGTGAGCCAGGCCCA | AGGGATCCAGGTGACCCA | 7955 & 7956 |
| LAIR1 | GCCGTCGGACAACAGTCA | TCTGGCGATGGAGGCAGA | 7957 & 7958 |
| LAIR2 | CTGAGCCAGGCACTGTGA | TCAGATGGACCAAGTCGA | 7959 & 7960 |
| LALBA | CTGGCCAAGCAATTCACA | GCGATGCCTCCATAACCA | 7961 & 7962 |
| LAMA1 | GTGACACCTGTGACCCCA | GCTGTGAGGACAGGCACA | 7963 & 7964 |
| LAMA2 | GGAGCTCACTGATGGGCA | AGCGTTGGCAGGCCACCA | 7965 & 7966 |
| LAMA3 | ACTCGGTGGCAGTCACCA | TGGCAGGTGGGAAGGGGA | 7967 & 7968 |
| LAMA4 | CTGGACCCTGAGGACACA | AGTGGCCAGTTCCAGGCA | 7969 & 7970 |
| LAMA5 | ACGCGCAGAGCAACCACA | CAGAGCGAGTCATGGCGA | 7971 & 7972 |
| LAMB1 | GCCAGTGCGACAAAGCCA | GCAAGATGGCCCGAAGGA | 7973 & 7974 |
| LAMB2 | TCACACAGGGGGTGAGCA | GCCTTCAGGACAGGGACA | 7975 & 7976 |
| LAMB3 | CCGACACTGATGCAGCCA | TGGTCTGGGACAGCACCA | 7977 & 7978 |
| LAMB4 | CAGGTACCCAGAAGCCCA | CACCGCTTTGGAGAGGGA | 7979 & 7980 |
| LAMC1 | TCACGTGACTGGCCAGGA | CGCTCACAGTGCTGACCA | 7981 & 7982 |
| LAMC2 | GAGCTGGAAGAGAGGGCA | TGTAGCAGCCTGGGGGCA | 7983 & 7984 |
| LAMC3 | GGACCAGTGCCATCCCAA | GGCAGCCCTTGATGGAGA | 7985 & 7986 |
| LAMP1 | GTGCAACGCGGAGGAGCA | TGCCGACGAGGTAGGCGA | 7987 & 7988 |
| LAMP2 | GCTGAACATCACTCAGGA | AGCAGTGTGAGAACGGCA | 7989 & 7990 |
| LAMP3 | GACCCCAACGCAACGCAA | ACTCACGCACTTGAAGGA | 7991 & 7992 |
| LAP3 | CTACAAAGGCAGCCCCAA | GCTTTGCAGCAGACACGA | 7993 & 7994 |
| LAPTM5 | ATGTCCGCATCGCAACCA | AGCCCAGCAGGGTGAGCA | 7995 & 7996 |
| LARGE | CTACCTGTCAGACGCCGA | GCCCATACATGGGCAGGA | 7997 & 7998 |
| LAS1L | GGTCAGACCGAGGACCCA | CACCACAGCTCAGGCCCA | 7999 & 8000 |
| LASP1 | TTACCAGCAGCCCCAGCA | CGGTACCGCTTCCCGCCA | 8001 & 8002 |
| LAT | CCCCTGGCATCCGAGACA | TAGCCGCTCCAGGATGCA | 8003 & 8004 |
| LATS1 | GGAGACCTGGAATGCAGA | TGACGAAGGAGCAGCAGA | 8005 & 8006 |
| LATS2 | GAGCCGCAAAAGCGCCAA | TTGCGGACGGGAACGGGA | 8007 & 8008 |
| LAYN | GGGAGAAGCCACTCCCGA | CACTCTCCACGCTCACCA | 8009 & 8010 |
| LBP | AGCCAGGCTCTACCCCAA | TGGCCACACTGAGCCGGA | 8011 & 8012 |
| LBR | CCGAGAAGCTCGTGACGA | GTAGGGCACACGCTGACA | 8013 & 8014 |
| LCAT | AGCAGCGCATAACCACCA | CTGGGAGTCCTGCCAGGA | 8015 & 8016 |
| LCK | AGGGATGACCAACCCGGA | CAGCACACTGCGCAGGTA | 8017 & 8018 |
| LCLAT1 | ATTCCCAGAAGGGACTGA | GAGGATACGCCACAGTGA | 8019 & 8020 |
| LCN1 | GTCGCACGTGAAGGACCA | CGAGCTTCACCCCTCGGA | 8021 & 8022 |
| LCN10 | GGAGGTGATCCTGAGGAA | CCAGGCGGAGGTAGACCA | 8023 & 8024 |
| LCN12 | GGCTGGCCGTCCTCAGGA | TCATCCGAGAGGCCCTGA | 8025 & 8026 |
| LCN15 | CCTCCACGTCCACATGGA | AGTGTCCCTCGGAGCCCA | 8027 & 8028 |
| LCN2 | GGAGAACCAAGGAGCTGA | GGTCGATTGGGACAGGGA | 8029 & 8030 |
| LCN6 | TGGGAGGGTGTGACCAGA | GCTCGTCCCCGAACTCCA | 8031 & 8032 |
| LCORL | AAGGCCCCTTAGACCTCA | TAGCATGCCAGCCACTGA | 8033 & 8034 |
| LCP1 | CCCCTTTCACCATTCAGGA | CACAGAAGTCCCAGGACCA | 8035 & 8036 |
| LCP2 | GAACTGGACTCCGAGGGA | CAATGAGCAGAAGTGGCA | 8037 & 8038 |
| LCT | GAAGGTGCGTGGAGAGCA | AGGGAGGATGCGAGACCA | 8039 & 8040 |
| LDB1 | CTTCAGCATCCGGCAGCA | GGGCTCGAGTATCACACA | 8041 & 8042 |
| LDB2 | CCGCCAGCAGAACCCACA | CAGGTACCTGACTGGACA | 8043 & 8044 |
| LDB3 | GGTCCTCAGGTGCCACCA | CGGCCCATGGCTACCAGA | 8045 & 8046 |
| LDHA | ATACAGCCCGAACTGCAA | AAGGACCCACCCATGACA | 8047 & 8048 |
| LDHB | GCAGCTGCCATGGATGGA | AGGCACTTTCAACCACCA | 8049 & 8050 |
| LDHC | CCACCCCACAAGCTGCCA | TCCATCACAGACAGTCCA | 8051 & 8052 |
| LDLR | CAGCACACAACCACCCGA | AGCACGATGGGGAGGACA | 8053 & 8054 |
| LDLRAD1 | GCCGAGATGTGCCCCAGA | GGTTGAAGGACAGCGCCA | 8055 & 8056 |
| LDLRAD2 | CTCCGGTGCCCAGCCAGA | GGGATCCTGCAGACCCGA | 8057 & 8058 |
| LDLRAP1 | GAGGGACAAAGCCAGCCA | AGACTGGGCAAGCCTCGA | 8059 & 8060 |
| LDOC1 | GACGCCATGAAGGTGGCA | CGTCGTCATCCCAGCCAA | 8061 & 8062 |
| LEAP2 | GTGAGTTCGGCAAAGAGA | AGGCTCCAATAGGCCTGA | 8063 & 8064 |
| LECT2 | ACCGCACTGGCAGGGCCA | CCACAGCCATGGCGGTCA | 8065 & 8066 |
| LEF1 | GCACGTGAAGCCTCAGCA | ACGGGAGAGGGCATGCCA | 8067 & 8068 |
| LEFTY1 | AGGAGGGAGGCAGGACCA | CTCCTTGGCACGAGCGCA | 8069 & 8070 |

FIG. 1 Cont.

| | | | |
|---|---|---|---|
| LEFTY2 | GTGACCCTGAAGCACCAA | CCACACACTCGTAAGCCA | 8071 & 8072 |
| LEP | CAAGGCCCAAGAAGCCCA | ATGGGCACAGCTTGGACA | 8073 & 8074 |
| LEPR | GTGGACAGAGCAAGCACA | CACTGAGTGACTGCACGA | 8075 & 8076 |
| LEPRE1 | GCTGGGGCAAGAAGGCAA | CGATGGCAGTGCGGCACA | 8077 & 8078 |
| LEPREL1 | GCATCCATTGAGGCCAGA | ACTCCTGAAGGGACCCGA | 8079 & 8080 |
| LEPREL4 | TCTTCGACCCCAAGGACA | TCTTCCAGGCCCCAGCGA | 8081 & 8082 |
| LETM1 | GCGAGGACTTGCAGGAGA | CCATCTCCAGCTGCGAGA | 8083 & 8084 |
| LFNG | GCAAGCCCAGCCTGGACA | AGTCATCAGGCAGCCGGA | 8085 & 8086 |
| LGALS1 | CGCCCACGGCGACGCCAA | CTTCCAGGCTGGAAGGGA | 8087 & 8088 |
| LGALS2 | AACCCTCGCTTCAGCGAA | GGGCTGAAGCACAGGTGA | 8089 & 8090 |
| LGALS3 | AAGTGCCACCGGAGCCTA | GGCTTCACCGTGCCCAGA | 8091 & 8092 |
| LGALS3BP | ACCTCCCCACCATCCAGA | CGAAGAGCCCTTCGCAGA | 8093 & 8094 |
| LGALS4 | CGGTACCGTGGTCCGGAA | CACCCTCTGGAAGGCCGA | 8095 & 8096 |
| LGALS7 | GCTGTGCGGGGAGGAGCA | CTGACGCGATGATGAGCA | 8097 & 8098 |
| LGALS8 | ACAGGATCGGCCCAGAGA | AGCTGGGGCGTGCCAGA | 8099 & 8100 |
| LGALS9 | GGGGGTCTGAGGAGCGAA | GCTGACCATCCACGGCCA | 8101 & 8102 |
| LGALS9B | CCCAGCTCCCATTACCCA | GGATGGCGGGAGTAGAGA | 8103 & 8104 |
| LGALS9C | AGGTGATGGTGAACGGGA | CAGGCTGGGAGAACGGCA | 8105 & 8106 |
| LGI1 | GGAAAAGACCTTCCGGAA | TAGATGTGAGAGCCACCA | 8107 & 8108 |
| LGI2 | CATCCCCAACATGGAGGA | CCACCTCATGACCCGGGA | 8109 & 8110 |
| LGI3 | GAGTCGCACCCAGAAGCA | TGTAGCGGCTGAGGCACA | 8111 & 8112 |
| LGI4 | GCTCATCGCCAGGGACCA | TGTCAGGCTCAAGGCGGA | 8113 & 8114 |
| LGMN | AGCAGCTCCTGTCCGAGA | GGAGTGCCAGTTGAAGCA | 8115 & 8116 |
| LGR4 | CCTCAGTCCCCGAGGACA | GCGCCTGTAGGGTGGGCA | 8117 & 8118 |
| LGR6 | CCAGCTGGAGATGGAGGA | CAGCGAACACGGTCAGCA | 8119 & 8120 |
| LHB | GGCATGGGCATCCAGGGA | TAGGTGCACACCACCTGA | 8121 & 8122 |
| LHCGR | TTACCCAAGACACCCCGA | CTGAGGCTATGAGCAGCA | 8123 & 8124 |
| LHFP | GGCTGGGACAGTGAGGAA | CGTGCAGTAGTAGGCCCA | 8125 & 8126 |
| LHPP | GCCCAGTGACGAGCACCA | GCTGCAGCAGCAGGTCCA | 8127 & 8128 |
| LHX1 | GACATCCTGGCGCACCCA | CGCCCCACCGTTGACCGA | 8129 & 8130 |
| LHX2 | GCGCAACCTCTTACGGCA | TGAGCGAGGCGTTGGAGA | 8131 & 8132 |
| LHX9 | TCTGACCACGGGCGACCA | TGAAGTAAGGCAGGGCCA | 8133 & 8134 |
| LIF | ACATCACCCGGGACCAGA | ACAGCACGTTGCTAAGGA | 8135 & 8136 |
| LIFR | AGCTGGAGGGACTGCACA | GCCCCTCCTACAGGGTCA | 8137 & 8138 |
| LIG1 | TGTGGAGACAGAGGGCGA | CATCAGCCCCTCGCAGGA | 8139 & 8140 |
| LIG3 | CAAGTGTGCAGGAGGCCA | GTGATCTCCCACACGGCA | 8141 & 8142 |
| LIG4 | AAGCTCCACCAAGCAGCA | AAACGCAAGGTGCAGCCA | 8143 & 8144 |
| LILRA1 | CACCCTCAGCCCATCACA | GCAGAATCCCGAGGACCA | 8145 & 8146 |
| LILRA2 | CCAAGCTCAGCAGAACCA | AGGGGGTCACTGGGGAGA | 8147 & 8148 |
| LILRA3 | CCGTGAGCCCAAGTCGCA | GTCGTAGCCGGCATCAGA | 8149 & 8150 |
| LILRA4 | GATGCTACGGCGCACACA | CGGGTCCCATGACTGACA | 8151 & 8152 |
| LILRA5 | CTGTGACCCCCAGCCACA | AGGTGTGAGGCAGTCCCA | 8153 & 8154 |
| LILRA6 | CAAAGAAGGGGCAGCCCA | TCACAGGACTCATGGGGA | 8155 & 8156 |
| LILRB1 | CTCCAGACCTAGGAGAGA | GGGGCTTCAGATGCAGCA | 8157 & 8158 |
| LILRB2 | CCTGAACTCCCAGCCCCA | CGGCTGCACTGAGAGTGA | 8159 & 8160 |
| LILRB3 | GATGAAGACCCCCAGGCA | GAGGCTTCAGATGCAGCA | 8161 & 8162 |
| LILRB4 | TACAGGGTCAGTCCCCCA | GACGCCAGTGTTGGAGGA | 8163 & 8164 |
| LIMA1 | CGTTCCACCCCTGCCGAA | CGGAAGCAGCTGATGTGA | 8165 & 8166 |
| LIMCH1 | CTCCCAGTGAAAGGCGGA | GCCCACAGGAAGAGCACA | 8167 & 8168 |
| LIME1 | AGAGCCACAGCAGGGGAA | AGGCTTGCAGACCCTGGA | 8169 & 8170 |
| LIMK1 | TCAAGAAGCCAGACCGCA | CGCACAGGACGATCCCA | 8171 & 8172 |
| LIN28A | AGCATGCAGAAGCGCAGA | GCGGACATGAGGCTACCA | 8173 & 8174 |
| LIN28B | GAGTCAATACGGGTAACAGGA | GATGATCAAGGCCACCACA | 8175 & 8176 |
| LINGO1 | AGGGAGAGGCCAACAGCA | AGAAGAGGACGACGCCCA | 8177 & 8178 |
| LIPA | GAAGTGGCTGGGTACCCA | TGCACAGAAGTTCCAGCA | 8179 & 8180 |
| LIPC | GGGAAGTGCCCCCAGCAA | CGATCGCTCGTGGGAGCA | 8181 & 8182 |
| LIPE | CTGCTGGGCCATCAAGCA | GGTCCATGAGGCTCAGCA | 8183 & 8184 |
| LIPF | GTGGAACGGTGGCAAGGA | GGGCATCCATTGCCCAGA | 8185 & 8186 |
| LIPG | GGTCTACACCGAGGAGGA | GCGGGGTTGAGACAGGTA | 8187 & 8188 |
| LIPH | CAAGGTACAAGCTCAGGA | TCATACCGACACAGCTGA | 8189 & 8190 |
| LIPI | TGCAACCACCAGAGAGCA | ACAGTCACAGTCCACACA | 8191 & 8192 |
| LIPM | GTGGACAGGAGGTCAGGA | CTCACACCGTCCCTGGGA | 8193 & 8194 |
| LITAF | ATACCCAGCCAGCGCCCA | AGCCCGCTATGCACCCCA | 8195 & 8196 |
| LLGL1 | GGTGAGCGCGAAGACCAA | ACCCAGGTTGGTGAGGCA | 8197 & 8198 |
| LLGL2 | GCCCTGACATGCAGGGAA | CGCCCAGGTTGGTAAGGA | 8199 & 8200 |
| LMAN1 | CAAGCAGCTGAACCGGCA | GCCCATGCTGCCCAGGCA | 8201 & 8202 |
| LMAN2 | ACACGCCCGACGAGGAGA | GATGCCCAGGAGAGCGCA | 8203 & 8204 |
| LMAN2L | CACAGCCATTGTCCGCAA | TGATGGAGGAGGTGCCGA | 8205 & 8206 |
| LMNA | GACCTGGTGTGGAAGGCA | CCACAGTCACTGAGCGCA | 8207 & 8208 |
| LMNB1 | GTGACAGTATCCCGAGCA | TCCAGTGGCTGAGGCGGA | 8209 & 8210 |
| LMNB2 | TCTTGGAGGGGGAGGAGA | CGCCATCCGCGTTAACCA | 8211 & 8212 |
| LMO1 | CCTCTACACCAAGGCCAA | CCCGCATCACCATCTCGA | 8213 & 8214 |
| LMO2 | GGACTGCCTGAGCTGCGA | TGTCACAGGATGCGCAGA | 8215 & 8216 |
| LMO7 | CAGTCAGTGGGAAGCGCA | GAAGAGCCTCCGAGGTCA | 8217 & 8218 |
| LMOD1 | GCAAAGGCAGGCACAGGA | AGGGGTGGAGCCAAGGGA | 8219 & 8220 |
| LMX1A | CCAGATGCCTGGAGACCA | CCCACTCTGGACTGCAGA | 8221 & 8222 |
| LNPEP | ACTCAGCCTACACCCGAA | GTGACCTGAAGAGCCTGA | 8223 & 8224 |
| LNX1 | AGTGTTGAGCCCGGAGGA | AGTTCGACCCCATCCACA | 8225 & 8226 |
| LONP1 | GTGTCCGCAACCTGCAGA | CCATTGCGGTCCAGGCCA | 8227 & 8228 |
| LONP2 | GATGAAGGAGTCCGCCCA | CTCCAGCTGGGAAGTGCA | 8229 & 8230 |
| LONRF1 | GCACTGCCGACATTGAA | CGTGGGTCTACAGGGAGAA | 8231 & 8232 |
| LOX | CGGCATGGTGGGCGACGA | GCCACCAGGTCTGGGAGA | 8233 & 8234 |

FIG. 1 Cont.

| | | | |
|---|---|---|---|
| LOXL1 | TCTGCCTGGAGGACAGCA | CGATCCACTGGCAGTCGA | 8235 & 8236 |
| LOXL2 | GACCACCTACCTGGAGGA | TCTGGGAGGAGAAGCGCA | 8237 & 8238 |
| LOXL3 | CCCATCATGGCACCCACA | AGGCGGTCTCCTGCACCA | 8239 & 8240 |
| LOXL4 | ATGGACTGGCCCTACGGA | TCAGCCACCTTGGAGCCA | 8241 & 8242 |
| LPA | GCCTCAAGTGGAGCCGAA | AGCAGCAGTCAGCACCCA | 8243 & 8244 |
| LPAL2 | CGACGGATCCCAATGTCA | TAACAGTCAGAGGCACGA | 8245 & 8246 |
| LPAR1 | GGCGGAATCGGGATACCA | ATAGGCCAGCACGTCGCA | 8247 & 8248 |
| LPAR6 | GTGATCGGAGGAAGTGCA | AAGCAGGCTTCTGAGGCA | 8249 & 8250 |
| LPCAT3 | GGGCAAGGCAAAGTGGGA | CGTGCCAGAGGGCCAGGA | 8251 & 8252 |
| LPHN1 | GGAACCACCTGCTGACCA | CAGGGTGTCCATGCCACA | 8253 & 8254 |
| LPHN2 | CTTACGGGGCAGCAGCAA | GGGTTGGTACAGAAGGGA | 8255 & 8256 |
| LPIN1 | AGTGATGAGGAGCGCGCA | GCTCGGAAGTCAGCCGGA | 8257 & 8258 |
| LPIN2 | GGGCAAAGACTGGACCCA | GAACAAGCTGCTGGGGGA | 8259 & 8260 |
| LPL | ATGGCACCGTGGCCGAGA | GCCGGGACTGCTCCACCA | 8261 & 8262 |
| LPO | CTCTCACAGCCGCAGACA | CCCGACCCCTTTCCACCA | 8263 & 8264 |
| LPP | CAACAAGCTCCGAGGGCA | CTCGGAGAATCCGCTCCA | 8265 & 8266 |
| LPPR1 | AACACGCTGCTCTGAGCA | ACCAGCAATCACGTCCGA | 8267 & 8268 |
| LPPR2 | CGGTCACCTACACAGCGA | GCACAACGCAGGTGACCA | 8269 & 8270 |
| LPPR3 | CACGCAGTACCGCAGCCA | AGGCCAGGTAGGCAGCGA | 8271 & 8272 |
| LPPR4 | CCTGCGGAGAAAGGGCAA | ATAAGCCCGTGTGGGGGA | 8273 & 8274 |
| LPXN | CACAGTGCCCAAGGGCCA | GGGCAGTAGGCCAAGCCA | 8275 & 8276 |
| LRAT | GGCACTGCTCAACGAGGA | GGACTGATCGGGGTGCCA | 8277 & 8278 |
| LRBA | CGTGACCACGTGACAGCA | CCAGTAGTCAAGGCGCCA | 8279 & 8280 |
| LRCH3 | AGAGCGCACTCGGAGAGA | GGGTAGCAGCACAGCCCA | 8281 & 8282 |
| LRDD | CCTCCTGGGAGAACCAGA | GAGGCCTGTGATGCCAGA | 8283 & 8284 |
| LRFN4 | CTGACCTCACGGCCACCA | CCCGAACCAGCAAGGCCA | 8285 & 8286 |
| LRFN5 | GGCAACACAAGGTCACCA | TGGACACGGACTGGGGCA | 8287 & 8288 |
| LRG1 | TGACCAGAACCTGAGCGA | ACTTGGCCACTGCCAGGA | 8289 & 8290 |
| LRIG1 | CTCAGGCCAATGGGCACA | ACGCAGACCCAGCACAGA | 8291 & 8292 |
| LRIG3 | GGCCACTGTTGGACCGAA | GGATCACACTGAGGCGCA | 8293 & 8294 |
| LRMP | GAAAGGACAAGGAAGCCA | GTGGGAGCGGCATCCACA | 8295 & 8296 |
| LRP1 | CGCTGGAAGTGTGACGGA | ATCAGAGCGGTCCCCACA | 8297 & 8298 |
| LRP10 | TCACTGCCCCTAGAGCCA | CATCTTCCAGGGCCAGGA | 8299 & 8300 |
| LRP11 | GCCTACTCCACAGGAGGA | TTGCGGTCCAGGCCCAGA | 8301 & 8302 |
| LRP1B | CGCTGCATCCCCAAGAGA | CTGGGAATGCAACGCCCA | 8303 & 8304 |
| LRP2 | GGAGTGCACAGAGAGCGA | GCCTGGCAGTATGCACCA | 8305 & 8306 |
| LRP4 | GTGCCAACCTCAACGGCA | CCAGGTTCTGCCACAGCA | 8307 & 8308 |
| LRP5 | GGAAGTCAGCCTGGAGGA | GTGGACTGGGCATGAGCA | 8309 & 8310 |
| LRP6 | GTGGCCAAAACCGCACCA | AGAGTAGTGGGCAGGGCA | 8311 & 8312 |
| LRP8 | CGACCTGGTGAAGCGGAA | TGCCAGGCCCTCTGGAGA | 8313 & 8314 |
| LRPAP1 | GCACACGGAGCTGAAGGA | GCCAGGTCCCACAGGTCA | 8315 & 8316 |
| LRPPRC | AACGCAAGTTAGGCGGGA | CCTGGATGACACGGGTCA | 8317 & 8318 |
| LRRC15 | GCATGACCCAGGCCCAGA | TGCAGCAGCAACAGCCGA | 8319 & 8320 |
| LRRC17 | GGCAGTGTGAGAAGCCGA | CCTGAGGCCAACCAGGCA | 8321 & 8322 |
| LRRC30 | ACCTGGCCAGCCTGCAGA | TCCAGGCGATCCTCACCA | 8323 & 8324 |
| LRRC32 | ACTCAGCTGCTGCGGCAA | GCACGTGGCTCAGGGACA | 8325 & 8326 |
| LRRC37B | CCTCATCCCCAACGAGGA | CAGGAGGCCTGTTCGCAA | 8327 & 8328 |
| LRRC38 | TGCTGCCAACGACGCTGA | ACCATAGTGAACCAGCCA | 8329 & 8330 |
| LRRC41 | CGCTGACTGTCAGAGCGA | CATCTGCCAAGGCCAGCA | 8331 & 8332 |
| LRRC4B | CCGAGCTCAAATGCCGCA | GCGTGCCGTCATGCAGGA | 8333 & 8334 |
| LRRC6 | TTGGAGAGCTGAGCAGCA | GAAGAGTTGCTACCACGA | 8335 & 8336 |
| LRRC7 | TCCCCTGGAACTCGAGCA | CCATGGTACGCCTGGAGA | 8337 & 8338 |
| LRRC70 | GTCAGAATCCCCCATCCA | CAGGCCATCATTAGCGCA | 8339 & 8340 |
| LRRC8C | CACCTACATCCCAGAGCA | GGAAGAGGTGGGAAGGCA | 8341 & 8342 |
| LRRC8E | CTCAAGAAGCTGGCGGCA | ACAGCCTGAGCGTGACCA | 8343 & 8344 |
| LRRFIP1 | AGGAGGTTCCAGCGCACA | CCTGCTGGAGAACCAGGA | 8345 & 8346 |
| LRRK1 | GCCAGATGAAGGACCCGA | CACCTTCATCCCAGGGCA | 8347 & 8348 |
| LRRK2 | CCGAGACCTGAAACCCCA | GCAACTTCAGGTGCACGA | 8349 & 8350 |
| LRRN3 | TGCAGAACCACAGCCTGA | GACTTCAAGTCAGCGCCA | 8351 & 8352 |
| LRRTM1 | CCTCAGGCAGCTCAGACA | GGGCAGACATGGCAGCCA | 8353 & 8354 |
| LRRTM2 | GCCTTCGGAAGCTGCAGA | AAGAAGAGCGTGTGCAGA | 8355 & 8356 |
| LRRTM3 | GACGGTGGGAGCCACAGA | TAACCAGCAGGATGACGA | 8357 & 8358 |
| LRRTM4 | AACGCTACCCAGCCAGCA | ATATGTGCAGGGCCCAGA | 8359 & 8360 |
| LRTM2 | CAGAGCCTGCTAAGCCCA | GATGCAGACGACGCCGCA | 8361 & 8362 |
| LSM1 | CCAGCCTCATCGAGGACA | CCACATGAATACGCTCCA | 8363 & 8364 |
| LSM4 | GGGACAAGTTCTGGCGGA | GTCGGGGATGCGCAGGTA | 8365 & 8366 |
| LSM7 | CGGGTAAAGTTCCAGGGA | CAATGGTGCCGTCCAGCA | 8367 & 8368 |
| LSMD1 | GGACGGAGAGCGCGAGGA | GCAGTCACGGTCAGTGCA | 8369 & 8370 |
| LSP1 | AGCAGCCCAGGACACCCA | GTGGTAGGGCTCAGGGGA | 8371 & 8372 |
| LSR | CCAAGACGACTCGAGGGA | ATAGGGGAGGTCCCCGGA | 8373 & 8374 |
| LSS | CTACCGCCAGATGCGCAA | CTCGGTGACATGGGGACA | 8375 & 8376 |
| LST1 | CAGGAACTCCACTATGCA | ACCCGCCTGGGTTGAGGA | 8377 & 8378 |
| LTA | TATCCAGGGCTGCAGGAA | TGAGGACTAGGTGGGGGA | 8379 & 8380 |
| LTA4H | CAGACGCTCCAGAGGGCA | ATTGAATGCAGAGCCGCA | 8381 & 8382 |
| LTB | GGCCAGGAGACAAGGGTA | CTCTCGCGAAGTCCACCA | 8383 & 8384 |
| LTBP1 | CGGAGCCAGAAGTGGCAA | GACAGCTGGGGTTGACCA | 8385 & 8386 |
| LTBP2 | GTGACCAGGGCTTCGAGA | CTCCAGGTCACTGGCACA | 8387 & 8388 |
| LTBP3 | GTGAACGAGTGCGAGGCA | GTTCAGGTCCACGCACGA | 8389 & 8390 |
| LTBR | AGCCACTGCCCCCAGAGA | GCGGACGCCTCTTGAGCA | 8391 & 8392 |
| LTC4S | CCAGGTGAACTGCAGCGA | AGTGGGCGAGCAGGCCGA | 8393 & 8394 |
| LTF | GCCTCGATGGCAAACGGA | ATCCGAGACACCACGGCA | 8395 & 8396 |
| LTK | GTGCCTAAGACCCCCACA | GAGGGGCTTGAGGCCAGA | 8397 & 8398 |

FIG. 1 Cont.

| | | | |
|---|---|---|---|
| LUC7L3 | GGACGAGAAGCGCAGCAA | GTGAACAATTCCGCAGGA | 8399 & 8400 |
| LUM | GCCCTGAAAGCTACCCAA | AGAATGAGCCACTGCAGA | 8401 & 8402 |
| LUZP2 | AGCAGCTCTTGACAGGGA | GGTGGGAGTAACATCCGA | 8403 & 8404 |
| LXN | GGACAAGAAACTGCACCA | ATAACCACAGGCAACCCA | 8405 & 8406 |
| LY6E | GCTTGAACCAGAAGAGCA | CCAATGCCGGCACTAGCA | 8407 & 8408 |
| LY6G5B | CTGGACCCCATGGTCACA | AAGAGTCCAGCCTGGGGA | 8409 & 8410 |
| LY6G6D | CAGCGCCGTGGCAAGCCA | CTGGCAAGAGACAGGTCA | 8411 & 8412 |
| LY6G6F | TGGTCCCCAGCAGACGCA | CCGTGGAAGGGGCACAGA | 8413 & 8414 |
| LY6H | CAGTGTCCGAATCACCGA | AACGAAGTCACAGGAGGA | 8415 & 8416 |
| LY6K | CTCCCAGCGAACGGACGA | CGCTGCACAACCAGCGGA | 8417 & 8418 |
| LY75 | GCAGACAGACGTTGCAGA | TGAAGGAGCGCCTGCACA | 8419 & 8420 |
| LY86 | AGCGACAGCGGCTTGGAA | TTGGGCAGAGCCGCCTCA | 8421 & 8422 |
| LY9 | CTGAGGTGCACAAGCCCA | ACATATGGAGTGACGGGA | 8423 & 8424 |
| LYAR | GACGCCGTGGAACAGCAA | GGGACTTCCTCCCCACCA | 8425 & 8426 |
| LYG1 | GGCTCTCAAGCTCCCACA | GCACCCCCACTGTAGGCA | 8427 & 8428 |
| LYG2 | AGGGAAAGCCATGGCGGA | GGCACCGACAGGGTGGTA | 8429 & 8430 |
| LYL1 | GTTCACCAACAGCCGGGA | GCCGCACCAGGAAGCCGA | 8431 & 8432 |
| LYN | CCCAAGCCACAGAAGCCA | TCCAGGAAGGCTTGCACA | 8433 & 8434 |
| LYNX1 | CCTGAGGGACTCCACCCA | GGATATCGGGGCAGCCTA | 8435 & 8436 |
| LYPD1 | CGGGATCATGTACCGCAA | CCCTGGGGAGCAGAAGGA | 8437 & 8438 |
| LYPD2 | CCTTCCAGGGGGACTCCA | CGGGCAGGGTCTGGCCGA | 8439 & 8440 |
| LYPD3 | CCACCAGGACCGCAGCAA | CCAACAGAAGGGCTGCCA | 8441 & 8442 |
| LYPD4 | ACAGGGACTGCAAGGGGA | GCAGAGATAAGACCGGCA | 8443 & 8444 |
| LYPD6B | AGCCACGGAAGAAGCACA | GAGCGTGCATTACGGCAA | 8445 & 8446 |
| LYSMD2 | GTGTCACGATGGAACAGA | GAGGACTGGGAGGAGGGA | 8447 & 8448 |
| LYVE1 | AGGCGAACCAGCAGCTGA | ATCAGGACACCCACCCCA | 8449 & 8450 |
| LYZ | GGCAAAACCCCAGGAGCA | AAGCTACAGCATCAGCGA | 8451 & 8452 |
| LYZL4 | GCCATCTACGAGAACACA | CCGGGACCAGGTGGGCCA | 8453 & 8454 |
| LYZL6 | TCCACTGCGCAAAAAGGA | CCGGCCTGAACAGTGCAA | 8455 & 8456 |
| LZIC | GATGGTAGGAAAGCTGGA | GCTGACAAGAAGGCCTCA | 8457 & 8458 |
| LZTS1 | CAAGCCCAAGGAGCAGGA | GTCCCACGGGTGTGACCA | 8459 & 8460 |
| MACF1 | AGAGCACACCCAGGAGGA | GAGCGCAGAGTTGGGACA | 8461 & 8462 |
| MAD1L1 | GTCCAAGGAGGTGGCAGA | GGCCTTGAAGATGAGGCA | 8463 & 8464 |
| MADCAM1 | CAAACCTGCGGGTGACCA | TGGGGCAGAAGCCTCAGA | 8465 & 8466 |
| MADD | GCACCAAGTGCCACAGGA | GACGTCAGGCTCACACCA | 8467 & 8468 |
| MAF | CGGCCTGCACTTCGACGA | AAGCGGCAGGACTGGGCA | 8469 & 8470 |
| MAFA | CGGCTTCAGCAAGGAGGA | GCGGCAGGACTGCGCGTA | 8471 & 8472 |
| MAFB | GACGTGAAGAAGGAGCCA | AGCTGGGCGACGAGGGCA | 8473 & 8474 |
| MAFF | GGTGACACGGCTCAAGCA | CTCGCGCTCCAGCTCCGA | 8475 & 8476 |
| MAG | GGAACCTCTATGGCGCCA | CTGCTGAACAGGACGGGA | 8477 & 8478 |
| MAGEA1 | TGAAGGAAGCAGACCCCA | GCAATCATGACCAGGACA | 8479 & 8480 |
| MAGEA11 | AGTGGACCCCACTAGCCA | TTCCAGCATACACCCCCA | 8481 & 8482 |
| MAGEA12 | TATCGAGCCAGGGAGCCA | GGATGTACAAGTGGCCGA | 8483 & 8484 |
| MAGEA3 | GCCGGTCACAAAGGCAGA | TTGTCACCCAGCAGGCCA | 8485 & 8486 |
| MAGEA4 | ACCGGCAGGTACCCGGCA | CGCAGGGATGGGTAGGCA | 8487 & 8488 |
| MAGEA6 | TGATGGAAGTGGACCCCA | TTGTCACCCAGCAGGCCA | 8489 & 8490 |
| MAGEB2 | CTGGAAGCTCATCACCAA | ATAGGCTCTCGGACCCCA | 8491 & 8492 |
| MAGEC1 | TGAGTGATGAGCAGGGCA | GAGCTCTTGGACCCCACA | 8493 & 8494 |
| MAGEC2 | CACAGTAGGCCTCACCGA | AATGTCCCTGCACCCAA | 8495 & 8496 |
| MAGEC3 | CGCAGAGTCCTCCCCAGA | ACTGCACCAACTCAGCCA | 8497 & 8498 |
| MAGED1 | GGTCCTCCAGACTGGCAA | GGCACGCGAGTTGGGAGA | 8499 & 8500 |
| MAGEE1 | GAGAGCCCAAATGGGCCA | GCACCCCCATCCTCCAGA | 8501 & 8502 |
| MAGI1 | CTGAAAGTAGGAGACCGGA | GAGGACTCATCCCCAGGA | 8503 & 8504 |
| MAGI2 | TGCCCAGAGAACGGGAGA | GCGAAGCCTTCAGGGGGA | 8505 & 8506 |
| MAGIX | GCCAGATCGCAGCCCAGA | AGCGTCGTCCGGGATGGA | 8507 & 8508 |
| MAGT1 | TGGAAGCAGTCAAGCCCA | CAAGTCCAATACCAGCCA | 8509 & 8510 |
| MAK | TCAGGAGAAACCGCCACA | TGGAATGGGAGGCTCCGA | 8511 & 8512 |
| MAL | CACCTACAGGCACTACCA | AGAACACCGCATGGACCA | 8513 & 8514 |
| MAL2 | TGGAAGCAGCAGCCACA | CAGACCCAAACTGCAACCA | 8515 & 8516 |
| MALL | GCCTGTACCACGGGACCA | GAAGAACGAGGCTGCCGA | 8517 & 8518 |
| MALT1 | TTACCGGGAGCACCCCAA | CATCCACAGCATTACGCA | 8519 & 8520 |
| MAMDC2 | CCCACTTCCTACACAGGA | CCAGAGACTCCTCGCAGA | 8521 & 8522 |
| MAMDC4 | GACCACACCACAGGCCAA | CTCATGGCTAGGCGCAGA | 8523 & 8524 |
| MAML1 | CCTGGCAGCATCAGGGAA | CTGAGCTCATGGGAGCCA | 8525 & 8526 |
| MAML2 | CCACCTACCTTAGGGCCA | GAAGCGGACTCCTGCAGA | 8527 & 8528 |
| MAN1A1 | CGCAAGTCTAGCAGCGGA | CATCAGCCCCGAGTGCGA | 8529 & 8530 |
| MAN2B1 | AAGGACGATGGACGCGGA | GGGCTGTGTCCAGCAGCA | 8531 & 8532 |
| MAN2B2 | GAAAGGCCATCGAGGGGA | TGCAGCACAGCCTCCAGA | 8533 & 8534 |
| MANBA | GCCGTAGTCGCAGCGAGA | CTCAAGAGAAGCCCAGGA | 8535 & 8536 |
| MANEA | CGTCCATGGAACACGCAA | TGAAGTGCGGCACTCAGA | 8537 & 8538 |
| MANEAL | CTATGAGACGGCCCTGCA | GGTGAGGCAGGTAGTCCA | 8539 & 8540 |
| MANSC1 | GCAGTTCCTCCCAGGGCA | CCGAGAGGATTCTACCCA | 8541 & 8542 |
| MAOA | TCGGGAAGGTGACCGAGA | GATCTTCAGCAGGCCAGA | 8543 & 8544 |
| MAOB | CACAGCCCATCACCACCA | TTGTGGGCCAGGAAGCCA | 8545 & 8546 |
| MAP1B | GGTCGACAAGGCTGCAGA | AGGTTCTCGGCCAGGAGA | 8547 & 8548 |
| MAP1S | CCTCACCCACAGTGACCA | ACCAGGCACAGGTCCACA | 8549 & 8550 |
| MAP2 | ACCCCGACGACTCAGCAA | CAGTGACATCCTCAGCCA | 8551 & 8552 |
| MAP2K1 | CCCCGCAGAGAGAGCAGA | GAGCAGAGCCAACCTGCA | 8553 & 8554 |
| MAP2K2 | CCTCCGAGAGAAGCACCA | CGACGGCCAGCTCCACCA | 8555 & 8556 |
| MAP2K3 | GGAGCCTGGGCATCACCA | GGGACGGCTCCTCCACCA | 8557 & 8558 |
| MAP2K4 | CTTCGGCATCAGTGGACA | CAGACATCAGAGCGGACA | 8559 & 8560 |
| MAP2K6 | AGCGGGCAGATCATGGCA | GGTGACAGTGAATGGACA | 8561 & 8562 |

FIG. 1 Cont.

| | | | |
|---|---|---|---|
| MAP2K7 | CGCTTCTGCCCGGACACA | CCTTGAACCAGGACGCCA | 8563 & 8564 |
| MAP3K1 | GCAGTGGAAGCAGCCCGA | GTAGACAGGGTCAGCACA | 8565 & 8566 |
| MAP3K11 | GCAAGGTGTACAGGGGCA | GCACAGCCCAGTTGACCA | 8567 & 8568 |
| MAP3K13 | TGGCAGAGAAGCTAGACGA | CACAGCTTGCCCAGAGACA | 8569 & 8570 |
| MAP3K3 | GCAAACGCCTGCAGACGA | CCACCACAGTGCAGCCCA | 8571 & 8572 |
| MAP3K4 | TCAGCCGGTCATCGCCAA | TCCACGCGGTCAATGGCA | 8573 & 8574 |
| MAP3K5 | AGGCGGTACAGACAGCCA | TCACGCCTGAGGTAGCCA | 8575 & 8576 |
| MAP3K6 | GCACCAGGAGCAGAAGCA | GGTCTGTGCAGAAGCGCA | 8577 & 8578 |
| MAP3K7 | AGTGATAACGCGTCGGAA | CATTGAAGGGCGCTGGGA | 8579 & 8580 |
| MAP3K8 | GCTGCTGAGTAGGAAGGA | GATTGAAGTAGCCAGCCA | 8581 & 8582 |
| MAP3K9 | GCAATGGGTTGAGCCCCA | TGCCGGTTGGCAGAAGGA | 8583 & 8584 |
| MAP4K1 | GCACACCTGAGATCCCCA | CACTACAGGCCTGGGGGA | 8585 & 8586 |
| MAP4K2 | CATGAAGCAGCGGGAGGA | CACGCAGTAGAGCCAGGA | 8587 & 8588 |
| MAP4K3 | CCAGATTACCCCCACACA | GGTGTTGGAGGAAGACCA | 8589 & 8590 |
| MAP6 | AGTGCCATGGCCACAGCA | TCACGGACTCGGGGACCA | 8591 & 8592 |
| MAP7 | TTCTGCAGGCACCACCGA | CAGCCACACGTTGAGCCA | 8593 & 8594 |
| MAP9 | GGATCTGAGGGAAACGCA | CAAGGTCATCAGCAGTCA | 8595 & 8596 |
| MAPK1 | GGAACAGGCTGTTCCCAA | CCAGATATGGGTGGGCCA | 8597 & 8598 |
| MAPK10 | TGACCCAGCCGAAGTGGA | ACTGCTGCACCTGAAGGA | 8599 & 8600 |
| MAPK11 | TTGAGGCCAAGGAGCGCA | GGGGCTTGAAGCTGAGGA | 8601 & 8602 |
| MAPK12 | ATGAAGGGCCTCCCCGAA | CGAAGTAGGGATGGGCCA | 8603 & 8604 |
| MAPK13 | GCTGGCGCGACATGCAGA | AGTGCATCCAGCTGAGGA | 8605 & 8606 |
| MAPK14 | ACTGGCTCGGCACACAGA | CAGTCAACAGCTCGGCCA | 8607 & 8608 |
| MAPK3 | CGGATCACAGTGGAGGAA | GCTCCATGGCGAAGGTGA | 8609 & 8610 |
| MAPK7 | AGCGACCTGCACCAGA | CAGGCCACGAGCCA | 8611 & 8612 |
| MAPK8 | CAGAAGCTCCACCACCAA | GACGACGATGATGATGGA | 8613 & 8614 |
| MAPK8IP3 | GCACGTCATCCAGCCCAA | AGTCCAGGCGGATGGACA | 8615 & 8616 |
| MAPKAP1 | GAAGCAGAGCGAGCCCAA | GTTCTCGCGGACCAGGCA | 8617 & 8618 |
| MAPKAPK2 | CCAAAAGGCCCAACGCCA | GGGGATACCCACACAGCA | 8619 & 8620 |
| MAPKAPK3 | CACAGACCCCACTCCACA | CGCATAGTGGCCAAGGCA | 8621 & 8622 |
| MAPKBP1 | TGAGCAGCCGAGAGGCAA | GTCAGGGTTGAGACGGCA | 8623 & 8624 |
| MAPRE1 | ACTCAACGTCAGTGACCA | TTCAAGGCAATGGAGCCA | 8625 & 8626 |
| MAPT | GCGAGAACGCCAAAGCCA | GCTGGGGCGAGTCTACCA | 8627 & 8628 |
| MARCO | CAGAAGGGAGACCAGGGA | GTAACCCAGCATGCGGCA | 8629 & 8630 |
| MARK2 | GAACAGCTGCCAGAGCGA | TCGAACCCCGTTGAGAGA | 8631 & 8632 |
| MARK3 | TAGTGCAGCCACCCCAGA | GGAGAGGCAGGAGGGCCA | 8633 & 8634 |
| MARK4 | CAGCCACAGCAAAGGGCA | TGCAGGGGATGGGCCACA | 8635 & 8636 |
| MAS1L | CATGGCAGTGGGACAGCA | TAAGAACCCCACTGCCGA | 8637 & 8638 |
| MASP1 | GAGCTGTTGGAGAGCCCA | AGCCGCTGACGATGACCA | 8639 & 8640 |
| MASP2 | TGCAGAGGTGACAGCGGA | TCATGGAACCCCAGGACA | 8641 & 8642 |
| MAST1 | CCCCACCTAGAGTCGGAA | GCGGAGAGCAGGAAGAGA | 8643 & 8644 |
| MAST2 | TCAAAGGCCGAGACCGGA | ATCCAGGAGGCCTGAGCA | 8645 & 8646 |
| MAST3 | CTCCCACCGGTTCAGCAA | CTCAGCCGGATGTCAGCA | 8647 & 8648 |
| MAST4 | AGCCCTGACTGGGAGGTA | CATGCGCACGAGGTTGGA | 8649 & 8650 |
| MAT2A | TCTACCACCTACAGCCAA | TTTGCCACCCAACGAGCA | 8651 & 8652 |
| MATN1 | GGGTCGCTTCCACACCAA | GCCTAGCCCCACTGGACA | 8653 & 8654 |
| MATN2 | GGCTGGCCCTGAAACACA | CGTCCGTCGGTGAACACA | 8655 & 8656 |
| MATN3 | CCCATGGGTGTCAGCACA | GGCCCCATCACTCACACA | 8657 & 8658 |
| MATN4 | GAGCTGTCAGGTCCGGGA | CGCACGCTCTTGGAGCCA | 8659 & 8660 |
| MATR3 | CGGGAGCCACCATACAGA | GGGTTGAGACTAGGACCA | 8661 & 8662 |
| MAVS | CGACCGGAAGTTCCAGGA | GCCGGTACAGCACCACCA | 8663 & 8664 |
| MAX | GGCTGACAAACGGGCTCA | ATGGGACTGAGTCCCGCA | 8665 & 8666 |
| MAZ | CAGCCAGGGTCCTCACCA | GCTGAGAGCTCACAGGCA | 8667 & 8668 |
| MB | CCCCGTGAAGTACCTGGA | GCCCCCTGGGCATCAGCA | 8669 & 8670 |
| MBD1 | CCCATCACAGTCCCCAGA | CTGACCAGACACTGGGCA | 8671 & 8672 |
| MBD2 | GAAGAGCGAGTACAGCAA | TATCAGCAGCTCGCGACA | 8673 & 8674 |
| MBD3 | CCGACGAGGACATCAGGA | CCTCCCCGTCACGGGCCA | 8675 & 8676 |
| MBD4 | CCATCCCACGAACACAGA | AGCGATGAGAAGCTTCCA | 8677 & 8678 |
| MBD5 | CCAGCCTTCAGCAGGAGA | CCTTGGAACGCCTGGAGA | 8679 & 8680 |
| MBD6 | CCAGTGTCACCACGGCAA | CCCAACTGGCCAGAGAGA | 8681 & 8682 |
| MBL2 | GAACGAGGGTGAACCCAA | GGAACTCACAGACGGCCA | 8683 & 8684 |
| MBNL1 | ACCAACGGTGCCACCGCA | GGGAACACTTGTGGCAGA | 8685 & 8686 |
| MBOAT2 | GGGATCCTGGCAGGCCCA | TAACAAGGACAGCCCACA | 8687 & 8688 |
| MBP | CCTGCCCCAGAAGTCACA | GGTGTGCGAGGCGTCACA | 8689 & 8690 |
| MBTD1 | TGCCATATGCACAGCCCA | GGAATCCGTCAGCTAGCA | 8691 & 8692 |
| MBTPS1 | TGGCCGCTACAACCAGGA | AGAAGGCCAGGACCACCA | 8693 & 8694 |
| MC2R | GGGCCATCACACTGACCA | TCTGGGCTCCGGAAGGCA | 8695 & 8696 |
| MC3R | GCATCATGACCGTGAGGA | AGAGGGTGCCCATGAGGA | 8697 & 8698 |
| MCAM | ACGTCAACGGCACGGCAA | CCAGCTCCAGGAAGAGGA | 8699 & 8700 |
| MCCC1 | GTACGGCAAGGAGACGAA | GTCAATGCCGCCTGGCGA | 8701 & 8702 |
| MCCC2 | GGCCACGATAACAAAGGA | AACTGAGACCCAAGACCA | 8703 & 8704 |
| MCCD1 | AGATGACGTCCCCTCCCA | GGGCCTGGTACAGCTCCA | 8705 & 8706 |
| MCEE | CCAGACTTCAAGCTCCCA | TCCACACAGAACCTGTCA | 8707 & 8708 |
| MCF2L | CGGAGATCGCAAGGAGGA | CCACAGGTTGTGAGGCCA | 8709 & 8710 |
| MCFD2 | GGGAGTGAACAGGCACCA | ATAACCAGGAGATGGCCAA | 8711 & 8712 |
| MCHR1 | CAGCCGCATACGTGAGGA | AGTAGGGTGCCCAGCACA | 8713 & 8714 |
| MCHR2 | GGATGCCAGATGCTGCAA | ACATGATAAGGGGCAGCA | 8715 & 8716 |
| MCL1 | ACCTTCGGGAGCAGGCCA | CATCCCCAACCCGTCGTA | 8717 & 8718 |
| MCM10 | GCGGATCTGCAGTCCA | TGAAGCTGCATACGAGGCA | 8719 & 8720 |
| MCM2 | CCATTACGGTGCGGCACA | TCTCCAGCATCACGCGGA | 8721 & 8722 |
| MCM3 | TCGCCAGCCAGATGCCAA | ACACATCCAAGAGGGCCA | 8723 & 8724 |
| MCM3AP | GGACGCCGTTGAGAAGGA | GTCAAGGGAATGGGGGCA | 8725 & 8726 |

FIG. 1 Cont.

| | | | |
|---|---|---|---|
| MCM4 | CCGCTTAGCAGAAGCCCA | ACGATGCCAGTCCGGGGA | 8727 & 8728 |
| MCM5 | CTTCGCCACAGAGGCAGA | CCCTGACAGGGTACCGGA | 8729 & 8730 |
| MCM6 | TGCGACAGCTTGAGAGCA | ATCCCGTTCACAGGAGCA | 8731 & 8732 |
| MCM7 | CGTGGAGATGAGGCGAGA | CTCAGACGTGCCAGAGCA | 8733 & 8734 |
| MCM8 | GCTACAGGCAGCGTGCAA | TCACCAAGTACCAGGGCA | 8735 & 8736 |
| MDC1 | GTCACCTCTGAGCCCACA | TCAAGGGCTGTGGGCACA | 8737 & 8738 |
| MDFIC | GTCCTGGGACAAGCGTCA | CCATGATGCCACAGTCCA | 8739 & 8740 |
| MDGA1 | GCAGTGGACTCAGAGGGA | CGGGAGGCCATGTCACCA | 8741 & 8742 |
| MDGA2 | CGGCAAGGACAGGATCGA | TTGCCCAAGCGCCACTCA | 8743 & 8744 |
| MDH1 | CAGATGTCAACCATGCCA | AGCAGACATGGCACTGGA | 8745 & 8746 |
| MDH2 | CTCTCAGTGCACCCCCAA | CGGCATACGCCATGGAGA | 8747 & 8748 |
| MDK | CACCCCCAGCAGCAAGGA | CCCATCACACGCACCCCA | 8749 & 8750 |
| MDM2 | TCAGGCAGGGGAGAGTGA | ATTCTCACGAAGGGCCCA | 8751 & 8752 |
| MDM4 | AGCCACTGCTACTACAGA | AGGTAGGCAGTGTGGGGA | 8753 & 8754 |
| MDP1 | CGTCCGACTGTACCCAGA | AAGCAGCCGCACCGGGCA | 8755 & 8756 |
| ME1 | GAGAGGCTGCCCTAGGGA | TCTGAGAATGCACCACCA | 8757 & 8758 |
| ME2 | ACTCAGCCCCAGAGAGCA | AGACGGCCAGCACCTGCA | 8759 & 8760 |
| MECOM | GGAGAGCAGCCTTACAGA | CAGTTCAGAATGAGGCGA | 8761 & 8762 |
| MECP2 | AGGAGACCGTACTCCCCA | TCTCACCGAGGGTGGACA | 8763 & 8764 |
| MED1 | GTGTTGCCACACCACCCA | CCCTGAGGTGGAAGCAGA | 8765 & 8766 |
| MED12 | GGAGAAGAGACAGGCGGA | ATGGGAGCACTGGGAGCA | 8767 & 8768 |
| MED12L | GGCTGCAGCAAGCACAGA | AGCTGGGAGACAGGACCA | 8769 & 8770 |
| MED13L | GGGAGTGGTGCATAGGGA | CTCCATGGCAACCAGGCA | 8771 & 8772 |
| MED17 | GGAGCAGGAGCTACAGGA | CACCACTTGGGGAGGCCA | 8773 & 8774 |
| MED20 | GGGCAGAGAAGCAAGGAA | GCAATAAGGCAAGGGCCA | 8775 & 8776 |
| MED22 | AGCTTACGGGAGGCTGGA | AGGGCCACCAGCATGGGA | 8777 & 8778 |
| MED23 | TCAGCAGGGGGTCAGCAA | ACTACGCATGGCCAGGCA | 8779 & 8780 |
| MED24 | AGACGCGGAAGGAGCACA | GGAACTGAGGGCACACCA | 8781 & 8782 |
| MED29 | AGAGCAGTGATGGACCCA | GGGTAGGGGAGGCTGTCA | 8783 & 8784 |
| MEF2B | AGCAAGACACCACCCCCA | CTCCGGGGAGGAAGGGGA | 8785 & 8786 |
| MEF2C | ACCACCACCCCTTCGAGA | GTCCAATGGGGGAGTGGA | 8787 & 8788 |
| MEF2D | CAGAACCGGTGTCCCCAA | GCTGGGCTGCTGAGACCA | 8789 & 8790 |
| MEFV | GGAGGTGGAGGTTGGAGA | ATCACCACCCAGTAGCCA | 8791 & 8792 |
| MEGF10 | TGCACCTGTGCCCCAGGA | CCATGTGCCACTGGGACA | 8793 & 8794 |
| MEGF11 | CGGGCAACACTGTGAGCA | TGCCTGTGACAGCACCCA | 8795 & 8796 |
| MEGF6 | TGGAGCAGCCTGTGACCA | CAGGAGCCATTCACGGCA | 8797 & 8798 |
| MEI1 | TGCCAGCCACCAAGGACA | AAGCAAGGCCTCCAGGCA | 8799 & 8800 |
| MEIS1 | GTAGCTTCCCCCAGCACA | GGAACAGCCACGCCCTCA | 8801 & 8802 |
| MEIS2 | CGCGGTCTTCGCCAAGCA | TGACGAGGTCGATGGGCA | 8803 & 8804 |
| MEIS3 | GACTTGGACCAGGAGCGA | ATGGGGAGCCCAGGCCCA | 8805 & 8806 |
| MELK | CTGGAAGATGTGACCGCA | GTTCGGGGAGTAGCAGCA | 8807 & 8808 |
| MEN1 | GGGAGCAAAGCCAGGGCA | CGTCGTAGAATCGCAGCA | 8809 & 8810 |
| MEP1A | TCACCCACCTCAGCCAGA | GGCTCAGGCTGACAGGTA | 8811 & 8812 |
| MEP1B | GCTCCACCCGAGACACCA | CAAGGGTGATGATCAGCA | 8813 & 8814 |
| MEPE | CTCACAATGGCCTGAGGA | TCGCAGTCACTGGCCCCA | 8815 & 8816 |
| MERTK | CAGGTTGAAGCAGCCCGA | GGTTCCGAACGTCAGGCA | 8817 & 8818 |
| MESDC2 | CGAGCCTCTGGCAGGGCA | TCCCAGGCGTAGCTCCCA | 8819 & 8820 |
| MEST | CCTGAGACTCACCGTCCA | CTGCCCACATGTCCCACA | 8821 & 8822 |
| MET | TGGCCACGGGACAACACA | GTGCCACCAGCCATAGGA | 8823 & 8824 |
| METAP1 | AGTGATGAAGTCGGGCCA | GTCACCGCAGTCCAACCA | 8825 & 8826 |
| METAP2 | TGAAAGGAGGGGAGGCAA | ATCCAGCCATCTGCGGCA | 8827 & 8828 |
| METRN | CGTGTCCTCCGCCAGACA | CCTCGTAGGCACGGCGGA | 8829 & 8830 |
| METRNL | CGAGGCTCCATCCAGCAA | GCACGCCACACTCCAGCA | 8831 & 8832 |
| METTL3 | CCCTGGCAGCAAAGACCA | GGTGGGTCAGCCATCACA | 8833 & 8834 |
| METTL7B | TCACCTGCCTAGACCCAA | TCCGGACCTCCTGCAGGA | 8835 & 8836 |
| METTL9 | GACTGGAAAACCCACAGA | GCTGATCACAGCGGTCCA | 8837 & 8838 |
| MEX3C | CGCAGAGGAAGTCAGCCA | GAGCTAGAGGTGGAACCA | 8839 & 8840 |
| MFAP2 | AAGTCATCCCAGCCCCAA | GACAGAGGTCAGCTCGGA | 8841 & 8842 |
| MFAP3 | CTGGATGGCAGAAGCAGA | GTGACAGAGTAGGAGGCA | 8843 & 8844 |
| MFAP3L | TGACCAAGAGGGTGGACA | AGCTCGGTGGACGTGACA | 8845 & 8846 |
| MFAP4 | GGTCAGCGCAGAGGAGGA | GTGGCAGCTGCGGAACCA | 8847 & 8848 |
| MFAP5 | TCGCCAGCCAAAGTAGGA | GCAGCAAGAAACAGCAGCA | 8849 & 8850 |
| MFGE8 | GACAGGCATCATCACCCA | GTCCCAGTTGCCAGGGAA | 8851 & 8852 |
| MFHAS1 | GACCAACCTAGCTGGGCA | CATCCGACCTGTGCACCA | 8853 & 8854 |
| MFI2 | CCACTCCCGAGATCCAGA | GGACTTGGCTGACACGCA | 8855 & 8856 |
| MFN2 | GAATGAGCTGCACCGCCA | TCTGACTCCGCACAGACA | 8857 & 8858 |
| MFNG | CAGAGCCACAGCCCCACA | AGTCATCAGGCAGCCGGA | 8859 & 8860 |
| MFSD1 | CCCAGGCAGCAAGTGCAA | ATGCCACCATTGGCCACA | 8861 & 8862 |
| MFSD6 | CCCCCTGAGCTGAGGACA | GGATCACCAAGCAGGCCA | 8863 & 8864 |
| MFSD8 | GCTCACTGGGGACCACGA | CCACTCCCAGGAGGGTGA | 8865 & 8866 |
| MGA | GAGGCAAGGGAGGAGGAA | TGACAGAAGGCGTGGGGA | 8867 & 8868 |
| MGAM | GTCATCACCCGCTCCACA | CCCAGCTGCATCCAGCGA | 8869 & 8870 |
| MGAT1 | CCGCAAGGGTGTGAGCCA | ACCTGCAGCTGGGGAGCA | 8871 & 8872 |
| MGAT2 | GCAGCAAGAGTGCCCTGA | GGGTCAAGGCTAGACCCA | 8873 & 8874 |
| MGAT3 | CTACGATGGCTGGACCGA | CATACACTGCCTGCAGCA | 8875 & 8876 |
| MGAT4A | GGCAACGGAAGAACAGGA | AGGTTGGCTACAACACCA | 8877 & 8878 |
| MGAT4B | GAACATCGAGCACCCGGA | TCTGGATCGAGAGGCGCA | 8879 & 8880 |
| MGAT5 | TCCCTCATACCCCAGACA | GGTCCCGTCCACTGAGGA | 8881 & 8882 |
| MGEA5 | GCGGTCACGAGCAGCCAA | ACTACGACACCCTAACCA | 8883 & 8884 |
| MGLL | ACTCCATGGGAGGCGCCA | GGGACAAGTTTGGCAGCA | 8885 & 8886 |
| MGMT | CCTGGCAGGCAACCCCAA | ACGGGATGAGGATGGGGA | 8887 & 8888 |
| MGP | TCAGGAAGCGCCGAGGGA | AGGGGTGCAGCCAGACA | 8889 & 8890 |

FIG. 1 Cont.

| | | | |
|---|---|---|---|
| MGST1 | ACGTGTACGCAGAGCCCA | GCTGTAGAGGGGTCGGGA | 8891 & 8892 |
| MGST2 | AGTCACTGGGTCACCAGA | CAATTCCCAGGGCACCTA | 8893 & 8894 |
| MGST3 | CACGGGAGAACCCAGCAA | TTGTGCCCACCAAGCCCA | 8895 & 8896 |
| MIA | GCTGTGTGCGGACCAGGA | CCCGGTGAATGGTCAGGA | 8897 & 8898 |
| MIA2 | GAAGACCAAGTTCCAGCA | GACTCCAGACACAGCTGA | 8899 & 8900 |
| MIA3 | CAGGCTGTCAGCTGCAGA | AGCACGAGCTTTGAGCCA | 8901 & 8902 |
| MICA | CGAGGCCTCAGAGGGCAA | TTCCCATCAGGCAGGACA | 8903 & 8904 |
| MICAL1 | CTGACACCCCCATCCCAA | CACAGAGGCGTTCCAGGA | 8905 & 8906 |
| MICAL3 | GGAGCAGAACGGACACCA | CTTCGGACCATCCAGGCA | 8907 & 8908 |
| MICB | GAGCCACAACACCCAGCA | CACCAGCGCCTTCCCAGA | 8909 & 8910 |
| MID1 | TGAACGCTTCACCAGCCA | CAGAGCGCCCAGGAAGCA | 8911 & 8912 |
| MID1IP1 | AGTCCATCCGCAACGACA | CCAAGTGGCCCAGGTCCA | 8913 & 8914 |
| MIER1 | ATAATCCGCCCACGTCGA | GGGTCCCACAGGAGCTGA | 8915 & 8916 |
| MIF | CTCCGAGCTCACCCAGCA | CAGGCTGCAGAGCGCGCA | 8917 & 8918 |
| MINA | CCGAGGAAAGGATCGGCA | GCCCCGAGATGGTATCCA | 8919 & 8920 |
| MINPP1 | ACGGCAGGATATGCGACA | AACTGGTGATGAGCCGCA | 8921 & 8922 |
| MIOS | CCTGGCTGTCGAAAACCA | CCCTGAACCAACTAAGCA | 8923 & 8924 |
| MIOX | CGGGATGTATCAGCCCCA | GTGCCAGGGGTAGAAGGA | 8925 & 8926 |
| MITF | GAGAACAGCAACGCGCAA | AGAGCAGAGACCCGTGGA | 8927 & 8928 |
| MKI67 | TGCTCCCCACCTCAGAGA | TAAGGGAGGGCTTGCAGA | 8929 & 8930 |
| MKL1 | TCACCGACTCCACAGGGA | AGAGCCAGGCTGGGACGA | 8931 & 8932 |
| MKNK1 | GGAGGTCTTCACGGACCA | CCCCGCAGTGACCCACGA | 8933 & 8934 |
| MKNK2 | GAGCATCCAGGAGGGCAA | CTCTGCAGGACCATGGGA | 8935 & 8936 |
| MKRN1 | ATGGATGCTGCCCAGAGA | CTCCATGCAGATCCCACA | 8937 & 8938 |
| MKRN3 | TGCAGACCTTGCACCCCA | CTCCATGCAGATGCCACA | 8939 & 8940 |
| MLEC | GCATAGCACAGCTCACGA | TGGACACCTCCCCCTGGA | 8941 & 8942 |
| MLF1 | TGAGGAGTGGCAAAGTGA | CGGGAGCCAGGATTCTCA | 8943 & 8944 |
| MLF2 | TCCGGGAGACACGGAGGA | GAGCGCTGGAGGATGTGA | 8945 & 8946 |
| MLH1 | ACTTCCAGCAACCCCAGA | GCCAAGGCCCACTGAGGA | 8947 & 8948 |
| MLH3 | TCCAGACCACCGGAGGCA | CTGGAATGGCAGCTGGCA | 8949 & 8950 |
| MLL | GCAGGAAGTCCTACCCCA | CCGCTGGGGTGATAAGGA | 8951 & 8952 |
| MLL2 | TCTGAGCCTGGGGAACCA | GCATCAGCTGAGGCGACA | 8953 & 8954 |
| MLL3 | GGCCAAGGAGCAGAAGGA | TCCCACAGGCCTCACACA | 8955 & 8956 |
| MLL4 | GGGCAGAACGAGTGGACA | TGCTGAGGCAGGAGGACA | 8957 & 8958 |
| MLL5 | CTGAACAGCACGGCACCA | GGGACTACGGCAGCAGCA | 8959 & 8960 |
| MLLT1 | CGGCCAAGGACAAGAGCA | TGACTGGGCAGACTCGGA | 8961 & 8962 |
| MLLT10 | GCTCAACAAGGCTCAGGA | GGAGTCTGCATAACCCCA | 8963 & 8964 |
| MLLT11 | CCAGGAGAAAAACCCTGA | CAAGTCCAGTTCGAAGGA | 8965 & 8966 |
| MLLT3 | GGAGGGCTTCACCCACGA | CGTGCAAGTGGAAGACGA | 8967 & 8968 |
| MLLT4 | AAGCCTACCCCATCCCCA | GGTTCTGAGGAGGAGCCA | 8969 & 8970 |
| MLLT6 | CCTTACTAGGGGCAGGCA | GGTAGAGCCAGCCAGAGA | 8971 & 8972 |
| MLPH | GGCCTCAGAAGTCCAGCA | TCCCAGCCACTCGAGGGA | 8973 & 8974 |
| MLXIPL | GAACCCGTACGCTGCACA | GAGAGCGGGCAGAGAGCA | 8975 & 8976 |
| MLYCD | CATCAACTGGATGGCGGA | CTTGGAGCCGAGGTAGGA | 8977 & 8978 |
| MMAB | CCAGTGCACATTGCAGGA | GCAGGATGAAGGCCGTGA | 8979 & 8980 |
| MMD | ATGGCCGCTACAAGCCAA | AACGATGAAGAGGGCACA | 8981 & 8982 |
| MME | AGGACACGAAATCACCCA | ACCTGCCAGGTCCCAGGA | 8983 & 8984 |
| MMP1 | CCCAGGTATTGGAGGGGA | GCTAGCTGAACATCACCA | 8985 & 8986 |
| MMP10 | AGGTGATGCGCAAGCCCA | CACTTCGGCATGCCAGGA | 8987 & 8988 |
| MMP11 | TCTCGCCACTGGCAGGGA | TCTCGGGACCCCAGACCA | 8989 & 8990 |
| MMP12 | AGTGATCCAAAGGCCGTA | TACAGGGACTGAATGCCA | 8991 & 8992 |
| MMP13 | AGGACCCTGGAGCACTCA | CATCGTCATCAGGAAGCA | 8993 & 8994 |
| MMP14 | CTGGCTACCCCAAGCACA | CAGGGATCCCTTCCCAGA | 8995 & 8996 |
| MMP15 | GGCGCTTCAACGAGGAGA | CTTTAGGGGAGGCAGGGA | 8997 & 8998 |
| MMP16 | CCAATGACCCCACTGCCA | TAGAGCGGTGTGGGGGCA | 8999 & 9000 |
| MMP17 | GGCGCTACGATGACCACA | CCAGCTCGCCATCCAGCA | 9001 & 9002 |
| MMP19 | CTGGCGCCTCAACCAGCA | ATGCCCGTACCTGAGGGA | 9003 & 9004 |
| MMP2 | ACCCCAAGCCACTGACCA | TGCAGGTCCACGACGGCA | 9005 & 9006 |
| MMP20 | CAGGAATTCGGCCCAGCA | CAGTGCCCCTCTCAGCCA | 9007 & 9008 |
| MMP21 | CCTACAGGACGGGATCCA | GATCCCTCACAGGAGCCA | 9009 & 9010 |
| MMP24 | TCACCGTGTGGAAGGGCA | GGATGCAGGGGATGACCA | 9011 & 9012 |
| MMP25 | GGTGTTCCAGGACCGGCA | ACGAGAACACGGCGTCCA | 9013 & 9014 |
| MMP26 | CATCCGCAGTGAAAGACA | GCATGGCCTAAGATACCA | 9015 & 9016 |
| MMP27 | GCAGGCACCTATGGAGGA | TGCAGATCAGCTGGCAGA | 9017 & 9018 |
| MMP28 | CCAAAGCTCCCACCTCCA | GACGAGTCATCTGGCGCA | 9019 & 9020 |
| MMP3 | GGCGCAAATCCCTCAGGA | TGCGGCATCCACGCCTGA | 9021 & 9022 |
| MMP7 | GCTGGACGGATGGTAGCA | AGGAATGTCCCATACCCA | 9023 & 9024 |
| MMP8 | GGCCAAGGTATTGGAGGA | ATCAAGGCACCAGGGTCA | 9025 & 9026 |
| MMP9 | CTCGACCTGTACCAGCGA | GGCTCAGGTTCAGGGCGA | 9027 & 9028 |
| MMRN1 | GTCCCAGGTGGGAAAGGA | GGCCCACTGTATCCAGGA | 9029 & 9030 |
| MMRN2 | TCAGCGCAGCTTGGAGCA | CCCAAGGCACCTGGCACA | 9031 & 9032 |
| MMS19 | CCGAGCAGATTCCAGCCA | TTCGAGGCAGGGAGCAGA | 9033 & 9034 |
| MMS22L | TACGGGAACGTCCAGACA | GTCAGCTGCAGCCCTGCA | 9035 & 9036 |
| MN1 | GGAGAAGGCCAAACCCCA | AGAATGCAGGGACCGCCA | 9037 & 9038 |
| MNAT1 | GAAGTGGAACGACAGGAA | AGCAGAGCAACAGGGAGA | 9039 & 9040 |
| MNDA | CACCTGCACCCACCGCAA | GGATGATCCACAGCTGCA | 9041 & 9042 |
| MNX1 | GCTGGAGCTGGAGCACCA | CTCGGTGAGCATGAGCGA | 9043 & 9044 |
| MOCOS | CCAGGTGGCCTGTAGGAA | GAAGGGCTGGATCAGGCA | 9045 & 9046 |
| MOCS1 | CCTGCAACCGCCTGCGAA | CTGCCCACAGCAGCCCCA | 9047 & 9048 |
| MOCS2 | CAGTGTCAGAAGCAAGCA | GCTCACAGCTTCAAGAGA | 9049 & 9050 |
| MOG | GAGGAGGCAGCAATGGAA | TGTACTGCAGGCAGAGGA | 9051 & 9052 |
| MOGAT2 | TGTAGGGGGTGCCCAGGA | TGGAAGACACCACGGCCA | 9053 & 9054 |

FIG. 1 Cont.

| | | | |
|---|---|---|---|
| MOGAT3 | GTCCGGTGAGCCGCCAGA | CTGGCACCAATGCTGCCA | 9055 & 9056 |
| MON2 | GGCAGCACAGCAAAAGCA | GCAGGACGGGGATCCACA | 9057 & 9058 |
| MORC1 | GCTGAGAGATCCCAGAGA | CAAGAAGCGGCCTGGGCA | 9059 & 9060 |
| MORF4L1 | GCGCCACATCTCCTGAGA | CGATGGTACTCAGGAGGA | 9061 & 9062 |
| MOS | AGGAGGCACATACACCCA | CTCGAAGACGGCAGCGGA | 9063 & 9064 |
| MOSC2 | AGGCAGAGACTGTGGCAA | CATGATCAGGAGCGGGCA | 9065 & 9066 |
| MOSPD1 | CGAGCAAAGCCAAAGGAA | GTAGAGAGGCACCAGCGA | 9067 & 9068 |
| MOV10 | GCACTTGCCCAAAGCCCA | CCTCAGGTACCATGCGGA | 9069 & 9070 |
| MOXD1 | CGAGTGCTATCACCCCAA | CCAGCCTCAATCACCCCA | 9071 & 9072 |
| MPG | GCACCCTCCGGAAAGGCA | TCACTGGGCTCCAGGGGA | 9073 & 9074 |
| MPHOSPH10 | CGGAAGTCGGCAAAGCCA | GCAAGGGGCTTCCATGGA | 9075 & 9076 |
| MPI | CCCAACACGGAGTCAGGA | CCAATGAAGAGCACGCCA | 9077 & 9078 |
| MPL | CTAGGGTGGAGACCGCCA | CTGGAAGTGAGGGCCACA | 9079 & 9080 |
| MPO | CGAGCCTCTGAAGCGCAA | ACCGATCACCATCCCGGA | 9081 & 9082 |
| MPP1 | CTCCTAGCGAAGCCCCGA | TATGGGACAGGGTACACA | 9083 & 9084 |
| MPP2 | TGGGCGCTACCTGGAGCA | TGACATCCAGCACGCACA | 9085 & 9086 |
| MPP5 | GCAAGCATTCGAGGCAGA | TGGCCAATAATGCCCGAA | 9087 & 9088 |
| MPPED1 | TGCTCAACACGGTGCAGA | ACAGTGCATACGGACGCA | 9089 & 9090 |
| MPPED2 | ACCTCATCCCTGAGGGCA | ACAGCTCCACACAGCCCA | 9091 & 9092 |
| MPZL1 | CACTACTCCCAAGGGCAA | GTCCAGGCTGGACAACGA | 9093 & 9094 |
| MPZL2 | GGTGAAGAACCCACCTGA | CCAGAGCCAGGAAGTGGA | 9095 & 9096 |
| MR1 | ACCTATCAGGCGTGGGCA | ACAAGGACAATGGACCCA | 9097 & 9098 |
| MRAS | ACAGCTGGGCAGGAGGAA | TAGACGATGAGGAAGCCA | 9099 & 9100 |
| MRC1 | GACGACTCCCGAACCCAA | TCCACCCAGAGCTCGACA | 9101 & 9102 |
| MREG | CGGCAGGTTCGAAGGGAA | CTGCAGCATCAAGTGCAA | 9103 & 9104 |
| MROH7 | CACGGGCTGTGAACACCA | TCCAGAGCCTCACAGCCA | 9105 & 9106 |
| MRPL11 | AAAGCTCAGGATGAGGCA | AGGTCCTTCACCACGCGA | 9107 & 9108 |
| MRPL14 | ACCCTGTGGGGACACGAA | AATGGCCAGCACCTTGGA | 9109 & 9110 |
| MRPL15 | GGCAGAGGCCATAAAGGA | TAGGATCAACACGACCCA | 9111 & 9112 |
| MRPL18 | CGCCCCAGAATTCACCAA | CTCACGAGTGGAGGCCGA | 9113 & 9114 |
| MRPL2 | CTGGATCATCGCCACAGA | TGAGGGTCCCCACAGGCA | 9115 & 9116 |
| MRPL21 | TGCCAGCCGCCAGTGGAA | GCTTGCCAAGCAGCGTGA | 9117 & 9118 |
| MRPL23 | GCGGACACGGGTGCAGCA | CCAGCTGCACGTAGGCGA | 9119 & 9120 |
| MRPL24 | GGGAGGGCTGAACACACA | TGACCTGGCGGTGGAGCA | 9121 & 9122 |
| MRPL27 | AGTCCGCTACACTAAGGA | GCACAGCACCCTTGGGCA | 9123 & 9124 |
| MRPL3 | CGGGGAACAGAACACACA | ATGCCCAGCTTCAAGGCA | 9125 & 9126 |
| MRPL32 | CGAAACTACTGGGAGCGA | AATGCTGGTCCCCACGGA | 9127 & 9128 |
| MRPL34 | CGAGCAACATCAAACGCA | TGAGCATTCGGCGAAGGA | 9129 & 9130 |
| MRPL35 | GCTGGTGCAGTGAGAGCA | CGTCCAGTGGACAATGCA | 9131 & 9132 |
| MRPL37 | AGCCCGTGGTGGTGCAGA | CTGAGTCCACCCAGGCCA | 9133 & 9134 |
| MRPL41 | GAGCAAGTGGACGAGCAA | AGCTTGAAGCCGGTCAGA | 9135 & 9136 |
| MRPL55 | CGCCAGGCTTATGCACGA | CTATGGGCATCGCCAGCA | 9137 & 9138 |
| MRPL9 | CCAGACCAAGGCAGGTGA | TACCGTCACCTCACACCA | 9139 & 9140 |
| MRPS11 | ACAGCAGGCATAGCCGCA | GCCCCAGGCCTTTCACCA | 9141 & 9142 |
| MRPS12 | GTCGAGTGCGGCTCAGCA | TGCCACGCACAACGGTGA | 9143 & 9144 |
| MRPS14 | GCGATGTGAAGAGACGAA | CGCTTCACACCACGCGGA | 9145 & 9146 |
| MRPS15 | GAAAGGACAAAGCCCACA | CTCAATTCCCAGCCCCCA | 9147 & 9148 |
| MRPS18B | CAGCGGACTCGGAAGACA | GATACCCGTGTGGGCGCA | 9149 & 9150 |
| MRPS22 | GTATAGCCAGGACAGGCA | GCACGTGATACAGCTGGA | 9151 & 9152 |
| MRPS28 | GTTGGAGCGGCACTCGGA | AGATCCGTCCAATGACCA | 9153 & 9154 |
| MRPS30 | ACCTGAACCTGCGCTGGA | AGGGTTGACACCAGCTGA | 9155 & 9156 |
| MRPS31 | GTGGACAAAAGAGGGGAA | CACAAGTCACCAGCTCCA | 9157 & 9158 |
| MRPS35 | CCACCAAGAAGAAAGGCA | ACAGGAAGAGGTACTGCA | 9159 & 9160 |
| MRTO4 | CACCAACCGCACAAAGGA | GCTCCATGGAGTGGGGGA | 9161 & 9162 |
| MS4A1 | AGCCAATGAAAGGCCCTA | CAGAGAGGGTACCACACA | 9163 & 9164 |
| MS4A14 | CCCAGGACAGAAGGGCAA | AGTGCTCCCCAGAATGGA | 9165 & 9166 |
| MS4A2 | CTCATCCCCACCACTGCA | GAGCAGACAACTGTTCCA | 9167 & 9168 |
| MS4A3 | GTCACCGGACCTATGCAA | GCAAGGTGAGAATCAGCA | 9169 & 9170 |
| MS4A4A | ATGGAACAGGCCATGCCA | CTAAGGCTCATCAGGGCA | 9171 & 9172 |
| MS4A6A | GCTATACAGCCAAAGCCA | GCCAGCACACTCACCCCA | 9173 & 9174 |
| MSC | CAAGCAGTCGCAGCGGAA | AACTGGAAGCCAGCCGGA | 9175 & 9176 |
| MSH2 | TGGGGAAACTGAGACAGA | GATTACCGCAGACAGTGA | 9177 & 9178 |
| MSH3 | GAATCAGCTCCGGGAGCA | AGCGACCTTGGCCAGGGA | 9179 & 9180 |
| MSH5 | CCTCAACCAGGTGGCGAA | CCAGCCAGTGTCGGAGCA | 9181 & 9182 |
| MSH6 | AAGGACTGCATGCGGCGA | GGGCGACACATAGGACCA | 9183 & 9184 |
| MSI2 | GGGGACTGCCTTACACCA | CATAAGCCGCTGCTGGGA | 9185 & 9186 |
| MSLN | GATCCTACGGCAGCGGCA | CTAGGAGCAGTGCCAGGA | 9187 & 9188 |
| MSMB | GGTGGAGAAGAAGGACCCA | GACTATTAGAGGCCAGAGGAGA | 9189 & 9190 |
| MSN | GTGCATGGGGAACCATGAA | CAGCATAGCACGCTCCA | 9191 & 9192 |
| MSR1 | CGTGCACAAGGCAGCTCA | GTGCAAGTGACTCCAGCA | 9193 & 9194 |
| MSRA | ACATCCGGGAGGGACAGA | GACACGCCGGTGCCCCCA | 9195 & 9196 |
| MSRB2 | CACACAGGGATCCTGAGA | GGCCCAGGTCCATCAGGA | 9197 & 9198 |
| MSRB3 | AACACCCCTGCAGTACCA | GAATGAAGGCCAACCTGA | 9199 & 9200 |
| MST1 | CCACAGCATGGAGAGCCA | ATTCAGGGGGCAGGCAGA | 9201 & 9202 |
| MST1R | TGAGAGCTGCCAGCACGA | CCAGTGCAGCCACAAGCA | 9203 & 9204 |
| MSTN | TTGACATGAACCCAGGCA | CCTGGGAAGGTTACAGCA | 9205 & 9206 |
| MSX1 | CGCGCCAAGGCAAAGAGA | GGGCCGTGTAGAGTCCCA | 9207 & 9208 |
| MT1G | GCAAGTGCAAAGAGTGCA | CCCTGGGCACACTTGGCA | 9209 & 9210 |
| MT3 | GCAAGTGCGAGGGATGCA | CTCACACTCCGCAGGGCA | 9211 & 9212 |
| MT4 | GTGTGGAGACAACTGCAA | GGGGCAGCAGGGACAGCA | 9213 & 9214 |
| MTA1 | GAGAGAGGCCAGGACCAA | GCGCAGGATCTCACGGCA | 9215 & 9216 |
| MTA2 | CTCACAGCCAGCAGCCAA | GGCAAGTTGGGTCGGCGA | 9217 & 9218 |

FIG. 1 Cont.

| | | | |
|---|---|---|---|
| MTA3 | GCCATGCAGGGAATGCCA | TTGCAGACCTGACGAGCA | 9219 & 9220 |
| MTBP | GGAATGGCCAGAAAGGCA | GCCCAGCAACTGTTCAGA | 9221 & 9222 |
| MTCH1 | GGATGACAGCTTCAGCCA | GGTCGCCAACTAGCAGGA | 9223 & 9224 |
| MTCH2 | AAGGGTGAGGAGTTAGGA | GAGGAACAAGACCCGCGA | 9225 & 9226 |
| MTCP1 | CGCAGCTAGGCCAAGTCA | TATCTGCCACAAGCGAGA | 9227 & 9228 |
| MTDH | CTTCCCAAGTGCCGCCAA | GTCTGTGAAGGAGGCACA | 9229 & 9230 |
| MTF2 | AACTGAGGGAACTGCACA | GGTATTGCAGCAGGCCAA | 9231 & 9232 |
| MTHFD1 | AAAGGTGGCGCTGCAGGA | CGAGCATCAATGGCCGCA | 9233 & 9234 |
| MTHFD2 | ATCAAGGAAGGAGCAGCA | ATGGGGCCAACACCTCCA | 9235 & 9236 |
| MTHFD2L | GACCACGTTGATGAGCGA | ATCTTCCAGCCACAACCA | 9237 & 9238 |
| MTHFR | CAGCCTGCTGAAGGAGGA | CACGATGGGGTCGGAGGA | 9239 & 9240 |
| MTMR10 | TCACCAGCGAGTGAAGCA | CTGGAGAGACCAGTCCCA | 9241 & 9242 |
| MTMR11 | AGCCTGGCTGACCAGGAA | GGTAGCAGCGTCTCCAGA | 9243 & 9244 |
| MTMR14 | AGAGACTCGGCTGCAGGA | CCGATGGCACCGGAAGGA | 9245 & 9246 |
| MTMR8 | GGCACCCTATCCAGGGAA | TGCCAGTGGCCTCAGAGA | 9247 & 9248 |
| MTNR1A | GGGTGAAACCTGACCGCA | GTTCAGAGGAGCCCAGCA | 9249 & 9250 |
| MTNR1B | AAGCCAAGCCAGAGAGCA | GGTTGATGGCCACAGCGA | 9251 & 9252 |
| MTOR | TGCGAGAGCACAAGGACA | CTGGCCAGCAGAGTAGGA | 9253 & 9254 |
| MTR | CTGCAGAGCCCATAGCCA | GGCCCAGGTAGTCACGGA | 9255 & 9256 |
| MTRF1 | AGTTCAGCGCATCCCCGA | CATCTGGCTGAGGAAGGA | 9257 & 9258 |
| MTRR | GGCCAGGAGGAAAGCCAA | CAGATCACGCTGAAGGCA | 9259 & 9260 |
| MTSS1 | GGTGACCAGGAGGCAGA | GTGGTGGGGAGGCCAGCA | 9261 & 9262 |
| MTTP | AGGCTGTCCACAGGCAGA | CTATCCGGCTGAGGGGCA | 9263 & 9264 |
| MTUS2 | AAACTGGGGACCCGACCA | GCTGACTCTGGCCGGAGA | 9265 & 9266 |
| MUC1 | CCACGACGTGGAGACACA | GGCACTGACAGACAGCCA | 9267 & 9268 |
| MUC13 | GACAGTGAGTCAACCACA | GCCAGTGGGAGGCCCTGA | 9269 & 9270 |
| MUC17 | CTGCTGAAGGTACCGGCA | GTGGTGCTGACAGGCACA | 9271 & 9272 |
| MUC20 | TGAAGCCCCCAACAGCCA | TCAGCCGCAGGAGGAGGA | 9273 & 9274 |
| MUC4 | CTTGAGCCTCACGACGCA | AGAGCGCGATCACCGAGA | 9275 & 9276 |
| MUC5B | TCTGCCCTGAGGACCAGA | GCTTGCACTGCACCGACA | 9277 & 9278 |
| MUC6 | TGCCACCTGCCACAGCAA | CGCAGTAGATGGGGCAGA | 9279 & 9280 |
| MUC7 | GAGACCACAGCTGCCCCA | CAGAAGGTGTGGGTGGGA | 9281 & 9282 |
| MUCL1 | CCAGCTGACACGTATCCA | GCAGTGGTAGGAGCAGCA | 9283 & 9284 |
| MUTYH | CAGAAAGGCCAGCCGCAA | CGGACGGGAACTCCCACA | 9285 & 9286 |
| MVD | CCCAGGCTCGAATGGAGA | CGCAGGGGTCATCCAGGA | 9287 & 9288 |
| MVK | CGAAGCAGGCCCTGACCA | GACTCGGCTGTCCAGGGA | 9289 & 9290 |
| MVP | GCTGAACAAGGGGCAGGA | GCCCAGCTGAGAGGGACA | 9291 & 9292 |
| MX1 | CCACAGAGGCTCTCAGCA | ACACGAGGTTCCGCACCA | 9293 & 9294 |
| MX2 | CCAGCAAACGTCTCGCCA | CTCTTGAAGCAGCCAGGA | 9295 & 9296 |
| MXD1 | CAGCAGCAGTGTGAGCGA | CCAAGACACGCCTTGTGA | 9297 & 9298 |
| MXD3 | CATCCAGAAGCTGGAGGA | CTCAGAGGAGAGGCCTGA | 9299 & 9300 |
| MXD4 | GCAGCTGCAGCAGGAGCA | ACAGCAGAGCCCGTGCTA | 9301 & 9302 |
| MXI1 | GCGACTGGAACAGCTGCA | CGCTCTGAATCAGAACGA | 9303 & 9304 |
| MXRA5 | GGTGGGACTGAAGCCAGA | AACACCGAGGCCTCACGA | 9305 & 9306 |
| MXRA7 | CTGGAGGAGGAGCAGAGA | CTGCACGTCGCCGTCGGA | 9307 & 9308 |
| MYB | CCTGCAAGGCACAGCACA | ACAGGGGAACGCTTGGGA | 9309 & 9310 |
| MYBBP1A | GGAAAACCAGGCCCGAGA | GGTCTGCGAACTGCACCA | 9311 & 9312 |
| MYBL1 | GGAGCCATGGAATGCCAA | TGCCTGGGGAATGACCCA | 9313 & 9314 |
| MYBL2 | TCTCAGACCTGAGCCGGA | TCTCAGTGACAGGGGACA | 9315 & 9316 |
| MYBPH | TGGAGCGCTACCACCCAA | CGAGGTGCTGAGTCCACA | 9317 & 9318 |
| MYC | CAGCGACTCTGAGGAGGA | ACCCTCTTGGCAGCAGGA | 9319 & 9320 |
| MYCBP2 | GCTGAATCCCCAGGACCA | TGAGGAGGAGCGTGGAGA | 9321 & 9322 |
| MYCL | GGAGCGCAAGAGGCGGAA | CCCCACCAGGGCTTGCA | 9323 & 9324 |
| MYCL1 | CTTGGCGCTGAGGGACCA | GCTGCTGCCGGCATCGGA | 9325 & 9326 |
| MYCN | TCTCACGCTCAGGGACCA | CGGCCTGGAGGGAGTGGA | 9327 & 9328 |
| MYD88 | AGAAGCGACTGATCCCCA | CTTGGCAAGGCGAGTCCA | 9329 & 9330 |
| MYF6 | GCTAAGGAAGGAGGAGCA | CACCACTTCCTCCACGCA | 9331 & 9332 |
| MYH1 | TTACCCGAACCCAGGCCA | CAGGGCCAGTGCTTCACA | 9333 & 9334 |
| MYH10 | CAAGAACCGCCTGCAGCA | CGGCATAGCGAGCAGAGA | 9335 & 9336 |
| MYH11 | ACGCAACACCACGCCCAA | TCCAGCACCAGGAACGCA | 9337 & 9338 |
| MYH14 | GGAAAGACGTGGAGGGCA | GGGACAATGCAGCGGACA | 9339 & 9340 |
| MYH2 | GGAAGCCCGCAATGCAGA | TCCCACCCTTCAGGGCCA | 9341 & 9342 |
| MYH3 | TGCAGCGGGTCAAGCAGA | CCTCCAGGGTTCGGCAGA | 9343 & 9344 |
| MYH4 | CTCAGCTATCCCGAGGCA | CGCAGCAGGTCACAGTCA | 9345 & 9346 |
| MYH6 | GGCAGAGATCGAGCGGAA | TCTGCAGCGAGTCCACCA | 9347 & 9348 |
| MYH7 | TGCAGCGGGTGAAGCAGA | CTTCCAAGGTCCGGCACA | 9349 & 9350 |
| MYH7B | GCAGGAAGGCCACAGAGA | CGGCATTGAAGGCACGGA | 9351 & 9352 |
| MYH8 | CCAGGAGGACCTCAAGGA | TGGACACGCTCACTGGCA | 9353 & 9354 |
| MYH9 | GCCCAAGCAGCTGAAGGA | CCTTCCACAGCTCCGAGA | 9355 & 9356 |
| MYL12A | ATGAGGCTCCAGGCCCCA | CTGTAAACCGATCCCCCA | 9357 & 9358 |
| MYL12B | TCAGCGTGCAACATCCAA | TCCCTAGAGAAGCAAGCA | 9359 & 9360 |
| MYL2 | CGGACCCTGAGGAAACCA | CCGCCTGCGTGGTCAGCA | 9361 & 9362 |
| MYL3 | CACAGGCACCTATGAGGA | GTGGCCAGCACGTGGCGA | 9363 & 9364 |
| MYL4 | CAAGGAGCAGGGCACCTA | CTCCCAGGGTGGCAAGGA | 9365 & 9366 |
| MYL7 | GAGTGTCCCAGAGGAGGA | ACATGCGGAAGGCACTCA | 9367 & 9368 |
| MYL9 | GAAGCTGAACGGCACGGA | TGGTGAGCAGCTCCCGGA | 9369 & 9370 |
| MYLK | GCCCATGGGCAATGCCAA | ACACCTGGCACTGGAGCA | 9371 & 9372 |
| MYLK4 | CTCGGAGGAGGCCAAGGA | TCCTGGGCATCAGAGCCA | 9373 & 9374 |
| MYLPF | GAGGATGTGATCACCGGA | CACACTGCGTGGTCAGCA | 9375 & 9376 |
| MYO15A | GGTCAGCACTGCACGAGA | TGATGCCCACGTGGGACA | 9377 & 9378 |
| MYO19 | CACACAGCGAGGAAGCCA | GCCTCAGCCGAGTCACCA | 9379 & 9380 |
| MYO1B | GAAGCAACGCCTGGAGGA | CTCCTGTACCAGGCGGCA | 9381 & 9382 |

FIG. 1 Cont.

| | | | |
|---|---|---|---|
| MYO1C | GCTAAACCTGAGGCGGCA | AGGGCTGATACTCCGGCA | 9383 & 9384 |
| MYO1E | CGCTCAGGACACAGACGA | TAGTCGACCCGTCCACCA | 9385 & 9386 |
| MYO1F | GAGGAGATGCGGGAGGAA | CACACTTGGGCGTCAGGA | 9387 & 9388 |
| MYO1G | GCAAGGGCTTCGTCAGGA | AGCACAGCCCCGAAGCCA | 9389 & 9390 |
| MYO3A | TACCCGGCACCGTCGGAA | AGGTCAGCTAGTGGAGGA | 9391 & 9392 |
| MYO5B | TGAGGAGGAGGTGGAGCA | GCAGTAGCGTCTGGCAGA | 9393 & 9394 |
| MYO5C | GTCCTCAGGACCCAAGGA | GAGAGTCTGCGTAGCGCA | 9395 & 9396 |
| MYO9A | CCTGACACCACTGACCCA | GACACAGAAGGCAACCGA | 9397 & 9398 |
| MYO9B | GTTCCCAGAAGACGCCCA | CCAGGTTGCTGACGACGA | 9399 & 9400 |
| MYOC | CAGCACCGATGAGGCCAA | GGTGTACAAGGTGCCACA | 9401 & 9402 |
| MYOF | GAGCCTCCTCCTGAGAGA | AGAAGGTCACCCACCGGA | 9403 & 9404 |
| MYOG | GAGTTCAGCGCCAACCCA | CACGATGGAGGTGAGGGA | 9405 & 9406 |
| MYOM1 | GGTTCGAGGCCTCAAGGA | GGACGGGTCTCTGCCACA | 9407 & 9408 |
| MYOM2 | GGAAACCCTGACCCCGAA | GCTCCACCTTCACCGAGA | 9409 & 9410 |
| MYOM3 | GCCCATCAGGGTCAAGCA | GGTCCAGGAAGTAGCCCA | 9411 & 9412 |
| MYOT | ATAACCAGTCCCCAGCCA | AGGTTGGCCAGCTGAGGA | 9413 & 9414 |
| MYOZ1 | AGAAGGCCTCCAAACGCA | GTCTACAGGCTCCCCAGA | 9415 & 9416 |
| MYST1 | GTACTGGAAGGGCCAGCA | TGAGGCAGACGGAGTCCA | 9417 & 9418 |
| MYST2 | TAGACATCTCCAGCCCCA | ACAGCCTGGTGTAGGACA | 9419 & 9420 |
| MYST3 | GCTGCAGCAGCTGACCAA | GGAGTCCCAGCTAAGGGA | 9421 & 9422 |
| MYST4 | GCAACCTCACCTCCAGCA | TCGGAGGCCTCTCCACCA | 9423 & 9424 |
| MZB1 | CACAGCCCCACAACTGGA | TGCAGGCATCACAGCGCA | 9425 & 9426 |
| N4BP2L2 | GCTTGGGAAATGAAGCCA | CGATCCAACATCTGAGCA | 9427 & 9428 |
| N6AMT2 | GAATTGGCAACTGAGCCA | GGGCACTCACACATGCGA | 9429 & 9430 |
| NAA11 | GGCCAAAATGGAGGAGGA | GCTTCTGGGCCAGGCCGA | 9431 & 9432 |
| NAA38 | GGACGGAGAGCGCGAGGA | GCAGAGGAAGCAGCCGA | 9433 & 9434 |
| NAAA | AAGACTCCAGAGGCCACA | ATCAGCCAGCTGACGGGA | 9435 & 9436 |
| NAALADL1 | CAGCCAGGATCTACCCCA | CAGTCACCAGAGGCCCCA | 9437 & 9438 |
| NAB2 | GAAGCCACCTCTCGCAGA | TCCTGCGACCCTCCACCA | 9439 & 9440 |
| NACA | CAAGCCCAGCTGGCGGCA | CCGAAGACCCAGTTTGGA | 9441 & 9442 |
| NADSYN1 | GGAGGAAGCAGCAGGGAA | GATGTCCGCACTGGAGCA | 9443 & 9444 |
| NAGA | GCATCCAGGGACGCAGGA | AGGGAGGAGTGGTAGCGA | 9445 & 9446 |
| NAGK | AGGTGCTCAGCAGGGAGA | TCTTCCACACAGAGCCCA | 9447 & 9448 |
| NAGLU | GACCTCACTCGGCAGGCA | GCAGCAGCTCATAGGCCA | 9449 & 9450 |
| NAGPA | CCCCTCTAACTGCAGCCA | ATGCCAGCCAAGGGGACA | 9451 & 9452 |
| NAGS | CCTGGTGTGCAACGCCGA | GGTGATGACGGCCGAGGA | 9453 & 9454 |
| NALCN | CTCAACAGCCACCACCCA | CGGTCACCATGCTCAGGA | 9455 & 9456 |
| NAMPT | AGAAGTACACAGGCACCA | AACCTCCACCAGAACCGA | 9457 & 9458 |
| NANOG | CCACCAGTCCCAAAGGCA | ACACACAGCTGGGTGGAAGA | 9459 & 9460 |
| NANOS1 | CCGGCTGCTGAAGCCCGA | TAGCGGCGCAGCACGGGA | 9461 & 9462 |
| NANOS2 | CCAAGAGATTGAGGAGCCA | CACACGTAGTGCCTCAGGA | 9463 & 9464 |
| NANP | GGAGGCCTCAATGCAGGA | GCAGGTAACTCTAGCACA | 9465 & 9466 |
| NAP1L1 | GTGCACAGATAGAAGCCA | GGCTGATAGAGAACAGCA | 9467 & 9468 |
| NAP1L2 | AGGAGGAGGAGGACGACA | CTGAGGGGCTCGCCAGGA | 9469 & 9470 |
| NAPA | CGAACAGGTGGGGACCAA | GCATTCCCGGGAATCAGA | 9471 & 9472 |
| NAPEPLD | TACATGGGTCCAAAGCGA | CTCCTCCCACCAGTCCAA | 9473 & 9474 |
| NAPG | AAAGATGTGTCCGGGAGA | CTCAGGCCCAGCTTAGCA | 9475 & 9476 |
| NAPSA | CCCTCATCACAGGACCCA | CGGACAAGCAGAGGCGGA | 9477 & 9478 |
| NARF | CAGACATGCGGCCAAGGA | ATCCTCCAGCACAGGCGA | 9479 & 9480 |
| NASP | GTGAAGGAGGCTGAAGGA | GGCAATCATGGAGACTGA | 9481 & 9482 |
| NAT1 | GACCATTGATGGCAGGAA | AACGGAAGACACAAGGCA | 9483 & 9484 |
| NAT10 | CATGGGGAAGCCAGCCCA | CCCCAAGAGAAGAGCCGA | 9485 & 9486 |
| NAT8 | GCACAGACATGTCTGACA | CAGGCAGAGCTCCTACCA | 9487 & 9488 |
| NAV2 | GCAGTTACGGCCTGAGGA | AGCGGGTCACCTTCAGCA | 9489 & 9490 |
| NAV3 | CTCTGCAGGCAGCAAGGA | CATGATGGCTGAGGGGGA | 9491 & 9492 |
| NBEAL1 | GCATCAACCCATTAGCCA | CCTGAACGCATCTCAGCA | 9493 & 9494 |
| NBL1 | CCCCAACACCTTCCCACA | GGGCACTCCAGCGTCACA | 9495 & 9496 |
| NBN | CAAGAAGCAGCCTCCACA | AGACAACTGCGGAACTCA | 9497 & 9498 |
| NCAM1 | GCAGTGAGTCAGAGGCCA | TCACACACAATCACGGCA | 9499 & 9500 |
| NCAM2 | GCTCTCCAGAACCCGCCA | GCCCTGCAGACATAAGGA | 9501 & 9502 |
| NCAN | GGGGTCTTCGACACAGCA | GCTGTACACTGAGGGCCA | 9503 & 9504 |
| NCAPD2 | GACCACCATGGAGGAGGA | TCTCGCAGATGCCACGGA | 9505 & 9506 |
| NCAPH | TGACACTCCAGAAGCCCA | CGGAGAGCGCTGTCAGCA | 9507 & 9508 |
| NCAPH2 | GGAGACAGAGCTGAGCCA | GAGGCCAGCATGGAACGA | 9509 & 9510 |
| NCBP1 | TAGAGAGGCTGCAGCAGA | ACTGCTGGAACACGGCCA | 9511 & 9512 |
| NCEH1 | GCCCGTCTAAACTGGACA | CGGAGCGGGCATCCAGCA | 9513 & 9514 |
| NCF2 | ACAGCCAGGTCCGGGACA | ACACCACAGAGTCAGGCA | 9515 & 9516 |
| NCF4 | GGAGCTCACAAGGCGGGA | TCATCCGACAGCAGCCGA | 9517 & 9518 |
| NCK2 | GCAGCTACAACGGGCAGA | CACATGCAGCACGCGGGA | 9519 & 9520 |
| NCKAP1 | CCCTGCTATAGAAGGGCA | TGGAGGATGCAAGCGCCA | 9521 & 9522 |
| NCKAP1L | TGCAGCTGGGCCAGGAGA | TAGGTGGAAGGCCCGAGA | 9523 & 9524 |
| NCKIPSD | GCGAGGGACATGCAGACA | GTGTCCAAGGGCAGCCCA | 9525 & 9526 |
| NCL | AAGCTGCCAAGGAGGCCA | CGGCCTCCTCTACCACCA | 9527 & 9528 |
| NCOA1 | CCCGCACTGAGACACACA | GTACACTGGACGTCAGCA | 9529 & 9530 |
| NCOA2 | GCAGCTGCTGACCACCAA | GGCCAAGTCCACAGGGGA | 9531 & 9532 |
| NCOA3 | CCACAAGCTCCTCCGCAA | GATTCTGGGAGGGACCCA | 9533 & 9534 |
| NCOA4 | GATGCCTGTGGAACCCAA | CCTGATAAGCCACTCCGA | 9535 & 9536 |
| NCOA6 | GCCAAGGGCTAGACACCA | AGCGTACACTGGTGGGGA | 9537 & 9538 |
| NCOA7 | CAAAGCGCAGGAAGAGCA | CAGGAAGGCGTCGGGCCA | 9539 & 9540 |
| NCOR1 | TGTCCAGAGGCTCACCCA | ACGACAGGGTCCACCCCA | 9541 & 9542 |
| NCOR2 | ACAACCAGCCCTCCGACA | GGTCATAGCGCTGGCAGA | 9543 & 9544 |
| NCR1 | GGGATCACACTGCCCAGA | GCCAGTCTTCAACCAGGA | 9545 & 9546 |

FIG. 1 Cont.

| | | | |
|---|---|---|---|
| NCR3 | TCGGGACAGGGAATGGGA | CCCACGGCCACAGAGAGA | 9547 & 9548 |
| NCR3LG1 | GCCTTGCGAGACAACCCA | CTGGAGGAGGTTCCCAGA | 9549 & 9550 |
| NCS1 | GAAAACAAGGACGGGCGA | GTAGAGCTTGAAGGCCCA | 9551 & 9552 |
| NCSTN | CCGAGAGCAGTGCCAGGA | CGTGCAGTAGAACGCACA | 9553 & 9554 |
| NDC80 | CCAGAGGCAAAGAAGCGA | ACAAGGCAGTTGGCACCA | 9555 & 9556 |
| NDP | AGCACTGTCCTCAAGCAA | ACCGGTAGGTGGCAGTGA | 9557 & 9558 |
| NDRG1 | CTGGAGATTGAGCGACCA | GAAGTGACGCTGGAACCA | 9559 & 9560 |
| NDRG2 | AACTGGACCCCACCCAGA | CAGAGAGGCTGTACGAGA | 9561 & 9562 |
| NDST1 | GCGGCCTCTTCACACACA | AGGAGTGCAGGAAGCGCA | 9563 & 9564 |
| NDST2 | CTGCGTACCAACCCAGCA | CTCCGGCCTAGACAGCGA | 9565 & 9566 |
| NDST3 | GACCCTTCAGACCGAGCA | CAAGGCTCTGAGCTCCGA | 9567 & 9568 |
| NDUFA1 | TGGAAAGAGATAGGCGCA | AGCAGGGGTAGATGGCCA | 9569 & 9570 |
| NDUFA10 | GAAGCCCCTCGCCACCGA | GGTCAGCAAGTGCTCCAA | 9571 & 9572 |
| NDUFA2 | CAGCCAGGGCGTCAGGGA | CATCGGAGCATTCGCGGA | 9573 & 9574 |
| NDUFA3 | GCCCCCATTGAGCCCCTA | GGCTGGGCACGTCGGGCA | 9575 & 9576 |
| NDUFA7 | CAGGCAAGCCAGCAGAGA | GTCCGAGGACAGCTCCCA | 9577 & 9578 |
| NDUFA9 | CTGTCCAAGGAAGCTGGA | TTCCAGCCCAAGGAACCA | 9579 & 9580 |
| NDUFAF4 | GCCTCCTGCGAGAGCAGA | ACCTGCAAGGAAGACACA | 9581 & 9582 |
| NDUFB1 | CCGAGGTCGCAGCTTCCA | GAACCCAGTGGTCCCGCA | 9583 & 9584 |
| NDUFB2 | CGCACGGACTGCTGGAGA | ACCACATGAGTCCGCTGA | 9585 & 9586 |
| NDUFB3 | GCCGCAATGAAGCTTGGA | GCTCCTACAGCTACCACA | 9587 & 9588 |
| NDUFB4 | AGCCCAGCTGAAACGAGA | CTTGCATAGGCCCAACGA | 9589 & 9590 |
| NDUFB6 | GAAACTGCGGCTGCAGCA | CCGGCTCCCGAGGGCTCA | 9591 & 9592 |
| NDUFB7 | CTTCCCCGAACGCAAGGA | GGGCGCAGTAGTCCCGCA | 9593 & 9594 |
| NDUFB8 | TGCACTGGCACCTAGACA | AGGCTGGTAGACAGGGTA | 9595 & 9596 |
| NDUFB9 | CTGCAGGAGGAAACGCCA | ACCACCACAGTGGGGGCA | 9597 & 9598 |
| NDUFC1 | GTTGACGCCCCCACGGA | GGGAAAGGGGACGCAGCA | 9599 & 9600 |
| NDUFS1 | GGCAAAGATGTGGCAGCA | GCCTCTTCCACACCAGCA | 9601 & 9602 |
| NDUFS2 | GGACCTGCGGAAGACCCA | CATCTCCTCCACCCGGCA | 9603 & 9604 |
| NDUFS3 | CCTCAGGGATCACACCAA | CGTGAGTTGAAGCGCAGA | 9605 & 9606 |
| NDUFS4 | CAGTGGTACTGAGGCAGA | CCTGGTCGGAACCCTGGA | 9607 & 9608 |
| NDUFS6 | GGGAGAAGGTCACGCACA | TCGCACGCTATCACCCGA | 9609 & 9610 |
| NDUFS7 | AGCTGCGCCAACGGAGGA | CTCGGCCGTAGGTGGGCA | 9611 & 9612 |
| NDUFS8 | GGACCACCCGCTATGACA | ACGATGGCATCCACGGGA | 9613 & 9614 |
| NDUFV1 | CCCTGTGGGAGATCAGCA | CGGATCAGACCCTGCACA | 9615 & 9616 |
| NDUFV3 | ACACAGGAGCCAGCCCCA | CGGCCTGAGGAGGGCTGA | 9617 & 9618 |
| NEB | GTCCCTGACACACGCCAA | CTTGCCAACTCGGAGGCA | 9619 & 9620 |
| NECAB1 | CTACCAAGAAGCCTCCAA | CAGGCCATTGAATCGACA | 9621 & 9622 |
| NECAB3 | CTGCAGGACTTCCACCGA | TACAGGGTGAAGGAGGCA | 9623 & 9624 |
| NEDD4 | AGTGCCCTACTCCAGGGA | ACAGTCGAGCCTTCAGGA | 9625 & 9626 |
| NEDD4L | GTCACAGGGACATCGCGA | GGAGGTAAGTCAAGGCGA | 9627 & 9628 |
| NEDD9 | AGGCATTGTCCCAGGCAA | TGCATCAGTCCAGAGGCA | 9629 & 9630 |
| NEFH | TATGCGCTCAGCGCAGGA | GAGGCAATGTCGGCCTGA | 9631 & 9632 |
| NEGR1 | CAACGTGACACAGGAGCA | TTAAGAGGCAGGCTCGCA | 9633 & 9634 |
| NEK2 | GCTTGCTAAAGGAACGGA | ACAGGGCTTGAGCCCGCA | 9635 & 9636 |
| NEK7 | GCAGTGCATTGGAACACA | TAGACAGCCAAGAGACCA | 9637 & 9638 |
| NEK8 | TCCAAGGCCTTGAGGGCA | TCCAACTGCACTGGCCGA | 9639 & 9640 |
| NEK9 | TCAGTCCCACAGAGGCCA | GAGATGGGCTGTCAGGCA | 9641 & 9642 |
| NELL1 | GCCACTCACTTGCCCCAA | TGCAGGGAGATCCAGCCA | 9643 & 9644 |
| NELL2 | GCCCTGAATGTGACCCAA | CCACATCTGGGCAAGGCA | 9645 & 9646 |
| NET1 | GTAACCAGCTGGCAGCCA | CTAGGCGACTTCGAGGGA | 9647 & 9648 |
| NETO1 | TGCACTCTCAGAGGGACA | GGACAGCTGTGATCCACA | 9649 & 9650 |
| NETO2 | GCGTCAAACAAAGCAGGA | CAGGGCCTGCTCAGGGCA | 9651 & 9652 |
| NEUROD1 | ACACGAACCGTCCGCCGA | ATGGGGATCTCGCAGCGA | 9653 & 9654 |
| NEUROG2 | GTTCCCCGAGGACGCCAA | GGTGCAACTCCACGTGGA | 9655 & 9656 |
| NEUROG3 | CGACGCGAAGCTCACCAA | GCGGGACTCAGGCTGCCA | 9657 & 9658 |
| NF1 | GGGTCAGGGAGTACACCA | AGCCAGTTTCCCAGGACA | 9659 & 9660 |
| NF2 | GGAGCGAAGAGCCAAGCA | CGAAAGACAGGCTGTCACCA | 9661 & 9662 |
| NFAM1 | TGGGCACAGAGAACCAGA | CACTCAGGACACTCAGGA | 9663 & 9664 |
| NFASC | GGGACACCCAGATCAGCA | ACCATCGCAGTGTGGGGA | 9665 & 9666 |
| NFAT5 | GCAGCAGATTCAGCCCAA | GGCAGCTGACTAGAAGCA | 9667 & 9668 |
| NFATC1 | CGTGGAGAAAGCCCCAGA | ATGGCGGGATCTCAACCA | 9669 & 9670 |
| NFATC2 | CCATCAAGACGGAGCCCA | ATGAGAGCCCCGTGCGGA | 9671 & 9672 |
| NFATC3 | ACAACAGCTTCCCCAGCA | GGAGACGGTGATGAGGCA | 9673 & 9674 |
| NFATC4 | CTGTCCCCGAGTACAGCA | CTCCGCCCATTGGAGACA | 9675 & 9676 |
| NFE2 | TGAGCTGGAGGGGACAGA | TTCATGGCCAAGGCCCGA | 9677 & 9678 |
| NFE2L1 | CCGCATGAGCTACCAGGA | TCGGCTGAGTCCAGGGCA | 9679 & 9680 |
| NFE2L2 | TGCCACAGTCAACACAGA | AAGTAGCAGGTGAGGGCA | 9681 & 9682 |
| NFE2L3 | GCTACTACCCAGAACCCA | GACTTCCCAGGCCACGGA | 9683 & 9684 |
| NFIB | GAGTATCCAGAACGCCCA | CTGAAGATTGACCCCCGA | 9685 & 9686 |
| NFIL3 | ACGAGCACGAACCCTCGA | GCAGCTTCCCTGCACAGA | 9687 & 9688 |
| NFKB1 | ATAGACGAGCTCCGAGACA | GAGAGTTAGCAGTGAGGCA | 9689 & 9690 |
| NFKB2 | GGCATGGAGACTCAGCCA | GCCTCCACTTCAGCCCCA | 9691 & 9692 |
| NFKBIA | GCTGCCAGAGAGTGAGGA | CACAGTCATCATAGGGCA | 9693 & 9694 |
| NFKBIB | TGGAGGCTGAAAACTACGA | CCCTCAGGAGAAGCTCCA | 9695 & 9696 |
| NFKBID | AGGTTGACCTGGAAGCCA | CAACGTTAAGGGCCAGGA | 9697 & 9698 |
| NFKBIE | CCCAGGTAGATGCCCGCA | CGCAGCAGGGAGTCAGCA | 9699 & 9700 |
| NFKBIZ | GCCCAAGGGAGAAGGGCA | GCCCCGATGTTCACCAGA | 9701 & 9702 |
| NFS1 | CAGAGCGGCTGATACAGA | GGGCTCCAGGGATGCAGA | 9703 & 9704 |
| NFX1 | AGTGCCAGCCTTGCCAGA | AGTTTGGCCACAGGGGCA | 9705 & 9706 |
| NFYA | CCAGCAGTGGGCAAGGGA | GGCACAGAGCCAGCCCCA | 9707 & 9708 |
| NFYC | AAGCCCAACAGGCCCAGA | CATTCAGCTGCACCGGGA | 9709 & 9710 |

FIG. 1 Cont.

| | | | |
|---|---|---|---|
| NGB | CAGCCTGGGCAGGAAGCA | TCCAGCATGTAGAGCAGA | 9711 & 9712 |
| NGEF | CCGGCAGATTCCAGGAGA | CGTTCTCCAGCAGCCGCA | 9713 & 9714 |
| NGF | AGACCACCGCCACAGACA | CACCCGCTGTCAACGGGA | 9715 & 9716 |
| NGFR | GCTACCAGCCCGAGCACA | TGCACAGACTCTCCACGA | 9717 & 9718 |
| NGLY1 | GTGTGGCGAGTGGGCCAA | TGCATCACAGTGCAGCCA | 9719 & 9720 |
| NGRN | TACCCACATTGGAGCAGA | TGCTGCAGCGAGTGGGCA | 9721 & 9722 |
| NHLH2 | CTACCCGCACCCGCAGCA | TGAAGGCTTCCACGCGGA | 9723 & 9724 |
| NHP2 | CGGTGAAGCAGAAGCAGA | AGCCTGCGGCTGCACCCA | 9725 & 9726 |
| NHP2L1 | CGCCGAGCCACTGGAGA | GACAGAACAGGCGATGACA | 9727 & 9728 |
| NID1 | CCTACATGGACGGCACGA | CTGCATCCACCCAGCAGA | 9729 & 9730 |
| NID2 | GAGCAGAGCCTGAGACGA | TGGCACGGGGATTCACCA | 9731 & 9732 |
| NIN | CGGTGACTGCAGTGAGCA | CCAGTCTTGGGGAGGGGA | 9733 & 9734 |
| NINJ1 | GATGGCCAACGCGTCCCA | CAAGGAAGATGAGCAGCA | 9735 & 9736 |
| NIP7 | AAAGCCTGGTGCAGAGCA | CTGCCATGGAGTACACCA | 9737 & 9738 |
| NIPA2 | CACAAGCTAGGTGATCCA | GCAGCAGAATCCAAGCCA | 9739 & 9740 |
| NIPBL | CGGAGTTGGCAGCACAGA | TGTCTACCCAAGGCACCA | 9741 & 9742 |
| NIPSNAP3B | GTGGAATGAGAGTGCAGA | TTTCCCGAACAGCCGCCA | 9743 & 9744 |
| NISCH | TGCTGGAGCACATCCGCA | GCCGTACCTTGAGCACCA | 9745 & 9746 |
| NIT2 | AATCTGACCACTGGACCA | GTGGCCACATACACCTGA | 9747 & 9748 |
| NKD1 | GACCAAGCCCACTGAGGA | GAGCGAGATCGAGTGGGA | 9749 & 9750 |
| NKG7 | GTGGGACCAGCCTCCACA | AGGACGGGGACCGCCACA | 9751 & 9752 |
| NKX2-1 | ACAAGGCCACGCGCAGCA | GGTCCGACCGTATAGCAA | 9753 & 9754 |
| NKX2-2 | CATGCAGTACAACGCCCA | ACTGCTGGGCCTGGACCA | 9755 & 9756 |
| NKX2-3 | GGAGGACGAGGAAGACGA | GCACGAGTCTCGCAGGA | 9757 & 9758 |
| NKX2-5 | GAAACTCACGTCCACGCA | ATTGAGGCCCACGCCGTA | 9759 & 9760 |
| NKX2-8 | GCGGTGGCGAGGTGGGAA | GAAGAGGCCAAGCGCCGA | 9761 & 9762 |
| NKX3-1 | GGGAGACTTGGAGAAGCA | GCCCACGCAGTACAGGTA | 9763 & 9764 |
| NKX6-1 | TGCACAGCATGGCCGAGA | GGAGGGCGACGAGGAGGA | 9765 & 9766 |
| NLGN1 | TACCAGACGACCCCCAGA | TGACGGTCAGCCCAGTCA | 9767 & 9768 |
| NLGN2 | CACCAATGGGTGGCACCA | TGACCACGGCACTGAGCA | 9769 & 9770 |
| NLGN3 | TGGAGCACCAAGCGGCCA | CACGAGGGTTCTCCACCA | 9771 & 9772 |
| NLGN4Y | CCACCAAACGCCCAGCAA | GTTGAGGAAGAGGAGCGA | 9773 & 9774 |
| NLN | GGAAGCCGGATGATGGCA | TGTCTCAGGAGAGAGGGA | 9775 & 9776 |
| NLRC5 | GACCTTGGAGCCCACCA | AGCAGCAGGGAACTGGCA | 9777 & 9778 |
| NLRP1 | GCCTGGATACGGGAGAGA | CAGGAGAAGGCACGCACA | 9779 & 9780 |
| NLRP3 | TGGACTGCAGAAGGCGGA | AGGTAGTACATGGCGGCA | 9781 & 9782 |
| NLRP5 | GTGCGAGGGACTGAAGCA | CAGATGCCGGTTGCAGGA | 9783 & 9784 |
| NLRP8 | CACAGAGGAGGGAGACCA | CTGCGGCCAAGTGACACA | 9785 & 9786 |
| NMB | TGGGGACAGCTCCCCACA | GCAGGAGGATTCCGAGCA | 9787 & 9788 |
| NMBR | GGACCTGTGTGAAGGCCA | AGCTACTGATGCGAGCCA | 9789 & 9790 |
| NME1 | ACTCCAAGCCTGGGACCA | TCCACAGAATCACTGCCA | 9791 & 9792 |
| NME1-NME2 | GTGGTGAAGACAGGCCGA | CCTGCCAACCTGAATGCA | 9793 & 9794 |
| NME2 | GACCTGAAAGACCGACCA | CACGTTCAGCCCCTCCCA | 9795 & 9796 |
| NME3 | GCTCATCGGAGCCACGAA | GCGGGCACTCTCCACCGA | 9797 & 9798 |
| NME4 | CCAGGACCTGCGGAGGAA | TGGGGCAGCCTCAGCCGA | 9799 & 9800 |
| NME8 | ACCTGAGGTCGAAGCCCA | CGGGGAAGAAAGCATCCA | 9801 & 9802 |
| NMI | GAGGTTACGGCCAAGCCA | CATAGTCCACGCGGTCCA | 9803 & 9804 |
| NMS | AATGCACCTGGCTGCCAA | GTGAAGTCCACTGCAGCA | 9805 & 9806 |
| NMT1 | CCAGGAGGAGGTGGAGCA | ATGGTGGAGGGCAGCGTA | 9807 & 9808 |
| NMU | CAGAAGTTGGGCAAGTCA | CATGCAGGTGAGGAACGA | 9809 & 9810 |
| NMUR1 | GCACCTGGCCTTCCAGCA | TCTGAGGCGATGGCAGCA | 9811 & 9812 |
| NNMT | CGCTCAGGAACCTCGGCA | CCAGGGGGAGGCTGGAGA | 9813 & 9814 |
| NNT | GCTACGGATGCAGCAGCA | CAGTAGGAGAGGGGCAGA | 9815 & 9816 |
| NOB1 | CAGCTGCGACTCTCCCAA | TAGCTGAGCGGCTGGAGA | 9817 & 9818 |
| NOC4L | ACACCCGCTACCACACCA | GCAGGCTCACGGCAGACA | 9819 & 9820 |
| NOD2 | GCTGCAGTGCATGGCCAA | GGTCAGGGTGGTCAAGGA | 9821 & 9822 |
| NODAL | GGAGTGGGGCAAGAGGCA | AACTCCTCCCCAACAGGA | 9823 & 9824 |
| NOG | CAAGAAGCTGCGGAGGAA | CTCGGGCACGGAGCACGA | 9825 & 9826 |
| NOL3 | GGGCCAGAGTACGAGGCA | GGGTGCCTCCGGCGTCCA | 9827 & 9828 |
| NOL8 | TGAGTACAAGGCCCAGGA | GGCAGTTTCCAAGCCAGA | 9829 & 9830 |
| NOLC1 | CTGCCAAGGAGGCAGAGA | CCGCAACTCGTGAATCCA | 9831 & 9832 |
| NOMO2 | CAGAAGGCAACGACCACA | CAGGGACTGGCCAAGGGA | 9833 & 9834 |
| NOMO3 | GAGATCCACGGGAAGGCA | GGGCCAACACTGTAGGCA | 9835 & 9836 |
| NONO | GATGGAAGCTGCACGCCA | GCCATCTGACCCATCCGA | 9837 & 9838 |
| NOP14 | GCTCTGGAACAGCAGCGA | GCAGCAGTCAGCTCAGCA | 9839 & 9840 |
| NOP16 | ATGCTCCCACATCCGACA | GGTCCACAGCCAACCCCA | 9841 & 9842 |
| NOP2 | GCAGCAGTTGCCAGAGCA | GCTGGAACGGATGGGAGA | 9843 & 9844 |
| NOP56 | GCTGGAGAAGCTGGAGGA | GTCCATGCCCATGGAGGA | 9845 & 9846 |
| NOS1 | TGTGGGGACGTCACCA | TCGCAGGGTGACTCCAA | 9847 & 9848 |
| NOS1AP | GACCCCTAAGCCAGAGGA | ACTCGTACTCCGAGGCGA | 9849 & 9850 |
| NOS2 | GACATCACCACACCCCCA | GCAGGAAGCCAGCAGACA | 9851 & 9852 |
| NOS3 | GTGCTGCGGGATCAGCAA | CTGACGCTCCTGCAAGGA | 9853 & 9854 |
| NOTCH1 | CAGGACCCAACTGCGAGA | CAGGCACACTCGTAGCCA | 9855 & 9856 |
| NOTCH2 | CCCATTGATCGACGGCCA | CTCCTCGGAGAGAAGCCA | 9857 & 9858 |
| NOTCH3 | GCAACCCGGTGTACGAGA | CTGGCACAATCCAGCCCA | 9859 & 9860 |
| NOTCH4 | GCTAACTCCTCCCCAGGA | TTCCCAGGGCTCAGGACA | 9861 & 9862 |
| NOTUM | CAGACTGCGTCGACACGA | CACCACGAACACAGGGCA | 9863 & 9864 |
| NOV | GCCAGAGCAGCCAACAGA | CCATCACTGCAGACCCCA | 9865 & 9866 |
| NOVA1 | TCAGCCAGTGGCAGCACA | CCTAGAATGGCACTGGCA | 9867 & 9868 |
| NOX3 | TGGAACTGCCCTGACAGA | AGAAGAGCAGCGAAGGGA | 9869 & 9870 |
| NOX4 | CCTCAGTCAAACAGATGGGA | GGTCCACAACAGAAAACACCA | 9871 & 9872 |
| NPB | CGCTCCCAGCCCTACAGA | GGCGACGTCCTGGACGCA | 9873 & 9874 |

FIG. 1 Cont.

| | | | |
|---|---|---|---|
| NPC1 | CTCTGACTCCGGAAGGCA | TGGTGCCATGGCCAAGGA | 9875 & 9876 |
| NPC1L1 | CCATCAGCACCAAGCCCA | TCAGGAGGTTGAGGCGGA | 9877 & 9878 |
| NPC2 | AGCCCATGCCCCACCCAA | AGGGAACTGGGACGCCCA | 9879 & 9880 |
| NPEPPS | GGACCCCAAACCTGGAGA | CCTCAGATCAGCGGAGAGA | 9881 & 9882 |
| NPFF | AGACCTGGCCGGAGCCAA | CAGGCTCCAGAACTGGGA | 9883 & 9884 |
| NPFFR2 | GGTGTCCAGGAAGAAGCA | GTTGCCGAATGCCAGCCA | 9885 & 9886 |
| NPHP1 | GCTTCTGGAGGAAGGGAA | AGGCCAGTTGTGAAGGCA | 9887 & 9888 |
| NPHP4 | CGTGCCTGTGAGCAGAGA | CATCTGGACGGCAGCAGA | 9889 & 9890 |
| NPHS1 | CTGGGAGAGACTGGGAGA | GCCACCCCATTGTCCACA | 9891 & 9892 |
| NPL | CCTCAAGCCATGGACCAA | GCCCTTGGAAGGTGGGGA | 9893 & 9894 |
| NPM1 | ACGAGATACTCCAGCCAA | TCAGTCATCCGGAAGCAA | 9895 & 9896 |
| NPNT | TCGGCAGCCAAAGCCCCA | GGAGTGTGCCAGAGTGCA | 9897 & 9898 |
| NPPA | CCTGGACCGGGGAAGTCA | CGCAGGCTCCGAGGGGCA | 9899 & 9900 |
| NPPB | AGGTAGCCACCGAGGGCA | AGCAGCCAGACCCTTGCA | 9901 & 9902 |
| NPPC | CCTGCGCGTGGACACCAA | GCCGAAGCAGCCCTTGGA | 9903 & 9904 |
| NPR1 | GGACCCAGAGCAAGGACA | TCCACGTGGAAGACCCCA | 9905 & 9906 |
| NPR2 | GGTCAACGCCATGCACCA | AGGCCAACAACCCCAGCA | 9907 & 9908 |
| NPR3 | TGGCATGACCAGTGGAGA | GACTGTCTGGAGGGACGA | 9909 & 9910 |
| NPS | CCAGATTGGACAGGAGCA | CCCCGAGTCCTTTGCACA | 9911 & 9912 |
| NPSR1 | ATGGGAAACTGTGCAGCA | GGAGCTGCTGAAGACACA | 9913 & 9914 |
| NPTN | GTCAGCGCTCCTAAAGCA | GTGGGGGTAGCCAACTGA | 9915 & 9916 |
| NPTX1 | CTACCAGGATGGCACGCA | AGTGGGCCAGCTCACCCA | 9917 & 9918 |
| NPTX2 | AGTGGGGCAACAACCCCA | CCTGGAATGCCTCCCACA | 9919 & 9920 |
| NPTXR | CGCCTGGACCACAAGGGA | AGCCAGGTTCTCACCGGA | 9921 & 9922 |
| NPVF | GCCACACTCCTTCGCCAA | TCACGAGGCTCACCTCCA | 9923 & 9924 |
| NPW | GGAGCTCCCAGGCAGGGA | CAGCTCCGCTGAAGTCCA | 9925 & 9926 |
| NPY | CCAGCCCAGAGACACTGA | GCAGGGTCTTCAAGCCGA | 9927 & 9928 |
| NPY1R | CAGGTCCAGTGAAACCAA | CTGTGAGGTGGCAGAGCA | 9929 & 9930 |
| NPY2R | GACCACTACCATCAGCGA | AAGTGGAGCACATGGCGA | 9931 & 9932 |
| NPY5R | CTGGCAGCCATAAATGGA | AAGTGGGGACCCCTGGTA | 9933 & 9934 |
| NQO1 | GAAGCTGGAAGCCGCAGA | TACATGGAGCCACTGCCA | 9935 & 9936 |
| NQO2 | CCACGAAGCCTACAAGCA | CCATCCAGCCCTTCAGGA | 9937 & 9938 |
| NR0B2 | TGGGCACCTGCAGCAGGA | TGGAGGCCGTGAGGAGGA | 9939 & 9940 |
| NR1D2 | CTCAATGGGAGCAGGGGA | TCTGCAGATACCAGGACA | 9941 & 9942 |
| NR1H3 | GCCCAACGTGCAGGACCA | GGGGATGGTGGATGGAGA | 9943 & 9944 |
| NR1H4 | TGGACCATGAAGACCAGA | TAGGTCAGAATGCCCAGA | 9945 & 9946 |
| NR1I2 | GACCAGCTGCAGGAGCAA | TGCGGAGCTCGGTGAGCA | 9947 & 9948 |
| NR2F1 | AGTACCCCAACCAGCCCA | GAGCTGCTCGATGACGGA | 9949 & 9950 |
| NR2F2 | CCTGCAGATCACGGACCA | TCAGAGAGACCACAGGCA | 9951 & 9952 |
| NR3C1 | CAGCAGGCCACTACAGGA | CCTCCAACAGTGACACCA | 9953 & 9954 |
| NR3C2 | CCCTCGGTCAACACAGCA | AGCGGTTGAGCGTGGAGA | 9955 & 9956 |
| NR4A1 | GTCACCGGCTGACCAGGA | GGGACCTTGAGAAGGCCA | 9957 & 9958 |
| NR4A2 | CTGCCCAAAGCCGACCAA | GTGACCATAGCCAGGGCA | 9959 & 9960 |
| NR4A3 | GCCTGTCAGCACTGAGCA | GTTCTACCAGGGCACCCA | 9961 & 9962 |
| NR6A1 | TCGCAGCCTGGATCCCCA | CCTGCCACGTAGAGCTCA | 9963 & 9964 |
| NRAP | GAGATGGTCCAGGCCAGA | TCAGCTTGGCCAGCAGGA | 9965 & 9966 |
| NRAS | CTCAGCCAAGACCAGACA | ATACAACCCTGAGTCCCA | 9967 & 9968 |
| NRG1 | GGCTCAAGGAGGACAGCA | AGGCGCACCGCTTGCACA | 9969 & 9970 |
| NRG2 | CCGAGGAGCTGTACCAGA | TTGCAGTAGGCCACCACA | 9971 & 9972 |
| NRG3 | TGTGGAACCGGCAGCAGA | CCACTAGGTCGGTGGGCA | 9973 & 9974 |
| NRIP1 | TCTCACAGGTCACAGCCA | CTGTGTGGGCGAGAAGCA | 9975 & 9976 |
| NRIP2 | CTGCAAGTGCCAGGACCA | GCAGAGTCTGCAGGCCCA | 9977 & 9978 |
| NRN1L | ACAGCAAGAAGCTCGCCA | CAGGCGCTGTAGCCCGCA | 9979 & 9980 |
| NRP1 | GTGGGAAGCACCGAGAGA | CGCGTGGAGAGAGCTGGA | 9981 & 9982 |
| NRP2 | ACCGAAGAGGAGGCCACA | CACAGGGCTCCTCGAGGA | 9983 & 9984 |
| NRTN | GCTGCGACGACTGCGCCA | GGCTGTGCGCGTCCAGGA | 9985 & 9986 |
| NRXN1 | CGGGAAAGAGCAGGGCCA | GAGGAAGGCACTTCACCA | 9987 & 9988 |
| NRXN2 | TAACGTGGGCACGGACGA | CGCTTCGAGTGAAGCGCA | 9989 & 9990 |
| NRXN3 | CAGCCAATGACAGGCCCA | AGCTGGAGGAAGTCACCA | 9991 & 9992 |
| NSD1 | CAGGAGGCTCCACACACA | GCCAGGTAGGGAAGCAGA | 9993 & 9994 |
| NSDHL | CATCCTGGCGGCAGAGCA | GGCTGCAGCTGGATGACA | 9995 & 9996 |
| NT5C | TGTGCGGGAGATGAACGA | CTGCTCCACCCAGCGGTA | 9997 & 9998 |
| NT5DC2 | ATGCGCAGTTCGGCAGCA | AGAGCTGGTCCATCCAGA | 9999 & 10000 |
| NT5DC3 | GCACAGACCAGAACCCAA | GCAGGAGAGGGGTTCCGA | 10001 & 10002 |
| NT5E | CGTGCACCGCTACGGCCA | GAGGGTCATAACTGGGCA | 10003 & 10004 |
| NTF3 | CGCGATGTAAGGAAGCCA | GTATCCACCGCCAGCCCA | 10005 & 10006 |
| NTF4 | GCGAAACTGCACCAGCGA | CGCCCACGCAAGTCCACA | 10007 & 10008 |
| NTHL1 | CCAAGTCCCCAGAGGAGA | TCTGCTGGCCGAAGCCCA | 10009 & 10010 |
| NTM | GCCTCACCTGCATAGCAA | GCCACGTCATTGGAGGCA | 10011 & 10012 |
| NTN1 | CCACATCCTGAAGGCGGA | CCTCCGCGTTGCCCAGCA | 10013 & 10014 |
| NTN3 | CGACCCGCGACGGGCACA | GCAGGCTCACGAAGACCA | 10015 & 10016 |
| NTN4 | GGAGGCAGCTGATGGCAA | CTGAGTTGGCAGGAAGGA | 10017 & 10018 |
| NTN5 | GAACCTGCAACCAGACCA | TGCTGGTAGCCAGGGCCA | 10019 & 10020 |
| NTNG1 | ACTGCCAGAACGGAGGGA | GCCAGAGTCGGAGCCGCA | 10021 & 10022 |
| NTNG2 | ACGACCGGTGCAACGAGA | GCACACGTTGGGGTAGCA | 10023 & 10024 |
| NTRK1 | CCCACGTCAACAACGGCA | AAGACGGCCAGGCCCACA | 10025 & 10026 |
| NTRK2 | GAGAGCCCCACATGAGGA | GTCCAGGTAGACCGGAGA | 10027 & 10028 |
| NTRK3 | AGACCTGGCCACCAGGAA | TCAGGAGGCATCCAGCGA | 10029 & 10030 |
| NUAK1 | CCAGGGTAACCTCCCACA | GGCTGTAGCTCCGGGAGA | 10031 & 10032 |
| NUB1 | GATGCACTCGTGGCCGAA | CTTCTGGCGACAGCGGCA | 10033 & 10034 |
| NUBPL | TCTCCACGCCCCAGGACA | CAAGGCCAAGGACGGGCA | 10035 & 10036 |
| NUCB1 | GAGATGGAGGAGGAGCGA | CGGTGTAGGCAGGGTGCA | 10037 & 10038 |

FIG. 1 Cont.

| | | | |
|---|---|---|---|
| NUDT11 | AAGCCCGTGCACGCCGAA | CTGGCGAGGATGGGGCCA | 10039 & 10040 |
| NUDT12 | CCAACCTGTGGAAATGCA | ACGCCATTGAGACTAGGA | 10041 & 10042 |
| NUDT14 | TGGAGGAGGGTGAGCTCA | CGCCGAGGGTCTTGGGGA | 10043 & 10044 |
| NUDT15 | CCAGGAGTCGGAGTCGGA | GACCTCCAGGGAGTTGGA | 10045 & 10046 |
| NUDT19 | CCCCCACAGTTCTACGAA | TGGACCATCCCATCAGCA | 10047 & 10048 |
| NUDT21 | TGAGCACCGGCTACCCCA | CTCCATCCTGACGACCCA | 10049 & 10050 |
| NUDT4 | GGTACCCAGACCAGTGGA | ACTTCCCTCACGGCAGCA | 10051 & 10052 |
| NUFIP1 | CCCCCTTCGACGCCCAGA | TACCACGATGTGGAAGCA | 10053 & 10054 |
| NUMA1 | GGCCAGCTATGCAGAGCA | CGGGTCTCAGCATCAGCA | 10055 & 10056 |
| NUMB | GTCCCAGCCCTGCAACCA | GCCACCATCTGGGAGGGA | 10057 & 10058 |
| NUP107 | GGAATGACAGAAGAGGCA | CACCCGGAAGTAGGCCCA | 10059 & 10060 |
| NUP133 | CTGGAGCATGAGGAGCAA | GACTAGCAGCCTGCAGCA | 10061 & 10062 |
| NUP153 | CCCACCGCAACAAGCCCA | CACTGCCATGATGACCCA | 10063 & 10064 |
| NUP155 | GTCACAGCGATCCAAGGA | CTGGACAGTACACGAGCA | 10065 & 10066 |
| NUP205 | AAACGGACCCGCAGAGCA | ACCTGGCACAGCTGGAGA | 10067 & 10068 |
| NUP210 | TCCTCCACATCGACCCCA | TCTGAGGGACGCTGACCA | 10069 & 10070 |
| NUP214 | TTGGGCAAGTGGCAGCCA | GGCACGGAACTGAACCCA | 10071 & 10072 |
| NUP50 | TAATGGGGACAGTCAGCA | TATCCAATCCCGCACGGA | 10073 & 10074 |
| NUP85 | TGTGGCCCACCTGACAGA | TGTGCAGCTCCAGGGAGA | 10075 & 10076 |
| NUP93 | GCGCAGTTTGAAGCAGCA | AAGCAAGGAGGGTCACCA | 10077 & 10078 |
| NUP98 | ACACCAGACCCTCAGCGA | ACTGGGTAAGGCTGCGCA | 10079 & 10080 |
| NUPL1 | ACCACAGGGGCCTCCACA | CAGAGGCAGGATTGGACA | 10081 & 10082 |
| NUPR1 | CCTTCCCACCAGCAACCA | CGAGGTAGGAATGGGCCA | 10083 & 10084 |
| NUSAP1 | AGCCAACGACGCTCGCAA | TGCCCCCAGACACGGTCA | 10085 & 10086 |
| NUTM1 | CCCAAGGAGATCCCACCA | TAGCTCAGGAGACCTGGA | 10087 & 10088 |
| NXF1 | CTGAGCGGGAATTGGACA | GAGGGGAGACACAGGCTA | 10089 & 10090 |
| NXPH1 | GCCGACTCCTGTCACAGA | TCCTCAGCCAGTCCCAGA | 10091 & 10092 |
| NXPH2 | ACAGTCTCCGGTGCCCAA | GTTGGCCAGCCAATCCCA | 10093 & 10094 |
| NXPH3 | ACGCTCAGAGCTCAGCCA | GGCACACCTTCTGGACCA | 10095 & 10096 |
| NXPH4 | CGAGCACACGCAGAGCCA | GGCACACCTTCTGCACCA | 10097 & 10098 |
| NXT1 | CTGCAGAGCTGCTGAGGA | GGCAGTCTACCACGCTGA | 10099 & 10100 |
| NYX | CAGAACCAGCGGCCACCA | AGGAGAGGCTGTCGGACA | 10101 & 10102 |
| OAF | TGGAGCAAGGTGTGGACA | GCAGCTGCGGATGCCACA | 10103 & 10104 |
| OAS1 | AGCACACTCCAGGCAGCA | CCCCAAGATGCACTGGCA | 10105 & 10106 |
| OAS2 | GATCTTGGACCCAGCCGA | GCAGGGAGAGGATAACCA | 10107 & 10108 |
| OAS3 | GGGCACAGACCTAAGGGA | CCCACAGCATCGAAGGCA | 10109 & 10110 |
| OASL | AGACCATCCCCTCCGAGA | CCAACCAGTCCTGCAGGA | 10111 & 10112 |
| OAT | GTTCCACAGACCCAACCA | AGAGCTCTCGCACTCCCA | 10113 & 10114 |
| OBFC2A | GACGGCCATGAAGTGAGA | GATCTCATCCCACACGGA | 10115 & 10116 |
| OBP2B | CCTGGTACGTGAAGGCCA | CCAACTTCCCACCGCCCA | 10117 & 10118 |
| OC90 | GCCTCAAGTCCCCAAGCA | CCTCAGAGCTGGAGCCCA | 10119 & 10120 |
| OCEL1 | CGCAGTGTTCCAGGACCA | AGCTCAGCAGGGCCTCCA | 10121 & 10122 |
| OCLN | GACACTGGCCTACAGGAA | ATTCATCAGCAGCAGCCA | 10123 & 10124 |
| OCRL | GACCCCTGGAATGCAGGA | TGTCGGCAGATCCGGGGA | 10125 & 10126 |
| ODAM | ACAACCAGGCCCCAGTCA | GTTCCCAGGGTAGGACCA | 10127 & 10128 |
| ODC1 | CCACGCTCAGAACCAGCA | CACAGCGGGCATCAGAGA | 10129 & 10130 |
| ODF1 | GAGCTTGCCAAACTGAGA | TCTCCCGCTCAGCCGACA | 10131 & 10132 |
| ODF2 | AGCCGAGAAGAGCGAGGA | GTAGCGGCTCCTCCAGGA | 10133 & 10134 |
| OFD1 | CTGCAGGGAACATGCCAA | GCTGATATGAGAGGGGCA | 10135 & 10136 |
| OGDH | CCCAGATGTCCTGCCAGA | GCTTCCGGAATGGCAGCA | 10137 & 10138 |
| OGFR | GGTGAGGAAGCGGAGGAA | AGGGCCAAGGTCTGGGCA | 10139 & 10140 |
| OGG1 | CCAGGATCACCTCCGAGA | GAGGAGAGGCTGGAGGGA | 10141 & 10142 |
| OIT3 | GCAGTACACATCCCGGGA | CTCGTCCAACACTCCACA | 10143 & 10144 |
| OLFM1 | CCATCCTCAAGACCCGCA | TGGCGTACACGGCCCACA | 10145 & 10146 |
| OLFM2 | CCGGGGTCAGTAACCCCA | AGTCTCCCAGGGTACGGA | 10147 & 10148 |
| OLFM3 | TCCACCAAAACCTCCACA | GGGTGACATTGAACAGCA | 10149 & 10150 |
| OLFM4 | CTCCTCCCACTCCAGGGA | ATTCAATGGCGCCACCCA | 10151 & 10152 |
| OLFML1 | CCCATGCAGAAGCCAGGA | GGAAGAACAAGTTGGGCA | 10153 & 10154 |
| OLFML2A | CAACCAGCAGGAAGGCCA | GCTCGTTGAGGAACGGCA | 10155 & 10156 |
| OLFML2B | CGGACCTGAGCACACAGA | CGAACAGCAGCCTGGGGA | 10157 & 10158 |
| OLFML3 | CCTGGCAGCTGATGAGGA | GACATAGAGGGTCCCACA | 10159 & 10160 |
| OLIG2 | CTGGAGGAGATGAAGCGA | TGGAGCCGACCGACGGCA | 10161 & 10162 |
| OLR1 | AGGAACCCCAGCTACCCA | GGGAGACAGCGCCTCGGA | 10163 & 10164 |
| OMD | GATGGGCTAGTAAACTTGACCA | GAAGGCAAACCAGGAGGCA | 10165 & 10166 |
| ONECUT1 | AGGCCATCTTCGCGCAGA | CCTGCAGCCACTTCCACA | 10167 & 10168 |
| OPA1 | CTGAGCCAGGTTACACCA | CTGCGCAGCTGGAAGGTA | 10169 & 10170 |
| OPCML | GGAACACCAATGCCAGCA | GAGGGTCCCTGATAGCCA | 10171 & 10172 |
| OPRD1 | CCAAGGAGAAGGACCGCA | ATGCACAGGTGCAGCGCA | 10173 & 10174 |
| OPRK1 | ACCTGCGTAGGATCACCA | AGCCTAAGGCGATGCAGA | 10175 & 10176 |
| OPRM1 | GCCTCAAGAGTGTCCGCA | TGGGAGTCCAGCAGACGA | 10177 & 10178 |
| OPTC | CTGCAGCCTTCAGGGCAA | GGTTGCCATCCAGGCGGA | 10179 & 10180 |
| OPTN | CGAAGACGGAGGCAGGCA | GGGCAGGAATGAATCGGA | 10181 & 10182 |
| OR10AG1 | CCCAAGAATGCTCATGGA | ATAGCCACGTAGCGGTCA | 10183 & 10184 |
| OR10G7 | CCCTCCTGGCCACCGGCA | AGGACAGCACTATCAGGA | 10185 & 10186 |
| OR10G9 | GCCCTACTGTGGACCCAA | CACAGGCCAGTTTCAGGA | 10187 & 10188 |
| OR10R2 | CTCACCATGGTCACCGAA | CCAGGTGGATGACACTGA | 10189 & 10190 |
| OR11L1 | CCTCCCGCCACTCATGCA | ACAGCCAGGTGGGAGCCA | 10191 & 10192 |
| OR1J2 | TGCGAACACCATCCCCCA | GGGAGCCACATGTGGACA | 10193 & 10194 |
| OR1L8 | CACCATGAGCCACCACCA | AGCACAGGGCTGAGGTCA | 10195 & 10196 |
| OR1M1 | CAGGGATGGTGATAGCCA | GGACACAGATAGACGCCA | 10197 & 10198 |
| OR2A2 | GCTGGAGAGTGTGCACGA | AGAGGCCCGACTAAGACA | 10199 & 10200 |
| OR2L13 | AACTCCTTGGCACACACA | TAGGACTCGGCCACAGGA | 10201 & 10202 |

FIG. 1 Cont.

| | | | |
|---|---|---|---|
| OR2M4 | ATCACAGTCCCACCCACA | GTTCCACAACCTGCCAGA | 10203 & 10204 |
| OR2T11 | AACTGGCCTGTGCAGACA | TGTGGAAGGACTGGGGCA | 10205 & 10206 |
| OR2T33 | CAGTCTTCGAAAACGCCA | GTAGAGCGCATGTGCAGA | 10207 & 10208 |
| OR2T34 | CCAGCTCATACACCCTCA | AGGAAGCACCGAAGAGCA | 10209 & 10210 |
| OR4C13 | CATCACTGAGATCCCCCA | AGTGCAAGGGCTTGCAGA | 10211 & 10212 |
| OR4C15 | ATGGGGGTAGCCTGGACA | GAGAGCAAGATGACAGCA | 10213 & 10214 |
| OR4C46 | CATCACTGGGGTCCCCCA | GCCCTCTGCACCTCCGAA | 10215 & 10216 |
| OR4C6 | CAAAGGCTGCCTCACCCA | CCCAAGCCCCTCCTACCA | 10217 & 10218 |
| OR4D11 | CCCAGGTCCTCAAACTCA | CCTGAGACCTCAGCGTCA | 10219 & 10220 |
| OR4K1 | AGGGTTGCATGGCCCAGA | CACCTCATTGGGACCACA | 10221 & 10222 |
| OR4K14 | GCCCCAATGAGGTAGACA | GTGCAGAGCAAGTGGAGA | 10223 & 10224 |
| OR4L1 | GGACAATCATGAGCCACA | GAGAGCAGCCCGCTGTCA | 10225 & 10226 |
| OR4N5 | TCAGACCCTGGGCTCACA | AGGCCATCACAACGAGGA | 10227 & 10228 |
| OR4Q3 | GTCATGAACCCCCAGCTA | AGCAGACAAGAGACAGCA | 10229 & 10230 |
| OR4S2 | CAGCCAACAGTGGTACCA | GTGGGAGCCACAGGTGGA | 10231 & 10232 |
| OR51E1 | CTGTCACCCACTGCGCCA | GTCCAGGCCAATGGCGGA | 10233 & 10234 |
| OR51I2 | CCAGCCTCCATGAGCCCA | TGCGGGCATTGAGGCAGA | 10235 & 10236 |
| OR52A5 | TGACACTCAGGGCTGCCA | CAGTAGCCAGCTTCACGA | 10237 & 10238 |
| OR52E8 | CATGATCCTCACCAGCAA | TGATGCTGGCACAGGCCA | 10239 & 10240 |
| OR5B17 | CCTGCTCTGAGAAACACA | GCAATGAGGTGAGAACCA | 10241 & 10242 |
| OR5H2 | TGAGGACATGGAACAGGA | TCAGACCAAGGTTCCACA | 10243 & 10244 |
| OR5L1 | CTCGGCTCCACACCCCCA | CACGCACCTTCCAAGACA | 10245 & 10246 |
| OR5L2 | TTCAGGCAACAGTGGAGA | AGGGGGTTCAGCATGGGA | 10247 & 10248 |
| OR6A2 | GTGCTGACTGAGAACACA | CACACTCAGTGCAGCCCA | 10249 & 10250 |
| OR6K3 | CCCATCTCCACAACCCCA | AGCGAAGAGGGTTGCAGA | 10251 & 10252 |
| OR8H2 | AATCCGCCTGGACCTCCA | AGTGTAGAGGACTGCAGA | 10253 & 10254 |
| OR8K1 | CCTGGGCTGCAGGCTCCA | CGGGGCAATGACAGTGGA | 10255 & 10256 |
| ORC1 | CAGGACTGGAGGAAGCCA | GGCTGACGTTGAGCCGCA | 10257 & 10258 |
| ORC2 | GGGATCATGCAAAGCAGA | TAAGGGAGCTAAGTGGCA | 10259 & 10260 |
| ORC3 | CGAATATCGCCCCAGACA | AAGCCTCTGACCAGTCCA | 10261 & 10262 |
| ORC5 | CCCTGATTACAGCATAGGCA | CCTTTAACCACGGGTTCACA | 10263 & 10264 |
| ORC6 | CTTCCCCAGACACAGCAA | CACCGGATGTGGCTACCA | 10265 & 10266 |
| ORM1 | CGTGGGAGGCCAAGAGCA | ATAGACAGACAGCCCCCA | 10267 & 10268 |
| ORM2 | GTCTCCAGATACGAGGGA | TCGTCCAGGTAGGAACCA | 10269 & 10270 |
| ORMDL2 | CCCGCAAGTTCCTCAGCA | AGACACGAACCCCATGGA | 10271 & 10272 |
| OS9 | GCTTCCGTCAGACCGAGA | GAGTGGATGTGAGAGCCA | 10273 & 10274 |
| OSBP2 | GCTCTGACGGGAAGCAGA | CGTTGAGGGTCAGGGCCA | 10275 & 10276 |
| OSBPL2 | CAAAAGCGTGGAGGCGGA | GACGTTGTGGACGCAGCA | 10277 & 10278 |
| OSCAR | CGGCACCTACAGCTGCTA | CCCAGCTGATGACCAGCA | 10279 & 10280 |
| OSGIN1 | CCAGATGATGCGGGAGCA | TGCCCCAGGCAGGAAGGA | 10281 & 10282 |
| OSM | AGAGCAGCGCCTCCCCAA | CAGCAGCTGGGCCATGCA | 10283 & 10284 |
| OSMR | CCCAGTAGAGGCACCACA | TCTCGGTCGGGGGAGGCA | 10285 & 10286 |
| OSTN | GGGAAGAGAAATCAGCCA | CGATCCATGGGGATACCA | 10287 & 10288 |
| OTOA | GACTCACTCCTGGCAGGA | ACCAGCAGGGGACAACCA | 10289 & 10290 |
| OTOF | GCAGGAGGACAAGCAGGA | CAGGAAGTCGTCAGCGGA | 10291 & 10292 |
| OTOL1 | GGGACCTACTGGGCCGAA | TGTCCCAGGAATAGAGCA | 10293 & 10294 |
| OTOP1 | TGACAGCCATCAGCACCA | CCGCAGCCCCCATAAGCA | 10295 & 10296 |
| OTOS | TGTGCAGGAGGAAGGAGA | CCCAGGGGGAAGTGGGCA | 10297 & 10298 |
| OTUD6B | AGGAGCGAGAAGAACGGA | CATACAGTGGCCATCAGA | 10299 & 10300 |
| OVGP1 | GGGGCCATGGTGTGGACA | CACAGCAGATGACAGCCA | 10301 & 10302 |
| OVOL2 | TCCGCACACACACAGGCA | GCTGCTGCACCCCATGGA | 10303 & 10304 |
| OXA1L | CTGTGACTCAGGCCCCAA | GCTCAAGAACAGCCCACA | 10305 & 10306 |
| OXCT1 | CCCCAACAGGGTATGGGA | GCAATGGCAACACTGCCA | 10307 & 10308 |
| OXCT2 | ATACGGCGACCTGGCGAA | GCTGCATGGTGACCACCA | 10309 & 10310 |
| OXNAD1 | GCCAGTGAGTCACCGTCA | CACCCACTCTCACAGCCA | 10311 & 10312 |
| OXSR1 | CCTGGTCGACGGAAGGGA | TGAGCCTTCGACACCAGA | 10313 & 10314 |
| OXT | CCTGCCGTCGCCCTGCCA | GCTTCCGCGTCGCAGGCA | 10315 & 10316 |
| OXTR | CCAAGATCCGCACGGTCA | TGGCGGAGCAGCACAGGA | 10317 & 10318 |
| P2RX1 | CAAGGTCAACAGGCGCAA | CCACGTAGCCAAGCTGGA | 10319 & 10320 |
| P2RX4 | CCTGGCTGGCAACGAGCA | CCATGCCTAGCAGTGCCA | 10321 & 10322 |
| P2RX5 | CGGGAGCGACTTCCAGGA | TGAGTACCAGGTCGCAGA | 10323 & 10324 |
| P2RX6 | TGGCCAAGGCTGGAGGGA | GGAGTAGTGAGGCCAGCA | 10325 & 10326 |
| P2RX7 | GCCTGCATCACCACCTCA | GCGTAGCACCTGTAGGCA | 10327 & 10328 |
| P2RY1 | CAGACGAGTACCTGCGAA | AGCCCAGAATCAGCACCA | 10329 & 10330 |
| P2RY10 | GGGATCAGTGAGAGGCAGA | ACTTGCAAGGCACAGGCA | 10331 & 10332 |
| P2RY12 | CAGAAGACCACCAGGCCA | AGAACATGAATGCCCAGA | 10333 & 10334 |
| P2RY13 | AGGTGACACTGGAAGCAA | AGGTGGAGGAGCTGGGGA | 10335 & 10336 |
| P2RY14 | CTCCACACAGCCTCCAGA | ACGTAGAAGAGCACGGCA | 10337 & 10338 |
| P2RY2 | GCCACACCCTCAACGCCA | GAGCACGGGGTCAAGGCA | 10339 & 10340 |
| P2RY4 | TGCCAACAGCTGCCTGGA | GCTATCCTCAGGCAGGGA | 10341 & 10342 |
| P2RY6 | CGCTGCCACAGGCATCCA | AGGGCAGCAGGAAGCCGA | 10343 & 10344 |
| P4HA1 | GCACGGAAAGATGAGCCA | GCTCCTCCTGCAGACACA | 10345 & 10346 |
| P4HA2 | AGGAGGACGAGTGGGACA | AGCTGGCGACAGTGAGGA | 10347 & 10348 |
| P4HA3 | GGCATCAGGGGAGAAGCA | TCAAGGCCTGTGAGGGCA | 10349 & 10350 |
| P4HB | ACACCGACAACCAGCGCA | CCAGGGTGATGAGGCGCA | 10351 & 10352 |
| PA2G4 | AGAGGGCAAGGCCAAGGA | TCCACCACACCCATCCGA | 10353 & 10354 |
| PABPC1 | GCCCCTCCTCAAGAGCAA | GTTGGAACACCGGTGGCA | 10355 & 10356 |
| PABPC3 | GCCCCTCCTCAAAAGCAA | GTTGGAACACCGGTAGCA | 10357 & 10358 |
| PABPC4 | CCATGTGCAGGGGCAGGA | ACAAGCGTTCTCCCAGCA | 10359 & 10360 |
| PACRG | GAACCTCCGAAACCGACA | AGATGTTCAGGACAGGGA | 10361 & 10362 |
| PADI4 | CATGACCCCCAACACCCA | AGTCGAAGACCACGGGCA | 10363 & 10364 |
| PAEP | CTATACGGTGGCGAACGA | TGGCCAGGTACTGGCACA | 10365 & 10366 |

FIG. 1 Cont.

| | | | |
|---|---|---|---|
| PAFAH1B1 | TGGGCTCCAGAAAGCTCA | CAGAACTCCACGTACCCA | 10367 & 10368 |
| PAFAH1B2 | GAGGCAAAAGAACGCCAA | AACCCCCGTCGGTATCCA | 10369 & 10370 |
| PAH | AGCTGGAGAAGACAGCCA | CGAACTGAGAAGGGCCGA | 10371 & 10372 |
| PAICS | AGCTGAGTATGAAGGGGA | CGAAGAGAAGACCACACA | 10373 & 10374 |
| PAIP1 | TCAAGCTGCAAAAGGGGA | TCTCGAAGACCAACCTGA | 10375 & 10376 |
| PAK1 | GGAGGTGGCCATTAAGCA | CTGCAGACACTCACGGCA | 10377 & 10378 |
| PAK3 | CCTTCAACAGCAACCCAA | ACATCAGTCAGAGAGCCA | 10379 & 10380 |
| PAK4 | CCGGGACATCAAGAGCGA | ACCTCTGGCCCGTAGGGA | 10381 & 10382 |
| PALB2 | GGCAGCCCAGCAAAACCA | TGGCGGGACAGAGTCACA | 10383 & 10384 |
| PALLD | CCAACCGAGCAGGACAGA | TCCCTGAATGAGCAGGCA | 10385 & 10386 |
| PAM | GCAACCAGGCAGTGACCA | AGAGCCAAGCTGTGAGGA | 10387 & 10388 |
| PAM16 | GCGTGCAGGTGGTGGGCA | GAGGCCGGAGAGGTTGGA | 10389 & 10390 |
| PAMR1 | CCAGTCGGGATCTCAGCA | TGACCACCCCAGAGCGCA | 10391 & 10392 |
| PAN2 | CATCCGCCATCTGCCAGA | TGGAGGGACACACCAGCA | 10393 & 10394 |
| PANX1 | GAACTCACTGCAGAGCGA | ATGTCAAGGTCACGCGCA | 10395 & 10396 |
| PAOX | AGCTGGTGTGGGAGGACA | AGTCCGGCAATGAACCCA | 10397 & 10398 |
| PAPD7 | GCCAATGCCCAGTGGCAA | TTGGGGGACGCTGAGGGA | 10399 & 10400 |
| PAPL | GCAAAGGCCTCCAAGGCA | CGAGTGCTCATGAGCCCA | 10401 & 10402 |
| PAPLN | GCCATCGAGTGGCAGAGA | CAGGTGTAGAAGCCGCCA | 10403 & 10404 |
| PAPPA | CTGGTGACGGATGGGACA | GGCTGAGGTCATGGACCA | 10405 & 10406 |
| PAPPA2 | GGAGGTCACACCTGGACA | CACACCTTGGAGCAGCCA | 10407 & 10408 |
| PAPSS2 | GCGGCTGTGCTCGAGGAA | ACCTCTGTGGGGCCAGCA | 10409 & 10410 |
| PAQR5 | CCCAGGGGAGAGTGCACA | AAGAGGCCAGGAGGGTCA | 10411 & 10412 |
| PAQR7 | CTCCGACCCCACCACGGA | CAGCCTCCAGCTGAGCCA | 10413 & 10414 |
| PARD3 | CTGGGGAAGGCTTCCAGA | ACCCTGGCGTTGAAGCCA | 10415 & 10416 |
| PARD6A | GCATTGAAGTAGCCGGGA | TCAGGCTCAGCAGGCCCA | 10417 & 10418 |
| PARD6G | CGGGAAGACGCTGGACCA | CGGGCTTGACGGTGACGA | 10419 & 10420 |
| PARK2 | CAGGCTCGTTGGGAAGCA | CGGTTCCACTCGCAGCCA | 10421 & 10422 |
| PARP1 | CGTCTCAGGGAGACCCAA | ATCCCGGTCCCAAGAGGA | 10423 & 10424 |
| PARP12 | CTTCCTACGGCAAGGGGA | AGATGGAGGGGTCGGACA | 10425 & 10426 |
| PARP14 | GCCACCATCTCCAAGGCA | ACGCATCGGCCTAAGGGA | 10427 & 10428 |
| PARP2 | GCCAATCCTAAGGCCGAA | AGGGTGACGAAGTGGGCA | 10429 & 10430 |
| PARP4 | CCCACAGGACCTCCCCA | CAGGGAAGGTGCCAGCA | 10431 & 10432 |
| PARP6 | ACCATCCCCCAGACCCGA | TGCAGACATGGTCGGACA | 10433 & 10434 |
| PARP9 | CAGGCAACCTGTGAGCCA | ACGGATGTCCCTGGCAGA | 10435 & 10436 |
| PARVA | CGGGAGGCATGAACGTGA | AGCCCTCCAGGAGCCCCA | 10437 & 10438 |
| PARVB | CAGCCACATCTCGGAGGA | CCAGAAGGCCCATGAGCA | 10439 & 10440 |
| PASD1 | CTTGCGATGAGCAGGGCA | ATGCAGCAGGGCCTTGGA | 10441 & 10442 |
| PASK | CCATCAGCAGAGGAGCCA | TCACCAGCCAGCAGCAGA | 10443 & 10444 |
| PATE1 | CAACAGAAGAGGCCTGCA | AGCACCTGAAGTTCACCA | 10445 & 10446 |
| PATE3 | GGGATTTCCGGGTCAGGA | TCTGAGCAGTACAGACACCAA | 10447 & 10448 |
| PATE4 | TAAGTGCCGGGAAGAGGA | ATGAGGACAGCCCCTGCA | 10449 & 10450 |
| PATL2 | GCCTGGGAGATAGCCCAA | CCTCCAGCTGCTGAACCA | 10451 & 10452 |
| PATZ1 | CGACATGGCAGTCCCCAA | GCGGAAGAAGCTCCCACA | 10453 & 10454 |
| PAX2 | CCCAGAGTGGTGTGGACA | ACGTCAGGGTAGGAAGGA | 10455 & 10456 |
| PAX3 | ACCCCATGAACCCCACCA | CCCCGGTGAGAGGGGAGA | 10457 & 10458 |
| PAX4 | CTTGCCCCCACAGCCGAA | TAGTGGGCAGCCAGGCCA | 10459 & 10460 |
| PAX5 | GAAGCAGATGCGGGGAGA | CAGCCCACCAGCCAGCGA | 10461 & 10462 |
| PAX6 | AGATGGGCGCAGACGGCA | GGCACCGAAGTCCCCGGA | 10463 & 10464 |
| PAX7 | GCATCTTGGGCAACCCCA | TGAGATGGAGGTGGCCGA | 10465 & 10466 |
| PAX8 | CTGGCAGCGACAAGAGGA | CTGAAGGCATCCGTGCGA | 10467 & 10468 |
| PAX9 | CCTGGAGCAGGAAGCCAA | GACAATGAGGTGCCCCCA | 10469 & 10470 |
| PAXIP1 | CACGAGTCGATGCACGCA | TGGGAAGGCCACTGGGAA | 10471 & 10472 |
| PBK | GCGTTGGGAACTAGGCCA | ATGTGTGCAGCAGAAGGA | 10473 & 10474 |
| PBRM1 | CAGAGACCTGGAGGGAGA | TTGGGATCCACAGCAGGA | 10475 & 10476 |
| PBX1 | CTCGCCCTCAACTCCCAA | GCACTGATGCCCTGCGGA | 10477 & 10478 |
| PBX2 | GAGCTCCCAGGAGGAGGA | GAGTTGTCAGGGGACACA | 10479 & 10480 |
| PBXIP1 | CACAGGGTGACAAGGCCA | GCTGTACAGACCCCAGCA | 10481 & 10482 |
| PC | TCAAGGACACCCAGGCCA | CCATGGGTGAGGTCACCA | 10483 & 10484 |
| PCBD1 | TGGAAGGCCGTGATGCCA | TCTCAGCCTGCAGGGCCA | 10485 & 10486 |
| PCBP1 | CCACCCATGAACTCACCA | ATACTGGCAGCAGAGCCA | 10487 & 10488 |
| PCCB | GGAAGCTGCTCAGGCAGA | GACATCCAGGTCACAGCA | 10489 & 10490 |
| PCDH1 | CTGCCCCTCAACTACCCA | GCAGCTGGATGGAAGGCA | 10491 & 10492 |
| PCDH11X | GCCCACGAGTGACACAGA | GGAGGACTGTGGTGGAGA | 10493 & 10494 |
| PCDH12 | GACCAGGGCAGTGAGGAA | TTCCGCTCGGCGAAGGCA | 10495 & 10496 |
| PCDH15 | ATGGGGAAGGAGGACGCA | TGATGAAGGCCAGAGCCA | 10497 & 10498 |
| PCDH17 | CTCCCCTCAACTCCACCA | GGATCCTGGGCGAGCACA | 10499 & 10500 |
| PCDH18 | CCAGCAGCAGCATCCACA | CCGATCCACCTCACTGCA | 10501 & 10502 |
| PCDH20 | AGCGAGGAGAGAGGCCAA | CCAACACTGTGAGGGCCA | 10503 & 10504 |
| PCDH7 | CATCCCACTCACCCAGGA | ATGCCAGCAACCACGCCA | 10505 & 10506 |
| PCDHA1 | CGGGCGAGATCAGCACGA | GCAGCAGTGTGAGCACCA | 10507 & 10508 |
| PCDHA10 | AGGAGGGCCTGATCAGCA | CACCGACTGGAGGGGACA | 10509 & 10510 |
| PCDHA13 | CCAGAACCAGAGGCAGGA | CAACTCACCGGGACCGGA | 10511 & 10512 |
| PCDHA2 | AGGGCACGTGGTGGCGAA | TAGGCGGTGTCGAGGGGA | 10513 & 10514 |
| PCDHA4 | GGTACTGGTGAAGGACCA | GCAGCGCGGTGTACAGCA | 10515 & 10516 |
| PCDHA5 | CGCAGCAGAGGAGACAGA | GAGGTGGGACCCTGAGGA | 10517 & 10518 |
| PCDHA6 | CGGGCGAGATCAGCACCA | CCTGGCCACTCTCCACCA | 10519 & 10520 |
| PCDHA9 | GGCTGTACACGGGCGAGA | ACACCGCGCAGATGGCGA | 10521 & 10522 |
| PCDHB1 | TCTACGCGCTGAGAACCA | CCTCTGCAGACCTGGGCA | 10523 & 10524 |
| PCDHB15 | GGCTGTGCAGGAGGAGCA | TGCCGCTCACGTCCACCA | 10525 & 10526 |
| PCDHB6 | CAACGCGGACAACGGCCA | CCACCACCTTGGTCACCA | 10527 & 10528 |
| PCDHB8 | ACCAGCTGCTCAAGGCCA | GCAGGTAGGGCTGGGAGA | 10529 & 10530 |

FIG. 1 Cont.

| | | | |
|---|---|---|---|
| PCDHGA11 | CCTGCTTAAGGCCAGCGA | GAGACTCGAGGCTGCCGA | 10531 & 10532 |
| PCDHGC5 | CACCTGGCCCAACAACCA | AATCCCATGGTGCCGGCA | 10533 & 10534 |
| PCF11 | GGAGCCCTCCCTAAGGCA | TCAGGGGGAGGCTGAGCA | 10535 & 10536 |
| PCGF5 | CCAAGGTGTGGCAACCAA | CTCGTAGTCCAGGGACCA | 10537 & 10538 |
| PCID2 | GGACGTGGACATTGACGA | ACCGTGGACAGGGGAGGA | 10539 & 10540 |
| PCK1 | TGTGGCCGAGACCAGCGA | CGAGTTGGGGTGGGCACA | 10541 & 10542 |
| PCLO | GTGCCACATCTCCACCCA | TGGGTGGGGAAGGAGCCA | 10543 & 10544 |
| PCM1 | GCGCCAGCAAAATCAGCA | GAAGGAGGGTGCGATGCA | 10545 & 10546 |
| PCMTD1 | GGTGGAATATGCCAAGGA | CTGCACTCCAGCTCCACA | 10547 & 10548 |
| PCNA | AGGCACTCAAGGACCTCA | CGAAGCCCTCAGACCGCA | 10549 & 10550 |
| PCNT | GTCGGAGACCAGGAAGCA | ACCCGCGATGCTGAGACA | 10551 & 10552 |
| PCNXL2 | TCCCTGTCCCGAAGGCAA | CAGGTGTAAGCCGGGACA | 10553 & 10554 |
| PCOLCE | ACCCACCTGCCCAAAGCA | GGCACTGCTTGCAAGGCA | 10555 & 10556 |
| PCOLCE2 | GGAGGACTCCTTGACAGA | GGGCTACAATGTGCCACA | 10557 & 10558 |
| PCP4 | AGGTGCTGGGGCAACCAA | TGAATGGCCACCGCTGCA | 10559 & 10560 |
| PCSK1 | CGGAGACGCACACAGGCA | CAGAGGTCCAGACAACCA | 10561 & 10562 |
| PCSK1N | AGGAGGCAGGCGACGAGA | CCGCAAGAATCCGTCCCA | 10563 & 10564 |
| PCSK2 | CTGGCGGGACATGCAGCA | CTCAGGGTCCTGCACGGA | 10565 & 10566 |
| PCSK4 | CGCCTACATCCTGGGACA | CGTGGAGGATGGGGGACA | 10567 & 10568 |
| PCSK5 | GCCGAGTTGAAGACCCCA | GGGGCAGCTGGAGACACA | 10569 & 10570 |
| PCSK6 | ATCTCACACCCACGCCGA | TGCGGACCTGGGATGGCA | 10571 & 10572 |
| PCSK7 | GCAGGATGGACCTGGAGA | CATCATGCCACTGGGGCA | 10573 & 10574 |
| PCSK9 | GTCCACACAGCTCCACCA | GACCTCGTGGCCTCAGCA | 10575 & 10576 |
| PCYOX1 | ATGGCCAAAGCACGGACA | CTGCAGAAGCCCTGAGCA | 10577 & 10578 |
| PCYOX1L | AGCTGAGTGGCAGGCCCA | TAAGCCAGCAAGGCCACA | 10579 & 10580 |
| PCYT2 | TCCAGCGGATCATCACCA | GCCTGGCAGCCTCCAGGA | 10581 & 10582 |
| PDAP1 | GAAGAAAGGGAGGCCACA | CCTGCAGCTGCGCGTCGA | 10583 & 10584 |
| PDCD1 | CTGAAGGAGGACCCCTCA | GCTCAGGGACACAGGGCA | 10585 & 10586 |
| PDCD10 | AAGCTGAGACCACATCCA | GTCTGGGCTGCAGACAGA | 10587 & 10588 |
| PDCD11 | GGTGGAGATTGCCCCAGA | GTGAGGACCTGTGAGGGA | 10589 & 10590 |
| PDCD1LG2 | CACACCGTGAAAGAGCCA | TAGTCCCAGGCGACCCCA | 10591 & 10592 |
| PDCD2L | GGAGGGGCCTTCACCACA | AGCCCAGGAGGCACAGGA | 10593 & 10594 |
| PDCD4 | ACCACAGTTGGTGGGCCA | CCCACCTCCAGAGCCCCA | 10595 & 10596 |
| PDCD6 | CTGAAGCAGGCCCTCTCA | CCGTCAACCTCTGCAGGA | 10597 & 10598 |
| PDDC1 | GCCACCAACGAGGACAGA | CGCCCGAATCCTTCACGA | 10599 & 10600 |
| PDE10A | TGAAGTCCCCCAAGGCCA | CTGAGCCACGGATGGGGA | 10601 & 10602 |
| PDE11A | CTCCAGACAGGTGGCAGA | CCAGTTGCAACCGAGGCA | 10603 & 10604 |
| PDE1B | CAGCCACCCAACCAAGCA | TGGAAGTGCGGTCACAGA | 10605 & 10606 |
| PDE2A | GTTCCCCAAAGCGGCAGA | GCCCTAGTGCCATCCAGA | 10607 & 10608 |
| PDE3A | CACTCAGAGTGCCCCAGA | TCCAGGGGCTCATCAGCA | 10609 & 10610 |
| PDE4A | ACCATAGCCTGGGAGGCA | CACGAATTCCTCCCGGGA | 10611 & 10612 |
| PDE4B | GTGGGAGACATGGGCAGA | CTCCATCAGACCCTGGCA | 10613 & 10614 |
| PDE4C | TCTGGAGGAGGCAGAGGA | CGGCTTCAGGGGACAGGA | 10615 & 10616 |
| PDE4D | CTGGGAGACATGGGCAGA | GTCATCAGGTGCAGGAGA | 10617 & 10618 |
| PDE4DIP | GCCTTGAAGCCCAAGGCA | CCACTTTGCCAGGCAGCA | 10619 & 10620 |
| PDE5A | AGAGCCATGGCCAAGCAA | GGGTCTGGGCAGATGGCA | 10621 & 10622 |
| PDE6B | AGACGACCCGGAAGGAGA | CCCAGAACTCAGCAGCCA | 10623 & 10624 |
| PDE6C | GTGAGGAAAGGGTACCGA | GCAGCAGCAAGCATGGCA | 10625 & 10626 |
| PDE6G | CAGGCAGTTCAAGAGCAA | AAGGGCAGATGACTGTGA | 10627 & 10628 |
| PDE7A | CGGTACTGCCCCTGGACA | CTCCACGCCTCTGAGAGA | 10629 & 10630 |
| PDE7B | CACGATGTGGACCACCCA | CCAAGATCAAGGAGCCCA | 10631 & 10632 |
| PDGFA | GGAGTCAGGTCGACCCCA | GACGCGGGAGGGCTGGCA | 10633 & 10634 |
| PDGFB | GCTGCTGCAACAACCGCA | CGGGTCACAGGCCGTGCA | 10635 & 10636 |
| PDGFC | ACAGCTGCACACCTCGTA | GTGGAGACAACAGGCACA | 10637 & 10638 |
| PDGFD | CAGTTGCACTCCCAGGAA | GCATGTGCAGGACCTCCA | 10639 & 10640 |
| PDGFRA | TGGGTACCGGATGGCCAA | GGCAGCAGATTCTCCACA | 10641 & 10642 |
| PDGFRB | CAGCTACCAGGTGGCCAA | GAGCAGGATCCCGAAGGA | 10643 & 10644 |
| PDGFRL | CCAAGGAGATCCCAGCCA | CCACTGGGAACCGCCACA | 10645 & 10646 |
| PDHA1 | AGAGAGCGGCAGCCAGCA | CCTCTCGGACGCACAGGA | 10647 & 10648 |
| PDHA2 | ACCCCTCGGATCACGTCA | CAGGCCAGAGCAATGCCA | 10649 & 10650 |
| PDHB | GGAAGGAGGCTGGCCACA | GGCATAGGGACATCAGCA | 10651 & 10652 |
| PDHX | CCCAATGCAGTGGGCACA | AACAGCTCCAAGGTCACA | 10653 & 10654 |
| PDIA2 | GCACCCACTGCAAGGAGA | GTAGGGAAGCCGTGCACA | 10655 & 10656 |
| PDIA3 | ATGCTGGGCACAAACTCAA | CCTTCCCATCACGCGAGAA | 10657 & 10658 |
| PDIA4 | CCTAGAGGTGGCCAAGGA | TCGTCCAGGATGGCGGCA | 10659 & 10660 |
| PDIA6 | CGCCATCAATGCACGCAA | ACAGGTGCCGTGGAGCCA | 10661 & 10662 |
| PDILT | GATGCAGACGAACCCAGA | CCACGAGCTGCTTAACCA | 10663 & 10664 |
| PDK1 | GGTTACGGGACAGATGCA | CTGGGGACGCACCAGTCA | 10665 & 10666 |
| PDK2 | CCTCCCACCTCTACCACA | CTCAAGGGAACACCCCCA | 10667 & 10668 |
| PDK3 | CACCTGTAACGTGGCGGA | CCAGCTCTGGAGCTACCA | 10669 & 10670 |
| PDK4 | AGAATGCAATGCGGGCAA | ATTCTCAGGGGAACACCA | 10671 & 10672 |
| PDLIM1 | AGCCTCTGAACCCCAGGA | AGTGCTGGAGGCAGGCGA | 10673 & 10674 |
| PDLIM3 | AGTCGGACGTGTACCGGA | CAGAGCCATCGTCCACCA | 10675 & 10676 |
| PDLIM4 | CAAGCCCACGGCCAGCAA | CAGGCCGCAGTCACTGCA | 10677 & 10678 |
| PDLIM5 | CCAGCCAAGTGACCAGGA | GGTTACAATGGGCGCACA | 10679 & 10680 |
| PDLIM7 | TGCACCCAGCTGTGCCAA | CTCGCTCGCAATAGGGCA | 10681 & 10682 |
| PDP1 | AGGTGACTCTGGGACAGA | TTGCCCACAGCGTGGCGA | 10683 & 10684 |
| PDPK1 | GTGGCAGGACTCCCACCA | CTTCCGACATAGCCGGCA | 10685 & 10686 |
| PDPN | CAAAGTCCAAGCGCCACA | ATGGCTAGTAAGACCCCA | 10687 & 10688 |
| PDS5B | GAGGAGATGGTGAGACGA | CAGCAAGGCAGCAGGCTA | 10689 & 10690 |
| PDX1 | CGCGGAGCCTGAGCAGGA | GCTGGAGGGCTGTGGCGA | 10691 & 10692 |
| PDYN | TAGCATGGGCCATGAGGA | CCTGAGACCGAGTCACCA | 10693 & 10694 |

FIG. 1 Cont.

| | | | |
|---|---|---|---|
| PDZD2 | CAAGGCCAGCGACCAGGA | GCCAGGCTGGGAAGACCA | 10695 & 10696 |
| PDZD3 | GTCCAGGATCCAGGGGCA | TAGCTGCCACCAGGCCCA | 10697 & 10698 |
| PDZD8 | CACCACGACCACAAGCGA | CAAGAGGAGGTGGCACCA | 10699 & 10700 |
| PDZK1 | TGGGCTAGAGGATGAGGA | AAGTGGATCAGCCAGGGA | 10701 & 10702 |
| PDZK1IP1 | CGGCAGTGCCACCTGCCA | GGAACACGGCCACCGCGA | 10703 & 10704 |
| PDZRN3 | GCTGGAGCTGCTGAACGA | CATCCAGGACTCGCGGTA | 10705 & 10706 |
| PDZRN4 | CCTCTTCCGGACAGAGCA | GAGGAGCTGTGGTAAGGA | 10707 & 10708 |
| PEAR1 | CCCCTGATCCATGACCGA | GATGCCGTACTGGAGGCA | 10709 & 10710 |
| PEBP1 | GCCGCTAAAGTGTGACGA | GCCTGGTAACACGTGCCA | 10711 & 10712 |
| PEBP4 | CCCTCTTGGACGAGGACA | GGGCATCTGGATCCACCA | 10713 & 10714 |
| PECAM1 | CGGTGGATGAGGTCCAGA | TCACAGCACATTGCAGCA | 10715 & 10716 |
| PECR | CATCCGGAATGAGGAGGA | CTCAAGCACAGCGTGCCA | 10717 & 10718 |
| PEF1 | GAGCCCCCAGTTCACCCA | CCTGCAGCTGGGTGCACA | 10719 & 10720 |
| PEG3 | CAGCACAGGTGGTGCCAA | GGTGTCTGGCGAGGGACA | 10721 & 10722 |
| PELI1 | CAATGCAGCACGACCTCA | AGCTTCACATCCAAGCCA | 10723 & 10724 |
| PELO | GGCATCAGGATGTAGCCA | CGGGAACAGGGAAGCGGA | 10725 & 10726 |
| PEMT | GCAGGCCATGCTGAGCCA | AGAAGCTGGAGAGCACGA | 10727 & 10728 |
| PENK | GAAGTGAGATCCTCGCCA | TGAGGAATTGGCCAGCGA | 10729 & 10730 |
| PEPD | CGTGGGAGGCTACCCAGA | GGACCTCGCGGTTAAGGA | 10731 & 10732 |
| PER1 | GCTGCTCCTACCAGCAGA | TAGGAGGAGGAGGAGGCA | 10733 & 10734 |
| PERP | CAGCGGGTCCTACGAGGA | TCTGGAACACAGCAGCCA | 10735 & 10736 |
| PES1 | GGAAGACCGCAGGAAGGA | ACGTCATAGGTGGCCCCA | 10737 & 10738 |
| PEX1 | GATGCCCATGTGGAGAGA | GTTCCGGGACAGCAGGCA | 10739 & 10740 |
| PEX11A | CCGATCTCTGAAGCAGCA | ACAAGACCTCCAAGTCCA | 10741 & 10742 |
| PEX11B | GGAGGAGGTCTGCCCCAA | CCCACAATCCCAGGGCCA | 10743 & 10744 |
| PEX11G | AGGGAACCTGGCTGACCA | GAGCAGAGAGAGGGCCCA | 10745 & 10746 |
| PEX12 | CTGCCTACTCCACCACCA | TACGACACAGTGGGCACA | 10747 & 10748 |
| PEX13 | CTGGGCAAGTGGTGAGGA | GCATATCACCAGCCCGGA | 10749 & 10750 |
| PEX14 | GCTGCCAAGGCCACCACA | CTGATGGGGATGGAGGGA | 10751 & 10752 |
| PEX16 | GAAAGGGCCTGACCCGGA | GTGACCAGGCCAACGCCA | 10753 & 10754 |
| PEX19 | GGGCTAGGCATGGACGAA | CCGATGACTCTGCAACCA | 10755 & 10756 |
| PEX2 | AAGGCCCTGGAGCAGCTA | AAGCGAGCTAACAGCCCA | 10757 & 10758 |
| PEX26 | GCTCCAAGACCCAGCCAA | AGTCGCCGCTCCTCACCA | 10759 & 10760 |
| PEX5 | CCCGCTATAACCTGGGCA | AACGCAGGGTGCTCCAGA | 10761 & 10762 |
| PEX6 | CCCTTCTGACCCACAGCA | TCCTCAGCCAGGAGAGGA | 10763 & 10764 |
| PEX7 | GATTGGAGCCAAACCAGA | CAACCAGGGATGTGGGGA | 10765 & 10766 |
| PF4 | CACTGCCCCACTGCCCAA | CGGGGCTTGCAGGTCCAA | 10767 & 10768 |
| PF4V1 | CAGCCAGGTCCCGCCTCA | TCACACACAGGCACTGCA | 10769 & 10770 |
| PFDN1 | CTTCAGTCCAAGGAAGCA | CCATCAGCATCTCCCGGA | 10771 & 10772 |
| PFKFB1 | CCGCTATCCCAAGGGAGA | AGGCCAGGAGGCACCGCA | 10773 & 10774 |
| PFKFB3 | GTCCAGCGCTTGGAGCCA | GTGTGCAGACGGACTCCA | 10775 & 10776 |
| PFKL | CCCAGCCACCATCAGCAA | ACGGTGGCCAGGTAGCCA | 10777 & 10778 |
| PFKM | AGCAGGGTGGGAGCCCAA | CCAGAGCCCTCTTACGCA | 10779 & 10780 |
| PFKP | CACAGATGCGCACGCACA | CATGACCATGGGGACACA | 10781 & 10782 |
| PFN1 | CATCGTGGGCTACAAGGA | TGCCAACCAGGACACCCA | 10783 & 10784 |
| PFN2 | GGGGTCCATGGAGGCGGA | CCCCACCAACAGAGGGA | 10785 & 10786 |
| PGA3 | ACATCGGAGCCAGCGAGA | TGAAGACGATGTCGGGCA | 10787 & 10788 |
| PGA4 | TCCTGCAGAGCGAGGGGA | TACTGGCGGATGAAGACA | 10789 & 10790 |
| PGA5 | CACCATCAATGGAGTCCA | ACATCACCCAGGATCCAA | 10791 & 10792 |
| PGAM1 | ATGTCCCACCACCTCCGA | GACTCTCACAGGAGGGTA | 10793 & 10794 |
| PGAM2 | GCGAGAGCCTCAAGGACA | CGTGGGCTGCAATGAGCA | 10795 & 10796 |
| PGAM5 | GCGTCTGCAAAGTCAGCA | CCGGCTTCCAATGAGACA | 10797 & 10798 |
| PGAP1 | ACCATTGCACAGGCTCCA | TAAGCAGGAAGAGCTCCA | 10799 & 10800 |
| PGAP2 | AGGCTGGAGTGTACACCA | GTTCCCGAAGTCCCACCA | 10801 & 10802 |
| PGAP3 | GGGCTCTACCTCCAGGAA | GTGGTACATGGGGGAGGA | 10803 & 10804 |
| PGC | CTGAGGGTTGCCAGGCCA | AGGAAGGTGGCAGAGGGA | 10805 & 10806 |
| PGCP | CAGGGCCATCATGGAGGA | CTGGCTCCAGGCACTCCA | 10807 & 10808 |
| PGD | CATCCAGGCTCAGCGGGA | GAGGATGACACGGTGCCA | 10809 & 10810 |
| PGF | CCAGCGAGGTGGAGCACA | ACCGGCACACAGTGCAGA | 10811 & 10812 |
| PGK1 | GTGCCCATGCCTGACAA | TCTCCAGCAGGATGACAGA | 10813 & 10814 |
| PGK2 | TGATGAAGAGGGAGCCAA | TGAGCCACAACTTGAGCA | 10815 & 10816 |
| PGLS | CGAGCTGCCTGTGGAGGA | AGTGAGCAGGTGTGACCA | 10817 & 10818 |
| PGLYRP1 | GGAGAAGACGGGCTCGTA | CCCATGAAGCTGATGCCA | 10819 & 10820 |
| PGLYRP2 | CTACCACCAGGACACGCA | GCACCGCACAACTCGGGA | 10821 & 10822 |
| PGLYRP3 | GGAAGCCAGAGAGACACA | ACCCCTTCATACACGCCA | 10823 & 10824 |
| PGLYRP4 | GCACTAGAGGCAGCCCAA | GAGACAAGGTTCGGGCCA | 10825 & 10826 |
| PGM1 | CACGGAGCATGCCCACGA | AGGACAGCCCACAGTCCA | 10827 & 10828 |
| PGM2 | GCCTCAAGCTTGGGACGA | AAGCTATGACCCACCCCA | 10829 & 10830 |
| PGM3 | GTCCCACAATCCTGAGGA | CCTCCCAGGATGGTGCCA | 10831 & 10832 |
| PGP | TGGTCCGAGCCGTGGAGA | CCTGGGACACGCAGTCGA | 10833 & 10834 |
| PGPEP1 | AGGACGGGCCTGAAAGCA | AAGGCTGATCGACCGTGA | 10835 & 10836 |
| PGR | GTGGCAGATCCCACAGGA | AACGCTGTGAGCTCGACA | 10837 & 10838 |
| PGRMC1 | ACCCAAGCGATCTGGAGA | AGGAAGATGCAGAGGCCA | 10839 & 10840 |
| PGS1 | CCTGCTGGCCTCACCAGA | GCTGTCCCAGGCTGCACA | 10841 & 10842 |
| PHB | CTCAGCAGGAAGCAGAGA | GGAGTCGCCCTCAGCAGA | 10843 & 10844 |
| PHC2 | GCCAAGTGAGCCCACCAA | CCTCCTTGAGCAGCAGCA | 10845 & 10846 |
| PHEX | AATGGAGGCCTGCGGGAA | TGAGGGGGACTGTGAGCA | 10847 & 10848 |
| PHF1 | CAATCAGCCCGAGCCCCA | GCTGGGGGATGGTGGAGA | 10849 & 10850 |
| PHF10 | GGACAGCTCCTCTGGCAA | CCCAGGAACTGACTTGGA | 10851 & 10852 |
| PHF11 | AGAGGAGCCACCGTGGGA | GATGATCGGGAATTGAGCA | 10853 & 10854 |
| PHF12 | AGAACCACACCGTCGGCA | GGCAGGCTTGGGACAGGA | 10855 & 10856 |
| PHF13 | TCCGAGATGAGGACAGCA | GCAGGTCACGAGGTCCCA | 10857 & 10858 |

FIG. 1 Cont.

| | | | |
|---|---|---|---|
| PHF14 | CGGGAGTGATGAAGACGA | CAACCCCCTTCACTGGCA | 10859 & 10860 |
| PHF17 | GCCCTGGAAGTGAAGGCA | AGCTCTCTGGGACCACCA | 10861 & 10862 |
| PHF19 | CCAGATGGACAGTGGGCA | CTTGAGGTGGGACAGGGA | 10863 & 10864 |
| PHF2 | CCCTACAGCCCAACAGCA | CGGTCTCGATGGAAGCCA | 10865 & 10866 |
| PHF20 | GCTGGACAGAGGTGGAGA | CCCAGTGTAGTCCAGCCA | 10867 & 10868 |
| PHF21B | CCTGGAGACCGAGAGGAA | ACCTGGGGCACACCCACA | 10869 & 10870 |
| PHF23 | GCTCCAGTGAAGGCGAGA | AGGTGGATCCACGTCCCA | 10871 & 10872 |
| PHF3 | GGCAAGCAGCAGGACGAA | TGTGTGACAGGCCAGGCA | 10873 & 10874 |
| PHF5A | GCACCATCCAGGAGAAGGA | GAAGGGGCCACCCACCAA | 10875 & 10876 |
| PHF6 | GGCACAGTCCAGCTCACA | ATAGTAGCACCAGGCTGA | 10877 & 10878 |
| PHF7 | CCACGGAACCCACAGGGA | AAGGAAGGTTCTGGCCAA | 10879 & 10880 |
| PHF8 | GGCTAGGCTGATGGCAGA | AAGGCTTCGCACGGGGCA | 10881 & 10882 |
| PHGDH | GAGCAAGGCTTCGGGGAA | GGTAGGACAGCAGCCGCA | 10883 & 10884 |
| PHIP | GGCGACGGGAAGCACAGA | GTCCCATCACGACTGCCA | 10885 & 10886 |
| PHKA2 | ATCCTCGACGACCCGAGA | CCGAGAGCAGCGTCAGCA | 10887 & 10888 |
| PHKG1 | TCTGGCACCGGAAGCAGA | GGGGTTGCACCACCAGGA | 10889 & 10890 |
| PHKG2 | ACCCATCGTGTACGGCCA | CCGTAGAGCCGGAAGGCA | 10891 & 10892 |
| PHLDA1 | GCCGGTCAAGCTCAAGGA | GCACCATCTGCAGCGTGA | 10893 & 10894 |
| PHLDA2 | CGGGGTGCTCACCTCCGA | TGCGCTCCACGCAGTCCA | 10895 & 10896 |
| PHLDA3 | CCGCATCAAGGCCGTGGA | TGGGCGTTCCAGCCGGGA | 10897 & 10898 |
| PHLDB2 | TGCCCTTCGGGAACGGAA | CAGCACAGAGACTGAGGA | 10899 & 10900 |
| PHOX2A | CAGCCGCTCAAGGGCGCA | GGAGGACAGAACCCCGGA | 10901 & 10902 |
| PHOX2B | GACCTCACAGAGGCGCGA | GTCCCTGGAAGAGTCAGA | 10903 & 10904 |
| PHTF2 | GGAACAACTCACAGCACA | CACACAAGAGACACGCGA | 10905 & 10906 |
| PI15 | CCGGCAGCAAATATGGAA | GTGTGCACATGGGACCAA | 10907 & 10908 |
| PI3 | GAGGCAGCTGTCACGGGA | GGGATTCAACATGGCGCA | 10909 & 10910 |
| PI4KA | TCGGCAACAAGCCACCCA | CGATCTCAGTGGCCAGCA | 10911 & 10912 |
| PIAS1 | CAGTATCCCGCACCCCAA | ACCGAGACGAGTGTAGGA | 10913 & 10914 |
| PIAS2 | CCCTCCTGCCAAAAGGAA | AGCAGCAGGATCAACCGA | 10915 & 10916 |
| PIAS3 | ACATCTGGCCACCAGCCA | GCTCCCAGTGGGAAGGCA | 10917 & 10918 |
| PICALM | GCATCGGAAATGGAACCA | TAGTAGCAGGATAGGCCA | 10919 & 10920 |
| PICK1 | CTCCCAGATGCGCAAGGA | AGACGTCGGCATCCCGCA | 10921 & 10922 |
| PID1 | CTCCTGGAAATCCGGCCA | CGGGCCACCTGGAAGGTA | 10923 & 10924 |
| PIF1 | GGGCGATGTCCATCCACA | GGTCACAGCGAACCGCCA | 10925 & 10926 |
| PIGK | CAGCGTGGCCGCTAGTCA | ATCGGGATGTACACACCA | 10927 & 10928 |
| PIGL | GAGTAAGTGGCCACAGCA | TTGAGCACGAAGAGGACA | 10929 & 10930 |
| PIGQ | GTGCTCCTGAACACGGCA | ACCATGGTGACCGCAGCA | 10931 & 10932 |
| PIGR | CCACCACTGAGAGCACCA | CGGTGCTGGACTGGAGCA | 10933 & 10934 |
| PIGT | CTGGTGAACCTGCCGACA | GGAAGGTTCGGGTGAGGA | 10935 & 10936 |
| PIGX | AAGATGGAGAAGCCTCGA | AAGCACAAGGGGCTGCCA | 10937 & 10938 |
| PIGZ | GGCGAGACATGGCACGCA | AGGCAGATAGCAGGGCCA | 10939 & 10940 |
| PIK3AP1 | TCAGTGTGAGCAGCGGGA | GGGGTCTCTCGAGGGACA | 10941 & 10942 |
| PIK3C2A | ACCCCAAACTACAGACGCA | CCAGAAAAACGAAGCTGAGCA | 10943 & 10944 |
| PIK3C2B | GGGAAGAAGACCAGCGCA | GCACAGCCATACGACGCA | 10945 & 10946 |
| PIK3C2G | TGACAAAGTCGGGCCACA | GCAGTCCTGCATACAGCA | 10947 & 10948 |
| PIK3C3 | GGATCTACCTCAAGAGGCCA | CGCAACCGGGCAACAGCA | 10949 & 10950 |
| PIK3CA | GGAGCCCAAGAATGCACA | GCATTCCAGAGCCAAGCA | 10951 & 10952 |
| PIK3CB | CAGTCACCCCTGAACCCA | TCAATGAGGCCAGAGCGA | 10953 & 10954 |
| PIK3CD | CAAGCCCCAGACCAAGGA | CCACGCAGACTTCAGCCA | 10955 & 10956 |
| PIK3CG | ACAGTGGGCAACACGGGA | GCCACACAGTAGCCTGCA | 10957 & 10958 |
| PIK3IP1 | GCGGATGAACTCCAAGGA | TGAAGGCAGACAAGGGCA | 10959 & 10960 |
| PIK3R1 | CGACAGCCTGCACCAGCA | CCCCAGTACCATTCAGCA | 10961 & 10962 |
| PIK3R2 | ATCAACCGCACGCAGGCA | CGTGCGGTAGATGACGCA | 10963 & 10964 |
| PIK3R3 | CTCCATTACCAGCAGACA | GCATGAACAGGGTAGGCA | 10965 & 10966 |
| PIK3R5 | ACCCCTGGTATGAGCGCA | TGTCAGCCAGGATGGGCA | 10967 & 10968 |
| PIKFYVE | GATTGAGGGACGAGGGCA | GAGGCAACAGCCTGCGGA | 10969 & 10970 |
| PILRB | CCAGCAGCACAACCACCA | TGAGCACAGCGACAGCCA | 10971 & 10972 |
| PIM1 | CCGCTACCATCGCTACCA | TGGTCTCAGGGCCAAGCA | 10973 & 10974 |
| PIM2 | CGACCCTCACTGGAAGAGA | TAGCAAGGACCAGGCCAA | 10975 & 10976 |
| PIM3 | CTCTCCAGAGTGCCAGCA | CAGGGTCGAGGGTGCACA | 10977 & 10978 |
| PIN1 | TAACGCCAGCCAGTGGGA | GCAGGTGCGAGCAGCGGA | 10979 & 10980 |
| PINK1 | GGGCATCGCGCACAGAGA | TGGACACCTCTGGGGCCA | 10981 & 10982 |
| PINX1 | CCAAGTTTGGCCAGCGGA | GGTAGCTCCGAGTCCCA | 10983 & 10984 |
| PIP | TCAGGGCCAGCCCTGCCA | TGAACTGCAAGCACTGCA | 10985 & 10986 |
| PIP5K1A | AGCAGGCTCCAGTGGCAA | GGAATAGGCGAGCCCTCA | 10987 & 10988 |
| PIPOX | CAGCAGGTCCTTGGACCA | GGTGGGGACACAAGCCCA | 10989 & 10990 |
| PITPNB | CCAGTCAGTCAAGACCAA | TAGGCACACATCTGGGGA | 10991 & 10992 |
| PITX2 | TGCAGCCCTACGACGACA | TCACTGCTGAGGGCACCA | 10993 & 10994 |
| PITX3 | CGGCTACTCGTACGGCAA | GATGGAGCTGGGTGGCGA | 10995 & 10996 |
| PIWIL4 | TGCCCAGTCCCAAGCCAA | GTTAACACTGGCCACGCA | 10997 & 10998 |
| PKD1 | GGTCACCGTGCTGAACGA | TGTGGACCCTCAGGGACA | 10999 & 11000 |
| PKD2 | GCGGCAAGGAGGAGGCAA | CATCCAGGCTTCGAGGGA | 11001 & 11002 |
| PKD2L2 | GCTGGATCACAAGAGGGA | GCAGGGAATTCTGCCACCA | 11003 & 11004 |
| PKDCC | CATCCTACCACCACGGGA | AAGGCCCGACACTGGGCA | 11005 & 11006 |
| PKDREJ | AGTGGGACCCAACAGCGA | GCACCAGGAAGGTGGCGA | 11007 & 11008 |
| PKHD1 | GGAGTCTCACGAGGACCA | TCCCCGAAGCAACGCACA | 11009 & 11010 |
| PKHD1L1 | CAACCGAGTCCGAGGGAA | CCTGGGCAAGGTTCACCA | 11011 & 11012 |
| PKIA | GGGGAAGCCCAGGGAGA | GCAATGCAGCACAGCCA | 11013 & 11014 |
| PKLR | CCAACGAGGGCAGAGACA | AAGGCAGCCTCCACAGCA | 11015 & 11016 |
| PKM2 | GCGACCCCACAGAAGCCA | GGATTCCGGGTCACAGCA | 11017 & 11018 |
| PKN1 | CCCAGGGGATGATGAGGA | CGATGGCTTCGGCCGACA | 11019 & 11020 |
| PKNOX1 | AGGGCAGAGCGAGGACGA | CCAAGACCAGCCCGCTGA | 11021 & 11022 |

FIG. 1 Cont.

| | | | |
|---|---|---|---|
| PKNOX2 | GCCCAAGCATGCCACCAA | CAAGCATGGGCTGCAGGA | 11023 & 11024 |
| PKP1 | GCAACGCCTACACCGAGA | GGCTCATGCCACTGGACA | 11025 & 11026 |
| PKP2 | GGCCATTAGTGCAGGCGA | CGTGTGTGCCCACAGAGA | 11027 & 11028 |
| PKP3 | CACGAAGGTGGTGAGCCA | TACAGCAGGTCTCGGGCA | 11029 & 11030 |
| PKP4 | GACTGTCGAAGTCCCCCA | GCTCCACAAGGATGGGGA | 11031 & 11032 |
| PLA1A | TTCGTCAACGGAGGCCAA | TCCAGACAGCGTCCAGCA | 11033 & 11034 |
| PLA2G10 | GTGCTGCCATGGCCACGA | ATTGACGCACTGCCAGGA | 11035 & 11036 |
| PLA2G12A | CCTCCTGGGAGGCGAGGA | GTCAGGGAAGGGATACCA | 11037 & 11038 |
| PLA2G12B | GGGTCTCAAGGTACCAGA | CCGCTTAAGGTCAGAGCA | 11039 & 11040 |
| PLA2G15 | GGCTGGTGGAAGCCACGA | GTACCATCGCCGTCACCA | 11041 & 11042 |
| PLA2G1B | AGGCCAAGAAGCTGGACA | CAGGTGATTGCCGAGCCA | 11043 & 11044 |
| PLA2G2A | GGCAGAGGATCCCCCAA | GCAAAACAGGTGGCAGCA | 11045 & 11046 |
| PLA2G2C | CCGTGGATGACACTGACA | GTTCAACACAGGCTGGCA | 11047 & 11048 |
| PLA2G2D | ACTGCTCTGACAAGGGAA | GCTTCAGGCAGAAGGCCA | 11049 & 11050 |
| PLA2G2E | CGAGAAGATGACAGGCAA | AGTCTGGTCCACCGGCCA | 11051 & 11052 |
| PLA2G3 | GCCTCGACAGAAGCAGCA | CAAGCCTGGGAGAGACCA | 11053 & 11054 |
| PLA2G4A | CACACGAACCCAAAGGCA | TGAGATTCAAGCCCAGCA | 11055 & 11056 |
| PLA2G4B | GGTCAGGAACCAGGCCAA | TTGGGGAGCCCATCCAGA | 11057 & 11058 |
| PLA2G4F | ACTGCCTGGACCGAGGAA | GTGCAGCACAATGGGGGA | 11059 & 11060 |
| PLA2G5 | CCCCAAGGATGGCACCGA | GCAGGTGACCACGCCCCA | 11061 & 11062 |
| PLA2G6 | GGCCAAGGAACTGGGCAA | CCCAGAGGGCGTTGACCA | 11063 & 11064 |
| PLA2G7 | AGGTACGGCAAAGAGCAA | ATCCATGCATCCAGGGCA | 11065 & 11066 |
| PLA2R1 | GCCGGTGCAGTACACACA | GCTGCTTGCACAAGGACA | 11067 & 11068 |
| PLAC1 | AGCAAGAGCAGGGCCACA | ACAAGGTGGACAATCGCA | 11069 & 11070 |
| PLAC8 | GCAGACAGGCATGTGTGA | ATAGATCCAGGGATGCCA | 11071 & 11072 |
| PLAC9 | TGGAGGAGATGGTAGAGA | GCTCCTCCAGCAGGCCCA | 11073 & 11074 |
| PLAG1 | TTCCCAGGAAGAAGCACA | GCTGACAGTGAGTGCAGA | 11075 & 11076 |
| PLAGL1 | TATGCAGCCGCTGCCAGA | GAGGCTCTTGCAGAGGCA | 11077 & 11078 |
| PLAT | CCATCCAGCCGCTGCACA | GCGGCCATCGTTCAGACA | 11079 & 11080 |
| PLAU | GGTGATCAGCGCCACACA | CGGATCTTCAGCAAGGCA | 11081 & 11082 |
| PLAUR | CGCCTTCAGCATGAACCA | GTGAGGCTGAGATGGGCA | 11083 & 11084 |
| PLB1 | TCCAACAGGCCCTGGACA | AGCTGCCAGCATGGCACA | 11085 & 11086 |
| PLBD2 | CAAAGCCTGCAACCCCCA | CATGGGAGCGCTGACGCA | 11087 & 11088 |
| PLCB1 | GAAGGGACGGACTGCAGA | TCCAGGGGCTCCATGAGA | 11089 & 11090 |
| PLCB2 | GCCTGCACAGTGAGAGCA | GGAAGGGCTTCTCAGGCA | 11091 & 11092 |
| PLCB4 | GAAAGGCCAACACCGCCA | ACACCAGAGGCCAGGGCA | 11093 & 11094 |
| PLCG1 | TGAGGAGGAGCCCAAGGA | CTCTCGCACGAGGAAGGA | 11095 & 11096 |
| PLCG2 | CCCTCTACGACGTCAGCA | GATGAGGGCACCACGGCA | 11097 & 11098 |
| PLCH2 | GCACCAGGACATGACGCA | TCCACGCAGCGGCAGCCA | 11099 & 11100 |
| PLCL1 | GAGGAGGAAAGGCACAGA | GACTGGCAATTGGAGGGA | 11101 & 11102 |
| PLD1 | GATGACCCAAGTGAGGACA | CATTGGGAAGGCACCGGA | 11103 & 11104 |
| PLD2 | GGCTGAGAGCAACGCCAA | TGAGGGGGAAGTGGACCA | 11105 & 11106 |
| PLEC | TCACCGAGTTCGCCGACA | TGTCCAGGATGCCAGCCA | 11107 & 11108 |
| PLEK | AGACCCTGCCTACCTGCA | TCCACTGAAGTCACCACA | 11109 & 11110 |
| PLEK2 | CCAACAGCTTCACGGCCA | AGGAACTGCTCGGCCAGA | 11111 & 11112 |
| PLEKHA1 | CTTGCCAAGGTCAAGCCA | CTGACCGGAAGGCTCGCA | 11113 & 11114 |
| PLEKHA8 | GGAAAGGTTGCAAAGGGA | TGGCTGATCCCAGGGCCA | 11115 & 11116 |
| PLEKHG2 | CCCTCCCAACTTCACCCA | GCAGCTGGAACATGGGCA | 11117 & 11118 |
| PLEKHG3 | GGCACAGGAGGACAGCAA | GAGCTGACAGCTGAGGGA | 11119 & 11120 |
| PLEKHG4B | GCTCAGCAGCCATGGCAA | AGCGCGTACTTGGCCACA | 11121 & 11122 |
| PLEKHG5 | GCAGGAGGAGGAAGAGGA | TCCCCAGGCTCTACCACA | 11123 & 11124 |
| PLG | CATCCTGGGTGCACACCA | TCAGTGATGACGGCAGGA | 11125 & 11126 |
| PLIN1 | CAGACAGACACGGAGGGA | GTGCCACACCACCCAGGA | 11127 & 11128 |
| PLIN2 | CTCAGCAGCTCCAGACCA | CGCCTGCCATCACCCCCA | 11129 & 11130 |
| PLIN3 | CCGCCGCCAGGTGGAGGA | CCCACGAGCCACGTGACA | 11131 & 11132 |
| PLK1 | GCAAGAGGAGGCTGAGGA | CATTGAAGAGCACCCCCA | 11133 & 11134 |
| PLK2 | CCAAAGAGCAGCTGAGCA | AGGAGGCTCATGTGAGCA | 11135 & 11136 |
| PLK3 | GCAGTGGGTCAAGACGGA | CTGCCGCAGGTCTGGAGA | 11137 & 11138 |
| PLK4 | CTCCAACACAGGCACCAA | AAGACACTCCTGCCTGCA | 11139 & 11140 |
| PLLP | TGCGGACACCCCGTACCA | CAGGTCAACTGCCGCAGA | 11141 & 11142 |
| PLN | GCCTCAACAAGCACGTCAA | AGCAGAACTTCAGAGAAGCA | 11143 & 11144 |
| PLOD1 | CTACTACACCAGGGCCCA | GTAGCGCAGGAACCGACA | 11145 & 11146 |
| PLOD2 | AGTCAAGCGGAAGCCAGA | GACTCAATGCTCCCCAGA | 11147 & 11148 |
| PLOD3 | ATGTGCCCACCGTGGACA | GTGGTGTGGCCGCAGAGA | 11149 & 11150 |
| PLP1 | CACCTGGACCACCTGCCA | GACAGAAGGTTGGAGCCA | 11151 & 11152 |
| PLS3 | AGGAAGGTGAACCACGGA | CCACTGACAACATCAGCA | 11153 & 11154 |
| PLSCR1 | AGCTACCCACCCCCACCA | GGTACCCCTGCAGCTCCA | 11155 & 11156 |
| PLSCR4 | TGCCAGACAAGAGCTGGA | GAATCTGAACCACAGCCA | 11157 & 11158 |
| PLTP | AGGTCCAGCTGTCCAGCA | TGGGATCAGAGCCAGCGA | 11159 & 11160 |
| PLXDC1 | CCAGCAAGGTCACCAGCA | GCCTCCTGTGCACAGCCA | 11161 & 11162 |
| PLXNA1 | TGACGGTCACAGGCACCA | CACAGGGTTGGCCACAGA | 11163 & 11164 |
| PLXNA4 | GAGGGACCCAAGTGACCA | TGTCCACCTGCACCGACA | 11165 & 11166 |
| PLXNB1 | CCAAACTGCCATGCCCCA | AGTCAGTGGCTCCACCGA | 11167 & 11168 |
| PLXNB2 | CCCACGATGCCAACGAGA | CAGGGCCTCATACACGCA | 11169 & 11170 |
| PLXNC1 | GCGAGCTCCGGAAAGAGA | AGCCACCTGACTCAGGGA | 11171 & 11172 |
| PM20D1 | ATCAGGACCACCACGGCA | CAGAAGGGCTGACGGGGA | 11173 & 11174 |
| PMAIP1 | GGACACCCGATCCCAGCA | GAGTAGCACACTCGACTTCCA | 11175 & 11176 |
| PMCH | TTCCCAGCTGAGAATGGA | GCCAACAAGGTCGGTAGA | 11177 & 11178 |
| PMEL | GGGTACCACACTGGCAGA | GACCTTCAGGCTCAGGGA | 11179 & 11180 |
| PMEPA1 | GCTGGAACTGAACCGGGA | CCAGCCTGGCACTATCCA | 11181 & 11182 |
| PML | GGGAATTCCAGGAGGCCA | GGTAGACATGCTGGGCCA | 11183 & 11184 |
| PMM1 | CCTGGAGGAGAGGATCGA | TGTCCCAGCCCTCGGGGA | 11185 & 11186 |

FIG. 1 Cont.

| | | | |
|---|---|---|---|
| PMM2 | ACGTGGATGGGACCCTCA | AGTCCGATCCGCCTACCA | 11187 & 11188 |
| PMP22 | ACCAAACGAATGGCTGCA | ACCGTGTAGATGGCCGCA | 11189 & 11190 |
| PMPCA | GGAGCTGGAACGAGCCAA | TGGAGCGAGTGGCCAGCA | 11191 & 11192 |
| PMS1 | CCTGCGGCAACAGTTCGA | ACGCTTGTGGCACCAGCA | 11193 & 11194 |
| PMS2 | GACCTTCGGACCCCAGGA | CATCACCGACTTCCGGCA | 11195 & 11196 |
| PMVK | GGGAGAGGAGAAACGCCA | ACCACTGGATGTCAGACA | 11197 & 11198 |
| PNKD | TACACCTGGCCACACACA | ACTCATGACCAGGCCACA | 11199 & 11200 |
| PNLIP | CTGGGAAGGGACTCGAGA | GCAGCCTCCACTTGGACA | 11201 & 11202 |
| PNLIPRP1 | TCCCCAATGGAGGAGAGA | GTGCAGGGATATGCAGCA | 11203 & 11204 |
| PNLIPRP3 | ATCAACGGTTCACGGGAA | ACCCAGCTTCCCCAGCCA | 11205 & 11206 |
| PNMA1 | GGTCCTAGAGGAGTGGCA | GAGCTCTCAACGCTCCCA | 11207 & 11208 |
| PNMT | GGAGGCTGTGAGCCCAGA | CCTCAGACACTGGCACCA | 11209 & 11210 |
| PNN | AGGCCCATCCAAGCCAGA | CTGAGAATCCACGCCTCA | 11211 & 11212 |
| PNO1 | GAGAATGTGACACGGACA | CTGCTAGCCACAGCTCGA | 11213 & 11214 |
| PNOC | CGAGCCTGGCATGGAGGA | CCCCGGTGAAGCCCCCAA | 11215 & 11216 |
| PNP | GTGAGCTACAGGAAGGCA | CCCAGCTTCTGCAGCACA | 11217 & 11218 |
| PNPLA4 | CAACGCCAAAACCAGAGA | GAGGCCTCCGTCCACCCA | 11219 & 11220 |
| PNPLA7 | GGACCAGCAGATCGAGGA | GGGGCATGTAACCGGACA | 11221 & 11222 |
| PNPLA8 | ACAGCAAGAAACCCCACA | AAGTAGCCTGGAGCAGCA | 11223 & 11224 |
| PNPT1 | GATGATCAGGAGCAGCAA | GAAGCAGTACCGCAGTCA | 11225 & 11226 |
| PNRC1 | CCCTCCCGATGGTGACCA | GAGGAGTGCCTCCCGCCA | 11227 & 11228 |
| POC5 | TCGGAGGAGCCAGCGCGA | GCTGCAGATCCTGCACCA | 11229 & 11230 |
| PODNL1 | GGTGCTGCCCCACAACCA | CCAGGCGGTTATAGGCCA | 11231 & 11232 |
| PODXL | GCCGAGCAGTCAAAGCCA | ACACATCCTTGGCAGGGA | 11233 & 11234 |
| POF1B | GCCAGCAAATCCAAGCCA | TACGGCTCAGATCAGCAA | 11235 & 11236 |
| POFUT1 | CCATGCTGAAGGACGGGA | CTTCAGGTCAGGCAGGCA | 11237 & 11238 |
| POFUT2 | TGAACCCACGTGGGAGGA | ACCTGGCGTGTGCGCAGA | 11239 & 11240 |
| POGLUT1 | CCAAAAACCAGGCCTGGA | CAAGTGAGCCACACAGGA | 11241 & 11242 |
| POLA1 | AGAGCCAACCTGTCGCAA | CAGCTGGGTGTACAGGGA | 11243 & 11244 |
| POLA2 | CAACCATGACCGGCCAGA | ACAGGCTCATGGTGCACA | 11245 & 11246 |
| POLB | CAGAATCAACCAAACAGCCA | GAAGCTGGCAAACACCCA | 11247 & 11248 |
| POLD1 | GCTGGCCAAGGAGACAGA | AGATCTCCAGGCACGGCA | 11249 & 11250 |
| POLD2 | CTTCCCAGAGTGCCCGCA | GCACTGAAGTCAGGGACA | 11251 & 11252 |
| POLD3 | GCTGAGTCACCATCCCCA | GAAGGAGGTTCAGGCTCA | 11253 & 11254 |
| POLD4 | CGGGATCACACGGCTGCA | TGCCACACCTCTGGGGGA | 11255 & 11256 |
| POLE | GCTACCTGGAACCAGGGA | TGCGCACAGTGTCCAGCA | 11257 & 11258 |
| POLE3 | ATGCCGTGATCACCAGGA | GAGAGCACATCACTGGCA | 11259 & 11260 |
| POLE4 | AGCGGCCTCGCAGCCCCA | AGGCCTTCACTCGCGCCA | 11261 & 11262 |
| POLG2 | GCAGCAGCTTAGCCGGGA | CCTGCTCCCTGAACACCA | 11263 & 11264 |
| POLH | CCCACAACAGCCAAAGCA | CACACTTCTCACAGGGCA | 11265 & 11266 |
| POLK | ATGAGCGTTGAGAGGACA | AGATCCTGAGCAAGCTCA | 11267 & 11268 |
| POLL | GAGCCCTGGCCAAAACCA | CAGTGGGAGTGGGCAGCA | 11269 & 11270 |
| POLQ | TCTGGGCGATACAGAGCA | AGCAGTACTGAGAGGGCA | 11271 & 11272 |
| POLR1A | CCGCTACAGCAGATGACA | GACGACCTTCCCGACCA | 11273 & 11274 |
| POLR1B | GAGACAGAGTCACCAACCA | CACACACATGGGCTACCGA | 11275 & 11276 |
| POLR1C | GATCCCCCTGGGGAACCA | GCCAATGCCCTTGACACA | 11277 & 11278 |
| POLR1D | CGATAAGGAACCAGCGAA | CGGAACCTCGAGCGCGGA | 11279 & 11280 |
| POLR2A | GCATGGAGATCCCCACCA | CTGGCATCTGACGCAGCA | 11281 & 11282 |
| POLR2B | ATGCCAGGGCATGAGGCA | GATACACGAACCCCTGGA | 11283 & 11284 |
| POLR2C | CTCGGAGCTGGATGAGGA | GAGAGCCACAGGACTCCA | 11285 & 11286 |
| POLR2D | TGCAGAGGACGAACAGGA | AAGCTACGAACACTGGCA | 11287 & 11288 |
| POLR2E | GACACCCTCCGCCAAGCA | TGACGACGTGCTCAGGGA | 11289 & 11290 |
| POLR2F | CAGAAGCGAATCACCACA | ACAGGGGCACACATCGCA | 11291 & 11292 |
| POLR2G | GTGATCCAGCCAGGCCGA | ACCTGAGTGACAACAGCA | 11293 & 11294 |
| POLR2H | GCCTTCCAGGGCTGACCA | GAGTCCACCTCGAATCCA | 11295 & 11296 |
| POLR2I | AAAGTGCGGCCACAAGGA | GGTCCAGCGGTGGCCGCA | 11297 & 11298 |
| POLR2J | GACTACAGCCCCCAGGAA | GCGCTCCTCCAGCAGGGA | 11299 & 11300 |
| POLR2K | CCTCCAAAGCAGCAACCA | CCCAGCATTCATCGAGCA | 11301 & 11302 |
| POLR3A | GCATTGGTGAGCCAGGCA | CCTTTCACGAGGCGAGCA | 11303 & 11304 |
| POLR3C | ACCATGCCCCATCCAGGA | CTGCACCAGTAGCCTGCA | 11305 & 11306 |
| POLR3G | CTTCGAGACTTAGGGAGCA | GCTAAATCCAACAGCCTCAA | 11307 & 11308 |
| POLR3GL | CATGAGGCAGCTCCCCTA | CCGCCAATCAGGGTTCCA | 11309 & 11310 |
| POM121 | AGAGTGGGAGCACAGCCA | GCAGGGGTGTTCAGACCA | 11311 & 11312 |
| POMC | AGGGCAGAAGCGCGAGGA | GGGGAAGGCCTCGGCCGA | 11313 & 11314 |
| POMT2 | GCCTCAAACCCAAGGACA | AGAGGAGGTAGAGGGCGA | 11315 & 11316 |
| POMZP3 | AGCTGAGCAGGACCCAGA | TGGACCACTGGCTCACGA | 11317 & 11318 |
| PON1 | GAACCATCCAGATGCCAA | AAGTGCTCAGGTCCCACA | 11319 & 11320 |
| PON2 | ATCCACATGGCATCAGCA | CCGGTCCAACAGCTGTGA | 11321 & 11322 |
| POP4 | CCTTCCTGAAGCGCAGCA | GGCGGGTGAAGTACTCCA | 11323 & 11324 |
| POP7 | AGAACGCGTGCTCTGAGA | ATTGGCAGCCACCTGCAA | 11325 & 11326 |
| POR | AGCTGGCGCAGTTCCACA | TCCGTGCATCCCCACAGA | 11327 & 11328 |
| POSTN | GCAAACCACCTTCACGGA | TAAGGAGGCGCTGATCCA | 11329 & 11330 |
| POT1 | ACCTCGCACTTCAAGCAA | AGCTGACAAGTCAGGTCA | 11331 & 11332 |
| POTEC | GCCGTACAATGCCAGGAA | AAGTGGTGTGAGGCCACA | 11333 & 11334 |
| POTED | TTCTGGAGACCACGACGA | GGGGAAGCAGTGGCGGCA | 11335 & 11336 |
| POTEF | GAGAGCGGCAAGAGCA | AGCAGTGGCAGCACCA | 11337 & 11338 |
| POU2AF1 | CATGGACACCTTACACCGA | GCGGAGAGGCATAGGTCAA | 11339 & 11340 |
| POU2F1 | CAAGCAGTGGTGGGACCA | AGGGGAGGGACTCAGAGA | 11341 & 11342 |
| POU2F2 | CCTTCAAGCAACGCCGCA | GAGGGCCTCGAAGCGGGA | 11343 & 11344 |
| POU2F3 | GGACCAGCATCGAGACCA | GGGAGATACCAGCCGGGA | 11345 & 11346 |
| POU5F1 | CGCCAGAAGGGCAAGCGA | AATGCATGGGAGAGCCCA | 11347 & 11348 |
| POU6F2 | CGGCCATCTGCAGACACA | CTCAGCCTCAGCCATCCA | 11349 & 11350 |

FIG. 1 Cont.

| | | | |
|---|---|---|---|
| PPAN | TCCCTTCAAGGACGGCGA | GCCCTGGAGACTTGGCAA | 11351 & 11352 |
| PPAP2A | AGGCAGACTGCGGCCTCA | CAGCATGCAGTACATGGA | 11353 & 11354 |
| PPAP2B | AGTCCAGGAAGCCAGGAA | CTATGCAGCAGGCCACCA | 11355 & 11356 |
| PPAP2C | CGGCTGCTGCGACCCACA | GCAGGAGGCCAACAAGGA | 11357 & 11358 |
| PPARA | GGCCAAGCTGGTGGCCAA | CACTGACGTGCACTGGCA | 11359 & 11360 |
| PPARD | GGTGGAGGCTATCCAGGA | GTTGCCGCAGGTCAGCCA | 11361 & 11362 |
| PPARG | AAGCAAAGGCGAGGGCGA | ACAGCCTCCACGGAGCGA | 11363 & 11364 |
| PPARGC1A | ACTGTGGTGCCACCACCA | CGTGTCCACCAGTGAGGA | 11365 & 11366 |
| PPAT | AAGGAAGCACCCACAGCA | TTCTGAAGACACCACCCA | 11367 & 11368 |
| PPBP | TGTAACAGTGCGAGACCA | ATGCAGCGGAGTTCAGCA | 11369 & 11370 |
| PPFIA4 | CTTGGGCACAGACCGGAA | GTCCCCAGGGTGGACACA | 11371 & 11372 |
| PPFIBP1 | GAGAATACCATCGCCCCA | AACGAGGCTCTAGAACCA | 11373 & 11374 |
| PPIA | TCACACGCCATAATGGCA | GCCATGGACAAGATGCCA | 11375 & 11376 |
| PPIB | CATGATCCAGGGCGGAGA | TCATCGGGGAAGCGCTCA | 11377 & 11378 |
| PPIC | TGACCGTCCACTCACCAA | TCAGCGATCTCAACCACA | 11379 & 11380 |
| PPIF | ACCAACCACAATGGCACA | ACAGGACACCTGGCCCCA | 11381 & 11382 |
| PPIG | GGCCAACAGAGGGAAGGA | GGGAATCAGCTCTCCACA | 11383 & 11384 |
| PPL | ATGGGCCTTGGAGGAGGA | CCACAAGCTCCAGGCGGA | 11385 & 11386 |
| PPM1A | AGTGAAGAAGGAGGCAGA | CATGGACTAAGTCGGGGA | 11387 & 11388 |
| PPM1B | ACACAAGGGAAGTCGAGA | ATGCGCATGACATGGGCA | 11389 & 11390 |
| PPM1D | CAAGTCACTGGAGGAGGA | TTGCTACGAACCAGGGCA | 11391 & 11392 |
| PPM1E | GCAGCATGGTTGCCCACA | GCACTGGTGCTGAGGCCA | 11393 & 11394 |
| PPM1G | GGCCCTGATACGAGGGAA | CCCCAATGGCTCTGGAGA | 11395 & 11396 |
| PPM1L | ACAAGACGCACCCGTCCA | AGGGCCTCTGGGAGTCGA | 11397 & 11398 |
| PPOX | GCAGTACCAAGGAGCCCA | ACCAGGAACCTCCCAGCA | 11399 & 11400 |
| PPP1CA | GTGTGGACGAGACCCTCA | CCTCCAGGGTTCAGGCCA | 11401 & 11402 |
| PPP1R15A | CAGCCAGGAGAGGACACA | GCAGGGGGTGTGGAAGCA | 11403 & 11404 |
| PPP1R15B | AGCCTGGAGAGGGCCGAA | CACTGGATGCACCTCCCA | 11405 & 11406 |
| PPP1R16B | CTTCACCGTACAGCAGCAA | GAGATACGGCAACAGCCA | 11407 & 11408 |
| PPP1R3A | CAAGCTCAAGGCAACGAA | TTCCCAGGATAGCCAGGA | 11409 & 11410 |
| PPP1R3C | AGCGAACAGTGACAGGGA | ATGACAGGGGGTAAGTCA | 11411 & 11412 |
| PPP1R8 | AGCAGGCTCCCAGCCACA | ACAGGAGTCAAGTCCACA | 11413 & 11414 |
| PPP1R9A | CAGCGGCTTAGGAGCAGA | AACCTGCTGCACACTCCA | 11415 & 11416 |
| PPP1R9B | ATGAGGAGCTGAGCCCCA | TCCACAGGGGACAGTGCA | 11417 & 11418 |
| PPP2CB | TTCCACATGAGGGCCCAA | AGCAGCCTGGTTCCCACA | 11419 & 11420 |
| PPP2R1A | TATGCCATCCGCGAGGCA | GCCCACAGACCTCAGACA | 11421 & 11422 |
| PPP2R1B | GAGACAGATCTCCCAGGA | CAGCAGCACGTCGTACCA | 11423 & 11424 |
| PPP2R2B | AGCCGAGTTCCACCCCCA | TGCCTGTCACACAGGGCA | 11425 & 11426 |
| PPP2R2C | CGGGCTGTGCTCAAGCCA | GCCAGGCCGTGTGCAGGA | 11427 & 11428 |
| PPP2R4 | TGCAGAGCACTCCAACCA | AGGGAACTTCTCCAGGCA | 11429 & 11430 |
| PPP2R5A | CCCAGCTCAAAGATGCCA | TGGAGGAAGTGTACGGAA | 11431 & 11432 |
| PPP2R5B | GAAGACGGAGCACAAGCA | TCTCCAGGAACTGCACCA | 11433 & 11434 |
| PPP2R5C | CCAAAGACTCACAGTCCA | GCCGGAAGAGGGGTTCCA | 11435 & 11436 |
| PPP3CB | CTGAGAGGCAACCATGAA | AAGTGCAGCAAGAGGGCA | 11437 & 11438 |
| PPP3R2 | TGCCGGAGCTGCGCCACA | ACTGGGAGGTCCCCAGGA | 11439 & 11440 |
| PPP4C | GAGTCGCCAGATCACGCA | ACCAGAGGAGGTCACACA | 11441 & 11442 |
| PPP6C | CATCGAACGGAATCAGGA | TCGGGGACTGATAGCCCA | 11443 & 11444 |
| PPP6R2 | GTGACTCAGAAGGCGCCA | CCCACACACTGGAACCCA | 11445 & 11446 |
| PPPDE1 | CAGCCAAGAACTCCAGGA | GCAGTGCTTGCCACGGAA | 11447 & 11448 |
| PPRC1 | GCAGAGCACTGTCCCCAA | GCTCCAGCAGACTGGACA | 11449 & 11450 |
| PPT2 | GACCATCCCAATGCCACA | GATACCGGCCATTGGACA | 11451 & 11452 |
| PPY | ATGCCACACCAGAGCAGA | CCCACTCCGAGAAGGCCA | 11453 & 11454 |
| PPYR1 | ACCGCACCATCTACACCA | AGGCCACCACCATCACCA | 11455 & 11456 |
| PQLC1 | CCGCAACCACCGCCACCA | GAGAACTGCAGAGGGGCA | 11457 & 11458 |
| PQLC2 | CCTCCGGAAGTCCACCCA | AGGGCAGGTGGTGCAGCA | 11459 & 11460 |
| PRAF2 | GCCGGGTACGTGCGGCCA | GCAACGAGGCGTGCACCA | 11461 & 11462 |
| PRAME | GCATGCCAGGCTCAGGGA | GTCCCCACAGTGAGGACA | 11463 & 11464 |
| PRAP1 | CAGAGCAGGACCCAGAGA | CGGCTTCTGGACAGGGAA | 11465 & 11466 |
| PRB1 | CAACCCCAAGGTCCCCCA | GGAGGTGGGGGACCCTGA | 11467 & 11468 |
| PRB2 | GGAGGCAACCAGCCCCAA | CCTGGAGGAGATCGGGCA | 11469 & 11470 |
| PRB4 | AGACCACCCCCACAAGGA | AGATCGGGCACTTCGGGA | 11471 & 11472 |
| PRC1 | CCTTCTGGCAGCAAGCCA | GCCGAGCCAGGGTACCCA | 11473 & 11474 |
| PRCC | CCAGGACGATGCAGCCAA | GCAGGATAGTAGCCACCA | 11475 & 11476 |
| PRCP | CCCTGGTCAGGAGGTGGA | CTTCCAAGGAGCGGGCTA | 11477 & 11478 |
| PRDM1 | TGCTGACCGGCTCGAGGA | AAGGCTGCACCCTGAGGA | 11479 & 11480 |
| PRDM11 | GGGGATGTACACCCCCAA | GTGAGGTGCTCAGGGCCA | 11481 & 11482 |
| PRDM12 | GCATCCACACGCTGGACA | GTTGCGCAGCGTGGACGA | 11483 & 11484 |
| PRDM13 | TAAGCCCAAGACCGGCCA | CTTGCCGCAGAACTCGCA | 11485 & 11486 |
| PRDM14 | GCGAGTCCACTCTGGAGA | GAAGGGCTTCTCCCCGGA | 11487 & 11488 |
| PRDM15 | GGAAGCCTCGAACCCACA | AGACGTCAGTCTGGGGCA | 11489 & 11490 |
| PRDM16 | TTCGAACCTCCAGCGGCA | CGACTCTGAGGTGGGAGA | 11491 & 11492 |
| PRDM2 | GAGGCCAAGAAGCGGAGA | AAGAGCAAGAGGGGACCA | 11493 & 11494 |
| PRDM4 | CGGTGTTGCAGGCGAGCA | ATGGAGTCACTGAGGGCA | 11495 & 11496 |
| PRDM5 | CACCATCTCAGGAGCAGA | TCCAGGTAGCCAATCAGA | 11497 & 11498 |
| PRDM7 | GGACAAGGGGCATCCCAA | AGTGCAGACCCAGTGGCA | 11499 & 11500 |
| PRDM8 | GCAGAACTGGTGCGCCAA | GTGGCGCTCCCTGAAGGA | 11501 & 11502 |
| PRDM9 | GGCTGATCACCAAGGGGA | CATCCCCATACCAGACCA | 11503 & 11504 |
| PRDX1 | GCGCACCATTGCTCAGGA | TCCAGCCAGCTGGGCACA | 11505 & 11506 |
| PRDX2 | CGGCGTGCTGAAAACAGA | GGCTTCCAGCCAGCGGGA | 11507 & 11508 |
| PRDX3 | GGCCACATGAACATCGCA | ACGCCTTCACCAAGCGGA | 11509 & 11510 |
| PRDX4 | CCGGACTCGCGAAGAGGA | GGCGACCGATACCCGGGA | 11511 & 11512 |
| PRDX5 | CCACAAGGCGGAAGGCAA | GTGCCAGGCTGCAGGTGA | 11513 & 11514 |

FIG. 1 Cont.

| | | | |
|---|---|---|---|
| PRDX6 | AGCTACCACTGGCAGGAA | GTTGGAAGGACCATCACA | 11515 & 11516 |
| PRE8 | CTACGTGAGGGAGGCCCA | CGACACACAGCAGGAGCA | 11517 & 11518 |
| PRELP | CCTGGAGAACGTGCCACA | TCATGAGGTCCAGCGGGA | 11519 & 11520 |
| PREP | ATCAGAGGAGGTGGCGAA | GCCACTAAGAGGCCTCCA | 11521 & 11522 |
| PREX1 | GCGAGTACGAGGAGAGCA | CTCTGACAGCGTCACCCA | 11523 & 11524 |
| PRF1 | AGGAGCTGAGGACGAGCA | GGGGACATAGTCCAGGCA | 11525 & 11526 |
| PRG2 | GAGGTGCTACAGGGGCAA | AGCGACCCGAGCCTGTGA | 11527 & 11528 |
| PRG3 | CTGGACTGATGGGAGCCA | GGTGCATAGGGCCACACA | 11529 & 11530 |
| PRG4 | GACACCAACTCCCCGCAA | CGGGAGTAACTTCAGGCA | 11531 & 11532 |
| PRH2 | GGACCACCCCAACAGGGA | CCTCGAGGAGGACGGGGA | 11533 & 11534 |
| PRIC285 | TCCTGGACGTGAGGCAGA | CCTGTGGGAACTGCACCA | 11535 & 11536 |
| PRIM1 | CCTGGCTGGAGTGGGAGA | GGCATCCAATTCACGGCA | 11537 & 11538 |
| PRKAA1 | GCACCTTCGGCAAAGTGA | ACCACATCAAGGCTCCGA | 11539 & 11540 |
| PRKAA2 | CACAACTGCAGAGAGCCA | GTGTGACTGCCCAGGCGA | 11541 & 11542 |
| PRKAB1 | TGAACAAGGACACGGGGA | GGGTTGCGCTGAGCACCA | 11543 & 11544 |
| PRKAB2 | GTCTGAAGGAGGCAAGGA | CAAGCTGACTGGTAACCA | 11545 & 11546 |
| PRKACA | AGTACCTGGCCCCTGAGA | AGCTGAAGTGGGAAGGGA | 11547 & 11548 |
| PRKAG1 | GAAGCAGAGGTTCACCGA | CTCCACCTGTGAGCACCA | 11549 & 11550 |
| PRKAR1A | GGGGCATCGACCGAGACA | GACCGACGTTGTAGCACA | 11551 & 11552 |
| PRKAR2A | GGAACCAGGAGGTCGAGA | ACTGCATAAGCTGAGGCA | 11553 & 11554 |
| PRKAR2B | GGTCAAAGATGGGGAGCA | TAAGGCCAGTTCGCCGAA | 11555 & 11556 |
| PRKCA | ATGACGTGGAGTGCACCA | ATGACGAAGTACAGCCGA | 11557 & 11558 |
| PRKCB | GGGGTGACAACCAAGACA | AGGGTGCCTGCCCAGCCA | 11559 & 11560 |
| PRKCD | AAGCGGAGGTTGGAGCCA | GAAGCCAGCGAATGCAGA | 11561 & 11562 |
| PRKCDBP | AGGCCGAAGTTGGAGAGA | GCGCTCCGGCCAGGCCCA | 11563 & 11564 |
| PRKCE | GGCCGACAATGAGGACGA | GCGATGCCACACAGCCCA | 11565 & 11566 |
| PRKCG | GTCCAGGACGCCTGCACA | ACCAGCGTGCAGTCCACA | 11567 & 11568 |
| PRKCH | GGTGTCACCACGGCCACA | GCCAGGTAGGGTAGACCA | 11569 & 11570 |
| PRKCI | AGGATTACGGCCAGGAGA | GAGCACTCCAAGAGCCCA | 11571 & 11572 |
| PRKCQ | AGGAGATGCCAAGACGAA | GCGACTGACCAATCAGCA | 11573 & 11574 |
| PRKCSH | CTACGACGAGCAGACGCA | GACAAGCTTGAAGGGGCA | 11575 & 11576 |
| PRKCZ | TCACCGACAACCCGGACA | GGGAGGCTTTGACGGACA | 11577 & 11578 |
| PRKD1 | CCTTCCAGCCCATCACCA | CCTTGGGAATGACGGGCA | 11579 & 11580 |
| PRKD2 | GAGCCACATCTCAGCTGGA | CAGCTCTCGGAGGTCCA | 11581 & 11582 |
| PRKG1 | CAGGGACCTCAAGCCAGA | GTGGGCTGCCAGTCAGGA | 11583 & 11584 |
| PRKG2 | GCTGAACAAGCTGCAGGA | TGGAGAGAGACCAATCCA | 11585 & 11586 |
| PRKX | CTGGACGTGGCATGACGA | CAGGTACTCGATGGCACA | 11587 & 11588 |
| PRL | CCATCAACAGCTGCCACA | CAGAGGCTCATTCCAGGA | 11589 & 11590 |
| PRLH | TCGGTCGGAGGAGGGCAA | CACCGCCTTCCAGGGGGA | 11591 & 11592 |
| PRLR | GGCAACCCAGCAGAGGGA | AAGGGTTTAGCGGAGCCA | 11593 & 11594 |
| PRM2 | GGCTGCACCGGATCCACA | CCTCCGGTGCCTGCAGGA | 11595 & 11596 |
| PRMT1 | GCCTGCAAGTGAAGCGGA | CCAGTGCGTGTACGGGGA | 11597 & 11598 |
| PRMT2 | CTTCCACCCCACCACACA | CAGCCCAGCTCAGAGCCA | 11599 & 11600 |
| PRMT3 | CATCCATGTGCACGGCAA | GGCCCGTAGAGAACACGA | 11601 & 11602 |
| PRMT5 | GGCTCCAGAGAAAGCAGA | AGGAAGAGATGGGAGCCA | 11603 & 11604 |
| PRMT6 | CTACGGACTCCTGCACGA | CCGGACAATCCCTGCACA | 11605 & 11606 |
| PRMT7 | ATGGTGATGCCCCAGGCA | TCCCTGAAGTCCAGGGCA | 11607 & 11608 |
| PRMT8 | CATGACCTGCATCCGGGA | CTGCAGGCAGAATGCAGA | 11609 & 11610 |
| PRNP | GTCAGTGGAACAAGCCGA | CCCAGCATGTAGCCGCCA | 11611 & 11612 |
| PROCR | CGGTATGAACTGCGGGAA | ATGCCTACAGCCACACCA | 11613 & 11614 |
| PRODH | ACTGCGCAGGATGGAGGA | CCTCAAGAGCTCCAGCCA | 11615 & 11616 |
| PROK1 | GGAAACGCAAGCACCACA | GTCCATGGAGCAGCGGTA | 11617 & 11618 |
| PROK2 | TGGGCAAACTGGGAGACA | GCCTGGCAGACATGGGCA | 11619 & 11620 |
| PROKR2 | TCGCCATGAGCAACAGCA | AGGGACGCCAGTGCAGCA | 11621 & 11622 |
| PROL1 | CCCCGCAGCATCTACTGA | GGACAGTGGCATTGAGCA | 11623 & 11624 |
| PROM1 | CCAAAGAGGCGTTGGAGA | GGATGCACCAAGCACAGA | 11625 & 11626 |
| PROM2 | AGGAGGTGACTCAGCGCA | TGCACCATGCCAGGCAGA | 11627 & 11628 |
| PROP1 | GAACCGCAGAGCTAAGCA | GGCTGGGAAGGGAGGGCA | 11629 & 11630 |
| PROS1 | CTGGAGTTGTCGACACCA | CATCTGGAAGGCCACCCA | 11631 & 11632 |
| PROZ | GGAAGTGTGGTCACCAGA | CCTTGGTGACAAGGACCA | 11633 & 11634 |
| PRPF3 | GTACAGCCAAAGACCGGA | ACAGATTCACTCAGCGCA | 11635 & 11636 |
| PRPF31 | GGACCCTGCAGAAGCAGA | GGAGTGGGGTGAAGGCCA | 11637 & 11638 |
| PRPF4B | CCTCGGAGAAGGGACAGA | TCTACGACCACCGCGTGA | 11639 & 11640 |
| PRPF8 | GGAGACGAGTGAAGGCGA | GCAGCAGCCTGTTGAGCA | 11641 & 11642 |
| PRPS1 | CCAATGAAGTGGACCGCA | TGCCACAAGTGTCAGCCA | 11643 & 11644 |
| PRPS2 | GGTGGGCGACGTGAAGGA | TGGCTCCAGCTGACAGCA | 11645 & 11646 |
| PRR5L | TCCAGTTCAGGGCCAGGA | GGACAATGGACGAGGGCA | 11647 & 11648 |
| PRRT3 | GCAACGTTGGTGCAGGCA | CCACACCGTTGCGGGACA | 11649 & 11650 |
| PRRT4 | GGCAGGGCCAGTGAGAGA | GACTGAGGACGCAGACCA | 11651 & 11652 |
| PRRX1 | GCAGGAATGAGAGAGCCA | TCGGAGCAGGACGAGGTA | 11653 & 11654 |
| PRSS1 | CTACCCAGACGAGCTGCA | CTCCCTCAAGGAAGCCCA | 11655 & 11656 |
| PRSS12 | TGCCAGGGAGACAGCGGA | TCCACAGCCATACCCCCA | 11657 & 11658 |
| PRSS16 | GCACAGCTGAGGAGCACA | GACAAGGCTGAGAGCCCA | 11659 & 11660 |
| PRSS21 | TGCCCAAGGCGGGAAGGA | CCGATTGGGCCGACCACA | 11661 & 11662 |
| PRSS22 | AAGGTGCCTGTGCAGACA | CCAGCCTGAGATCCAGCA | 11663 & 11664 |
| PRSS23 | CAGCCATGCCCGAGCAGA | GCAGGAGGGCTCACCCCA | 11665 & 11666 |
| PRSS27 | CGAGGAGGGCAAGAAGGA | GGCACAGCCCTCACCCCA | 11667 & 11668 |
| PRSS3 | TGCTGACTACCCAGACGA | CTCCCTCAAGGAAGCCCA | 11669 & 11670 |
| PRSS33 | CGTGGTGAGCTGGGGCAA | GACGCGAGCCTGAATCCA | 11671 & 11672 |
| PRSS35 | CCACGGGGTTCAGAAGGA | CCCGTGAATCCAGAGGCA | 11673 & 11674 |
| PRSS36 | CCTGTGCCAGATGACGGA | CAGGCCTCTTCAGGACCA | 11675 & 11676 |
| PRSS37 | AGAAAACAGTGGCCGACA | TGACAGTAGCAACGGCCA | 11677 & 11678 |

FIG. 1 Cont.

| | | | |
|---|---|---|---|
| PRSS38 | ACCTGCTCTACGGACACA | CGGAGTCGCCCTCACACA | 11679 & 11680 |
| PRSS42 | GGTGCTGACGGCAGGCCA | TGGAGAAGGGCAAGGTCA | 11681 & 11682 |
| PRSS50 | CAGAAGAGCGAGGCCCCA | GCAGTGGGAGTGCCAGGA | 11683 & 11684 |
| PRSS53 | AGCCCTGGTGTCAGAGGA | GAGCTGCTTCAGGCCCCA | 11685 & 11686 |
| PRSS54 | GCTTGGGGGACCCAGGAA | CCAGGGCACGTCTCACCA | 11687 & 11688 |
| PRSS55 | TGACCCAGCTAGAGGGCA | GACTCCCGAGACTGGGGA | 11689 & 11690 |
| PRSS8 | CAACCTCTGTGGCAGCCA | ATGGGGAGAGGAGGCCCA | 11691 & 11692 |
| PRTG | TTACACCGTGAAGGGGCA | AGTACTGCCAGCTCCACA | 11693 & 11694 |
| PRTN3 | GCTGAGCAGCCCAGCCAA | GCCGGCAGAAGAAGGTGA | 11695 & 11696 |
| PRUNE2 | GCCCTGCACAAGACCAGA | GACCCTCACCCAAGCCGA | 11697 & 11698 |
| PSAP | AGCCCGTGCTGATCGAGA | CAAGGGCTTATGGGCCGA | 11699 & 11700 |
| PSAPL1 | ACGCGGAGAACCAGGGCA | TATAGGGCAGCGGCAGGA | 11701 & 11702 |
| PSAT1 | CCCGATGTCAAGGGAGCA | CCAGCAGGTCATCACGGA | 11703 & 11704 |
| PSEN1 | CTTCGACTCCAGCAGGCA | ACCAGCATACGAAGTGGA | 11705 & 11706 |
| PSEN2 | AAGCCAGGAGAACGAGGA | TGACAGGCACAAACAGCA | 11707 & 11708 |
| PSENEN | GCGAGTGTCCAATGAGGA | AGGTAGTCCCCAAGGGCA | 11709 & 11710 |
| PSG1 | CCAGGGTAAAGCGACCCA | GGGTCACTGCGGATGCCA | 11711 & 11712 |
| PSG11 | ACCCGGGAGGACGCAGGA | GCGTCCGGAGTCTCAGGA | 11713 & 11714 |
| PSG2 | TAAACCCCAGGGAGGCCA | ATAGGGAGGCTCTGACCA | 11715 & 11716 |
| PSG3 | CCACTGCCCAAGTCACGA | ACCAGATGTAGCCAGCAA | 11717 & 11718 |
| PSG4 | AGGCCATGGAGGCTGTGA | GACAGCTGCAACCTGTGA | 11719 & 11720 |
| PSG5 | CTACCCAGTGTCACGAGA | GGGTCACTGCGCATGCCA | 11721 & 11722 |
| PSG6 | CCCCAGGGAGAAGAAGGA | CCCTCGGACTGACCGGGA | 11723 & 11724 |
| PSG7 | AATCAGGGACCTCTACCA | TGGATCAGCAGGGATGCA | 11725 & 11726 |
| PSG8 | ACCCAGGGAGAATAAGGA | GGGTAACTGCGGATGCCA | 11727 & 11728 |
| PSG9 | CCATCCCCTACATCACCA | GGGTTACTGCGGAGGCCA | 11729 & 11730 |
| PSIP1 | AGTGGAGAAGAAGCGAGA | GTGACCTGAAGTGAAGCA | 11731 & 11732 |
| PSMA1 | GCGCAATCAGAGCTTGCA | CAAGACGAGACACAGGCA | 11733 & 11734 |
| PSMA2 | GAGCCCCGTCCGTGGGAA | ACCAGCTGAGCTGTAGGA | 11735 & 11736 |
| PSMA3 | GTGAATGACGGTGCGCAA | GCCGATGGCACAGCCCCA | 11737 & 11738 |
| PSMA4 | AGAGTGACCCTAGTGGAA | GACACAGCTGCAGCGCTA | 11739 & 11740 |
| PSMA6 | GGTACAGAGGGCACGCTA | AACAACCAAGAGGCCTCA | 11741 & 11742 |
| PSMA7 | TGCCAAGTCAGTGCGCGA | TGCCACCTGACTGAACCA | 11743 & 11744 |
| PSMB1 | GAGGCTCAGCAAGTGCCA | AGCGGAACATGCTCCACA | 11745 & 11746 |
| PSMB10 | AGACCGGTTCCAGCCGAA | AGCTCAGTGTCCGCAGCA | 11747 & 11748 |
| PSMB2 | CGTGAGAGGGCAGTGGAA | ACACTGAAGGTTGGCAGA | 11749 & 11750 |
| PSMB3 | TGAAGGAAGGTCGGCAGA | TCACCATGGGGCAGCCGA | 11751 & 11752 |
| PSMB5 | CCGTCGAGCCATCTACCA | GAGACTCGGATCCAGCCA | 11753 & 11754 |
| PSMB7 | AAGCCATCGCAGCTGGCA | TCACACCTGTACCGGCCA | 11755 & 11756 |
| PSMB8 | TAGCCCTGAAGAGGCCTA | GGTGCAGCAGGTCACTGA | 11757 & 11758 |
| PSMB9 | GCAGCATATAAGCCAGGCA | CGATGGTCCACACCGGCA | 11759 & 11760 |
| PSMC2 | TGATGCAGGTGGAAGAGA | ACTCGAATGAAGCACGCA | 11761 & 11762 |
| PSMC3 | GGATGCCATCGGCACCAA | GGTTCAGAAGCTCCAGCA | 11763 & 11764 |
| PSMC3IP | GGAACACGGACTGGGCAA | AGGACTTGAAGGTCAGCA | 11765 & 11766 |
| PSMC4 | ACGCGGACATCGGAGGCA | CCACAGCCAGGTGGGCCA | 11767 & 11768 |
| PSMD1 | TCCTAACCATGCCGGAGA | CTGCCACAGGTTCCACCA | 11769 & 11770 |
| PSMD11 | CATGCTCAACACCCCAGA | GCTAGCCTGAGCCACGCA | 11771 & 11772 |
| PSMD12 | GTCCAAAAGGCGGAGTCA | GTCAGTCGCGCACGCTCA | 11773 & 11774 |
| PSMD13 | ACCTGGGTGCAGCCCCGA | GGGCCTGGTGCTCCACCA | 11775 & 11776 |
| PSMD14 | CCAGGGGCCACCTACAGA | GGAACTCCAGCACGGCCA | 11777 & 11778 |
| PSMD2 | GGCTGCAATGCTGCGCCA | CAGTGAGCAGTCCAGCCA | 11779 & 11780 |
| PSMD3 | AAGGCCCCTCAGCACACA | GAGTGAGCGCTTGAGGGA | 11781 & 11782 |
| PSMD7 | AGATGTCAGCCTGCAGGA | GTGCAGGGCGACCACGGA | 11783 & 11784 |
| PSMD8 | GGCTGCCTGCCAAGGACA | ATGCACCCAGCGATCTCA | 11785 & 11786 |
| PSMD9 | AGGCCCACAAAGAGGCCA | CCGAACTCCACAATCTCA | 11787 & 11788 |
| PSME1 | AGCAGCCAAGCAGCCCCA | CCATGACCATCAGCCGGA | 11789 & 11790 |
| PSME2 | AGGTGCTGGAGAGGGTGA | ATGCACCAAGGCCCGGTA | 11791 & 11792 |
| PSME3 | GCTGAAAAGCAACCAGCA | AATCAGGAGCTGTACCCA | 11793 & 11794 |
| PSMG1 | CCTCAGAATCCACCGGCA | CAATGGACAACACGCCGA | 11795 & 11796 |
| PSORS1C2 | TGAACCGCCTAGAACGGA | TCCACCTCAGGGGCAGGA | 11797 & 11798 |
| PSPH | GACGCAGCCAACAGCTGA | AGCATCAGCAGGAGGACA | 11799 & 11800 |
| PSTK | GGCCAGAGGCCACAGGCA | GCACATGCTGGACTCGGA | 11801 & 11802 |
| PSTPIP1 | CCATCGCAGTGCAGGAGA | CCTCTCCACAGTCCACCA | 11803 & 11804 |
| PTAFR | CCAACACAGTGCCCGACA | CCGTGCACACCATCCACA | 11805 & 11806 |
| PTBP2 | CAACCTGCATTGGACCCA | AGACTCCAGGCATACCCA | 11807 & 11808 |
| PTCD2 | TGGCCAGGTCACCACTGA | GGAAGGTGCGACGGCTGA | 11809 & 11810 |
| PTCD3 | CCGCCCTGAAGGAACGAA | GAGGGCTCCTGGTCACCA | 11811 & 11812 |
| PTCH1 | GGTCCACGACAAAGCCGA | GGAAGACAGCGCACACGA | 11813 & 11814 |
| PTCH2 | GATGGGGCCATCTCCACA | CCAGGATGGACAGCAGCA | 11815 & 11816 |
| PTEN | GGGGAAGTAAGGACCAGAGA | GCAAGTTCCGCCACTGAACA | 11817 & 11818 |
| PTGDR | CTTCTACCGACGGCACA | CGAACTTCCCGAAGCCCA | 11819 & 11820 |
| PTGDR2 | GCCACAGCAACACCAGCA | TGCGGCAGCCCACCACGA | 11821 & 11822 |
| PTGDS | GCTCCTACAGCTACCGGA | GCTGTACAGCAGCGCGTA | 11823 & 11824 |
| PTGER1 | CGTGGAGATGGTGGGCCA | GGCGAAGCAGTTGGCGCA | 11825 & 11826 |
| PTGER2 | AGGAGACGGACCACCTCA | GGAGGCCTAAGGATGGCA | 11827 & 11828 |
| PTGER3 | GGGCCAGTACACCGTCCA | GGTGGCCAGGTTGCAGGA | 11829 & 11830 |
| PTGER4 | CGGCTGAACAGCCCA | GACAGCCAGCCCACA | 11831 & 11832 |
| PTGES | GGAACGACATGGAGACCA | TGTAGGTCACGGAGCGGA | 11833 & 11834 |
| PTGES3 | GGAGAATCTGGCCAGTCA | GAAGTCGACACTAAGCCA | 11835 & 11836 |
| PTGFR | CACAACCTGCCAGACGGA | GGCCAAAAGCAGAAACGA | 11837 & 11838 |
| PTGFRN | GGCAGAAGGAGGCAGAGA | GACAGGACAGGAGCCCGA | 11839 & 11840 |
| PTGIR | GCGCACCGGAGAGGACGA | GCGTAGAAGCGGAAGGCA | 11841 & 11842 |

FIG. 1 Cont.

| | | | |
|---|---|---|---|
| PTGIS | CGACCACTCTCCCACAGA | AGGAGGAGGCGGTCACCA | 11843 & 11844 |
| PTGR1 | GCTGGACAACGCACTCCA | TCCACCCTTCACACCACA | 11845 & 11846 |
| PTGS1 | CGGAGTACTGGAAGCCGA | GATGGTCGCTCCACAGCA | 11847 & 11848 |
| PTGS2 | CCTACTGGAAGCCAAGCA | ATCTAGTCCGGAGCGGGA | 11849 & 11850 |
| PTH1R | CAACAGGACGTGGGCCAA | GGACGCCAGGGACACGGA | 11851 & 11852 |
| PTHLH | GGAGACGTACAAAGAGCA | CCAGAGTCTAACCAGGCA | 11853 & 11854 |
| PTK2 | ATCCAGCCAGCCCCACCA | GAGCTCACCCAGGTCAGA | 11855 & 11856 |
| PTK2B | TACAGACCCCCTCCGCAA | GCTGGTGAGCGTAGGAGA | 11857 & 11858 |
| PTK6 | AGCTCATGGCCAAGGGCA | TAAGCCTGGCTAACCCGA | 11859 & 11860 |
| PTK7 | CCCTCAGCACCAAGCAGA | TGAGGCCCAGGGCAGACA | 11861 & 11862 |
| PTMS | GAGAGCTGCCGAAGAGGA | AGGGATGGGGCAGGACA | 11863 & 11864 |
| PTN | GGAGCTGAGTGCAAGCAA | CCAGGCCTGGAACTGGTA | 11865 & 11866 |
| PTP4A3 | CCAACGCCACGCTCAGCA | GCCAGTCCACAACGGTGA | 11867 & 11868 |
| PTPN1 | GCCAAAGGGGAGCCGTCA | CCGTGAGGACCGTAGCCA | 11869 & 11870 |
| PTPN11 | CAAGAGGAAAGGGCACGA | TTGGAGTACAAGGCGGGA | 11871 & 11872 |
| PTPN12 | AACCACCAAGGACCCGCA | AAGGGGGAGAAGGTGTCA | 11873 & 11874 |
| PTPN14 | GGTCCGTCGCCATACCAA | GCCTCAGCATCATGGGCA | 11875 & 11876 |
| PTPN21 | AGGTGCTGGACATCCCGA | GGCAGAGAGTCTGCACCA | 11877 & 11878 |
| PTPN22 | GGCCTCCAAGTGGTACCA | GAGGATGTTGGCAACAGA | 11879 & 11880 |
| PTPN4 | GCCTGGCCTGACCATGGA | CCAGCACTGCAATGGACA | 11881 & 11882 |
| PTPN6 | TGTGACCAACTGCGGGGA | AAGCTGAGGACACCCCCA | 11883 & 11884 |
| PTPRA | AGTCAGGGAACCACCCCA | GCACCACCTTGTAGCAGA | 11885 & 11886 |
| PTPRB | GTCACAGCGGAGAGCAGA | CCACGTGATGGCCAAGGA | 11887 & 11888 |
| PTPRC | CACCAGCTGGCCAGACCA | GTGCGCCCAACACCAGCA | 11889 & 11890 |
| PTPRCAP | GGATGAGCAGGACACAGA | GCTGGACGCCTCTCCACA | 11891 & 11892 |
| PTPRD | GGAGCATGGAGAGGAGCA | ACCCAGGCCTTGAGGGGA | 11893 & 11894 |
| PTPRE | AGGCCAGGGTCATCCAGA | CCTCCGTCAGCATCACGA | 11895 & 11896 |
| PTPRF | GGAGCTCACCAAGGAGGA | AGCGAGGAGATGGCCACA | 11897 & 11898 |
| PTPRG | GATCCCAAGAGGCCCGAA | GAAGGATGAGGCACACGA | 11899 & 11900 |
| PTPRJ | GCGAATGGCACAGAAGGA | ATGACAGCGCGAGGCTCA | 11901 & 11902 |
| PTPRK | AGAGAGAAGCCGGAGCCA | CCCACAGTGAACGGGGCA | 11903 & 11904 |
| PTPRM | CGATGGGGAGAGCAGCAA | GGACACAACTGGGCAGGA | 11905 & 11906 |
| PTPRN | GCCTACCAAGCAGAGCCA | GGGCATGGTCATAGGGCA | 11907 & 11908 |
| PTPRO | TGCTGACGAGATGCAGGA | TCCCACGCCAGCACTGCA | 11909 & 11910 |
| PTPRR | TCCACTGCAGTGCAGGAA | TCATACAGGCACAGAGCA | 11911 & 11912 |
| PTPRS | GTTCACAGACTGGCCGGA | CCACGCCTTCATACCGCA | 11913 & 11914 |
| PTPRT | CTGCCGACAAACCCACCA | GCTGCAGCAAGTCAGCCA | 11915 & 11916 |
| PTPRU | GTGTCAGCCGCTACACCA | CTGCAATCCCACTGGGCA | 11917 & 11918 |
| PTPRZ1 | GAGGAGTGACGGCAGGAA | TCAGGCAATGCTGCACCA | 11919 & 11920 |
| PTRF | GCGGGACAAGTTGCGCAA | CCACCTGGCCCTCGCGGA | 11921 & 11922 |
| PTRH2 | GAGCAAGACACACACAGA | GCATGAGAGCACTGGGCA | 11923 & 11924 |
| PTTG1 | CCTTGACGAGGAGAGAGA | CCCATGGTGGAGAGGGCA | 11925 & 11926 |
| PTTG1IP | GGCCGACGCCGTACTGGA | AACTCCCCAGCGTGCAGA | 11927 & 11928 |
| PTX3 | GTGAACTGGCGGCTACCA | GCCACCACCCACACAGCA | 11929 & 11930 |
| PTX4 | CAAACGCCTCCACCAGGA | ACTGGCCGTCCAGCAGCA | 11931 & 11932 |
| PURA | CCGTGACGCTCTGGCCAA | GTAGGGCACGGTGATGGA | 11933 & 11934 |
| PUS1 | CACCATCATCGGCACCGA | TGAGAGCGGTGGCACTGA | 11935 & 11936 |
| PVALB | GAGGAGGATGAGCTGGGA | CTCCAGCAGCCATCAGCA | 11937 & 11938 |
| PVR | AGCAACCCAGAGCCCACA | TGGCGAGCTCCTAGGGCA | 11939 & 11940 |
| PVRIG | CCCCACCCACGCTGCACA | CCGGGACCAGTGTGAGGA | 11941 & 11942 |
| PVRL1 | ACTGGTACCTGCAGCGGA | CCTCCACACCCTTGGGGA | 11943 & 11944 |
| PVRL2 | CCTGGTCCCATGGAACCA | CCGCCGTGAGATGAGGGA | 11945 & 11946 |
| PVRL3 | GATTTGCTAGAGGAAGGCGA | CCAACCTGCTCCACACAGA | 11947 & 11948 |
| PVRL4 | CCGCAGCATGAATGGGCA | CTCACAGAGGCCTCAGCA | 11949 & 11950 |
| PWP1 | GGCGATTCAGTGGGCAGA | CAGCTGAAGCAGTCACGA | 11951 & 11952 |
| PWWP2A | CCACGGTGTCGCAACTGA | ATCCATGAGGACCCCGGA | 11953 & 11954 |
| PWWP2B | CTGTCCCCAGGGTCCACA | CGCCGACTCACTGGCACA | 11955 & 11956 |
| PXDN | GTGACGCCTCAGGACAGA | CAGTCAGGTGGGCCACGA | 11957 & 11958 |
| PXDNL | TCCAAGGAAGGCCGAGGA | TCAGGACTGGGACAGGGA | 11959 & 11960 |
| PXMP2 | GAGGGGAAAGACGCCTCA | TGGCGAAGAGCACCCGGA | 11961 & 11962 |
| PXN | CGCCATTCGTGAACGGCA | CTTGAGGCAGAAGGCACA | 11963 & 11964 |
| PYCARD | CCTTGGACCTCACCGACA | CGTACAGAGCATCCAGCA | 11965 & 11966 |
| PYCR1 | AGAACAGCACCCAGGCCA | GCAGCTCCCGTGTGCGGA | 11967 & 11968 |
| PYGB | CCCCAAGGAGTGGACCAA | AGGTCGGAGGGCTCCACA | 11969 & 11970 |
| PYGL | GAAGCTGCTCCCTCGACA | GCCACGCCATTCACAGCA | 11971 & 11972 |
| PYGM | CAAGAGAGTGGACGCGGA | GGAAGGCTCCACACCCCA | 11973 & 11974 |
| PYGO1 | GCAGAATAAGCCACGACA | GCCTCACATAAGATGGCA | 11975 & 11976 |
| PYGO2 | ACCGTGAGTGCACAGGCA | GCAGAGATCGCAGGCCCA | 11977 & 11978 |
| PYY | CTACCCCATCAAACCCGA | GAGGTAGTGGCGCAGGGA | 11979 & 11980 |
| PZP | CAGAGACCCAAGGCACCA | GGGCCGTGAGATAAGCGA | 11981 & 11982 |
| QARS | AAGGAGGAGCCAGAGCCA | CTGCAGGTCACCTCCAGA | 11983 & 11984 |
| QDPR | ATCGACCATCTCCAGCCA | TGGCCATGCCGTACCCGA | 11985 & 11986 |
| QPCT | TCAGCACCCTCAATCCCA | AGGCACGAGCAAGTTCCA | 11987 & 11988 |
| QPRT | ACGAGGAAGACCACGCCA | ACCGCCTTCTCCACGCCA | 11989 & 11990 |
| QRFP | ACGAAGGCAGTGAGGCCA | GACCGAAGCGGAAGCTGA | 11991 & 11992 |
| QRICH2 | GGACAGGCTGCTCACAGA | CCGGTCACATGAGAGGCA | 11993 & 11994 |
| QSOX1 | CGCTAGCCACTTCGAGCA | ACGTCCCACACGGGCACA | 11995 & 11996 |
| RAB14 | GGTTGACAGATGCAAGGA | CTTGGCAGCCTCAAGGAA | 11997 & 11998 |
| RAB17 | GGCCCAAGAGCTACTGCA | TTCAGAGCCACAGCTGCA | 11999 & 12000 |
| RAB1A | ACAGAAAGCTACATCAGCACA | GGAATTCCAAGGGAATCAGCA | 12001 & 12002 |
| RAB22A | AACCCAACAATAGGGGCA | GCTGCAGCCGACCCTCGA | 12003 & 12004 |
| RAB23 | GGATCCAGAACTAACGCA | CCGGAGTGACTTCCACCA | 12005 & 12006 |

FIG. 1 Cont.

| | | | |
|---|---|---|---|
| RAB24 | ACTGCGCAGCCTAGAGGA | TGGAAGTCCACACGTCGA | 12007 & 12008 |
| RAB25 | AGCCCTGGACTCTACCAA | CTGCCCAGAGTGATGGCA | 12009 & 12010 |
| RAB26 | GCTGACCGAGATCCACGA | GCTCATGGGCAGAGTCCA | 12011 & 12012 |
| RAB27A | AGCCATAGCACTCGCAGA | TCCGTAGAGGCATGACCA | 12013 & 12014 |
| RAB2A | CACGAGAACATGGACTCA | GCAGCATGCTGAGGGCCA | 12015 & 12016 |
| RAB31 | GGGTTGGGAAATCAAGCA | GCTGCAGCTGAGCCTCGA | 12017 & 12018 |
| RAB34 | GGAGAAAGACGCCCTCCA | AAGGTCAGTGCTGCCACA | 12019 & 12020 |
| RAB36 | CTGAGGGAGAACGAGGCA | CTTGGCCGACACTGACCA | 12021 & 12022 |
| RAB3GAP1 | GCAGCTATGACTCCACCA | GGGGTGGGAAGTCTGACA | 12023 & 12024 |
| RAB40C | CGTCACCATCAAGAGCCA | CTGGCCAGGGAGTAGGAA | 12025 & 12026 |
| RAB9A | ACGGCAGGTCAGGAGCGA | GTAAGCAGGCAGCAGTCA | 12027 & 12028 |
| RABEP1 | GGTCACTCCAGATGCCAA | CTAGGGGACACATAGGCA | 12029 & 12030 |
| RABGAP1 | CAGTGCTATCACCCGGGA | TGGAGAAGGAGCACAGCA | 12031 & 12032 |
| RABGAP1L | ACCGGACCTGCATAGCCA | ACACCATGCAGAGTGGGA | 12033 & 12034 |
| RABIF | CAGCAATCCTGACGGCGA | GCCAGCCAATTGGTCCAA | 12035 & 12036 |
| RAC1 | AGAAGAAGCTGACTCCCA | TGAGCGCCGAGCACTCCA | 12037 & 12038 |
| RAC2 | GGTGGGCACCAAGCTGGA | GGTAGGTGATGGGAGCCA | 12039 & 12040 |
| RACGAP1 | CAGGCCAACAGGGACACA | TGGGCACAGCATGGGCCA | 12041 & 12042 |
| RAD1 | CACAGGAACCTGAGGAGA | GGAGCCCCTCTGACTGCA | 12043 & 12044 |
| RAD17 | GTGAACCCACTCAAGCCA | GCAGGCAGTTCACTGGCA | 12045 & 12046 |
| RAD21 | GGGCGATCAAGATCAGGA | TTAGCAAGAGCACGCTGA | 12047 & 12048 |
| RAD23A | CCCTGGGCTTCCCAGAGA | GGAGGAAGTTGGCAGCCA | 12049 & 12050 |
| RAD23B | CCCTGACAGAGCAGTGGA | GAAGACTGAGGAGCCCCA | 12051 & 12052 |
| RAD50 | CAGGGACAGACTTGCCAA | CTGTGGCTCCAGCCAGCA | 12053 & 12054 |
| RAD51 | GAACTGGGAAGACCCAGA | GACCATACCTCTCAGCCA | 12055 & 12056 |
| RAD51AP1 | AGAAGTAGCAGCAGCCCA | TGGACAAGCCAAGGCGGA | 12057 & 12058 |
| RAD52 | CTCCTGTGACGCACAGCA | TAGACGAGGGCTTGACCA | 12059 & 12060 |
| RAD54B | GACCAGGAGCACTACAGA | GGCAGGGGTGATTGCACA | 12061 & 12062 |
| RAD54L | AGCTGTGCCGTGCCCGAA | ACCAGCCGGTTAGCCCCA | 12063 & 12064 |
| RAD54L2 | GCGATCAGAGCCTGACCA | ATGGGGGTGGACTGCACA | 12065 & 12066 |
| RAD9A | CAGGCCGTCTTCGACCCA | CGTGGTAGCTGCGCAGGA | 12067 & 12068 |
| RADIL | GCAGAGCATGGAGGAGCA | GCTGGAAGGCGTACAGCA | 12069 & 12070 |
| RAE1 | GATACAGATCGCACAGCA | CAGTTGCCACCACAGCCA | 12071 & 12072 |
| RAET1E | CTGGCAGTTCGCCACCAA | CCTGAGCCAGTGATCGCA | 12073 & 12074 |
| RAET1G | CCACCCTCAGTCCCTGCA | AGTCACGTGTCCACCAGA | 12075 & 12076 |
| RAET1L | TCCTCAGGCACAACCCAA | GGAGGATGAAGCAGGGGA | 12077 & 12078 |
| RAF1 | CAAAGAGAGCGGGCACCA | ACCCAATCCGAGTGGACA | 12079 & 12080 |
| RAG1 | TTCCGAGGAGAGGCACGA | ACTGTACTGGCAGAGGGA | 12081 & 12082 |
| RAG2 | CAGTCTTGCCAGGAGGAA | TCAAGCTGATAGCCACCA | 12083 & 12084 |
| RAI1 | GAGACGCGTTCACCACCA | CGGCTGCATCCAAGGAGA | 12085 & 12086 |
| RAI14 | CAGAACCAGCTGGCGGAA | CCCTGCACAGCATACAGA | 12087 & 12088 |
| RALB | ACTGCCGAATTCAGGGAA | CCCACGACGAGCAGTGGA | 12089 & 12090 |
| RALBP1 | CGAGAGCGAGAGTGAGGA | GCATCTGGAGCAGCCGCA | 12091 & 12092 |
| RALGDS | CTCACAGTCATCCCCGGA | GCAGAGCCCTGAGACAGA | 12093 & 12094 |
| RALGPS2 | ACCCATCAACTGGCAGCA | ACATGAGGCAACATGGGA | 12095 & 12096 |
| RAMP1 | ACTTCAGGAGCTGCCCCA | GGGTCACCGTGATGGGGA | 12097 & 12098 |
| RAMP2 | TGAGACTCACCAGATCCA | TGAGGCAGATGGGGGCTA | 12099 & 12100 |
| RAMP3 | CACCGGCATCCACAGGCA | CCAGGCCAGCCATGGCGA | 12101 & 12102 |
| RAN | CCCCACCAGAAGTTGTCA | TCCTCATCCGGGAGAGCA | 12103 & 12104 |
| RANBP1 | AATGGAAGGAGCGAGGCA | TCCGCATGAGGAGGCGGA | 12105 & 12106 |
| RANBP10 | GACCCCATCCAGAGGGAA | GGCCATGAGCCGGAGACA | 12107 & 12108 |
| RANBP17 | CAGATGTCCTGCAGCAGA | TGAGCAGGATGAGCCCCA | 12109 & 12110 |
| RANBP6 | GCCATGGCCAGACAGACA | GCCATGACACCCAGGCCA | 12111 & 12112 |
| RANBP9 | CGGAGATCGAGAAGGAGA | GCTGTGGCACAGTACCCA | 12113 & 12114 |
| RAP1GAP | GAAGCGGCACATCGGGAA | CCTCAGCCTGCACCACGA | 12115 & 12116 |
| RAP1GDS1 | GAGTGGTGGCATCAAGCA | GAGCACATATCAGGACCA | 12117 & 12118 |
| RAP2B | GGTGGGCAACAAGGTGGA | CGTCTCCATGAAGGGGCA | 12119 & 12120 |
| RAPGEF3 | GATCCCACACCCTGACCA | GTGGTGACATCCCGCAGA | 12121 & 12122 |
| RAPGEF6 | CATGGCCCTGGGTGGACA | GGAGCTGCTTGAACACGA | 12123 & 12124 |
| RAPGEFL1 | CCCCCAATCACCTGCAGA | AGGAGAGCTCGAAGAGGA | 12125 & 12126 |
| RAPH1 | GGCCACAGTTGTGCCACA | GAGAGTGAGCCGTGCCGA | 12127 & 12128 |
| RARA | GACCCTGAACCGGACCCA | GTCTCCGCAGATGAGGCA | 12129 & 12130 |
| RARB | CGCCAGGACCTTGAGGAA | GCACTGATGCTACGGAGA | 12131 & 12132 |
| RARG | AGGGAGCTGAAAGGGCCA | GAGGCATTGGGGTGGGGA | 12133 & 12134 |
| RARRES1 | CCCTGGGCAGCCTCAGGA | TGGGCGAGCCGGACCGGA | 12135 & 12136 |
| RARRES2 | GGAGCACCAGGAGACCCA | GGGGCAGGGCCTTGGAGA | 12137 & 12138 |
| RARRES3 | GGACCATGAGTACCAACCA | GAGCATCCAGCAACAACCA | 12139 & 12140 |
| RARS | GGAAACTAGGCCGGTGCA | AACCCCTTGGCCATGACA | 12141 & 12142 |
| RASA1 | AGGGAAGGGCAAAACCCA | GGCTCAACTGGCAGCGCA | 12143 & 12144 |
| RASA2 | CCACAAACAGCCAGGCAA | ATCGGCTCACCCTGCAGA | 12145 & 12146 |
| RASA3 | CGCTGTACATCCAGGCCA | ACGGGTGGTAGACGGTGA | 12147 & 12148 |
| RASAL2 | GCTCAGTGGACCCAGCAA | GCTCGGGCACCTAACCCA | 12149 & 12150 |
| RASEF | TGCTGCTACAGAGGGACA | TCTCGAGCAAGGTGCAGA | 12151 & 12152 |
| RASGEF1A | GGCCCATCCTCAAGACCA | GCTCAGGCAGTTGAACCA | 12153 & 12154 |
| RASGRF2 | AGAGTCTGCACCAGCGGA | CGATAGCGGAGGTGCCGA | 12155 & 12156 |
| RASGRP1 | CCCACAAGGCCACCCAGA | GGACATGGAGAGGTGGGA | 12157 & 12158 |
| RASGRP2 | CCTCGACCAGAACCAGGA | CACTCAACTGACAGGCGA | 12159 & 12160 |
| RASGRP3 | GAGGGCCACCACCAGCCA | ACAACATCCACACCAGCA | 12161 & 12162 |
| RASSF2 | CTGTCACCAACGTCCGCA | TCGGGCAATCAGCGGGTA | 12163 & 12164 |
| RASSF4 | ACCGTGAGGAAGAAGGGA | TCCATGAGGTGGAGGGGA | 12165 & 12166 |
| RASSF8 | AGTCACAACTTGCCAGGA | TCAGGAATTCGAGCCACA | 12167 & 12168 |
| RB1 | CAGCCTTCCAGACCCAGA | AGACAGAAGGCGTTCACA | 12169 & 12170 |

FIG. 1 Cont.

| | | | |
|---|---|---|---|
| RBBP4 | CCCAAATCTCAGTGGGCA | TCATCAGCAACTGACCCA | 12171 & 12172 |
| RBBP7 | TGACAGTGACAAGGGTGA | TGCGGCATGTAACGAGCA | 12173 & 12174 |
| RBBP8 | GAGCCCTGTTCACAGGAA | GGCTCATGAGAACCAGCA | 12175 & 12176 |
| RBBP9 | GGTGAAAAAGGAGCTGGA | CTCCATGAAGGGCAGCCA | 12177 & 12178 |
| RBCK1 | TGGGTCACCAAGGGCCCA | CAGCTTGGGTGGCAAGGA | 12179 & 12180 |
| RBFOX1 | CACTTGCTCCAGCCCCCA | AGACCCACATCATCAGCA | 12181 & 12182 |
| RBL1 | CAACAGCCAGGCTCACCA | GGTGTAAGGCCTGACCCA | 12183 & 12184 |
| RBL2 | CGCCACTGTCACAGCCAA | TGGCCACTTGACCAGGGA | 12185 & 12186 |
| RBM10 | AATCAGCCGAGGCGAGCA | CTGGTAGCCGGTGGGAGA | 12187 & 12188 |
| RBM14 | AATGCCCAGTCTGCCCCA | TGGCTGGCATAGGCAGCA | 12189 & 12190 |
| RBM15 | GACCAGCCTAGGAAGCGA | GTCAGGAGAAGGAGCGCA | 12191 & 12192 |
| RBM19 | TTCAGCCAGGCTGCAGCA | GTGCTGGAGAAGACGCCA | 12193 & 12194 |
| RBM27 | CCGCAAACCAAGGGCCAA | CGCCATGAGCGAGACTCA | 12195 & 12196 |
| RBM3 | CAAGGACCGGGAGACTCA | CTGCATGATCCACACGGA | 12197 & 12198 |
| RBM38 | ACCGGCCACCTATGACCA | GCGCCTGGTACTGCACGA | 12199 & 12200 |
| RBM4 | TCAGGAGCTGCTGCCACA | CCTCTCCAACAGTGGGGA | 12201 & 12202 |
| RBM47 | ACAGCCACGATCGCCACA | GGGACCTGAATGGCAGCA | 12203 & 12204 |
| RBM5 | GCCCAAGCGCAAGAAGCA | GCCTCAATGGGAGCCGTA | 12205 & 12206 |
| RBMX2 | GCGGAGCTCAGATGCACA | CGCCAACGGTCACTGGGA | 12207 & 12208 |
| RBP1 | CCCCGAAATGCCAGTCGA | GGTCACCGTCCTGCACGA | 12209 & 12210 |
| RBP3 | GCAGATGCTCTCCGGAGA | TGGAGACCTGGGTGAGCA | 12211 & 12212 |
| RBP4 | GATGAGCGCCACAGCCAA | CAGGAGTACTGCACGGCA | 12213 & 12214 |
| RBPJ | GCGGTGGGGACGTAGCAA | GACTGGTTGCCGGACCCA | 12215 & 12216 |
| RBPMS | GCCCAACACTGTACCTCA | GCATGCAGTGAAGCGGGA | 12217 & 12218 |
| RBX1 | CCATCTGCAGGAACCACA | AGCGAGAGATGCAGTGGA | 12219 & 12220 |
| RCAN1 | AGCAGATGCCAGGCTCCA | CCATCCCACTGGCGGAGA | 12221 & 12222 |
| RCAN2 | GCACGTGTGCGACAGTGA | GGCAGGCCAGGACGCCGA | 12223 & 12224 |
| RCAN3 | GCGAATAGAACTCCACGA | GTCCCGCACTTCGCCGGA | 12225 & 12226 |
| RCE1 | CCTTGGAGCACCCACAGA | GTGAGGGGCTGGAGCAGA | 12227 & 12228 |
| RCHY1 | TGCGAGCACTATGACAGA | ATCATGACACAAGCGGCA | 12229 & 12230 |
| RCL1 | GACCCTTGGACAGCAGGA | CAACACAGGTCATCAGCA | 12231 & 12232 |
| RCN3 | GATGGCCACTCGAGAGGA | GATCCCGGAAGTCCCGGA | 12233 & 12234 |
| RCOR1 | ACTCCTGGGAGGAAGGCA | CGGGGTCGAAGTCGGGCA | 12235 & 12236 |
| RDBP | GAGACAGAGAGCGGGACA | GAGAGAAGGCCCCACGGA | 12237 & 12238 |
| RDH11 | CACCCTGGCACAGTCCAA | TACGAGCTTGGGCAGAGA | 12239 & 12240 |
| RDH12 | ACCTACGCAGTGCACCCA | GCTCCAGGCCCTCAGCCA | 12241 & 12242 |
| RDH13 | ATACCTGGCCGTGGCGGA | GCGGGCACTTTCAGCCCA | 12243 & 12244 |
| RDH16 | AGCTGGCTGGGATGCCAA | CGGGCTTGGAGAGACCCA | 12245 & 12246 |
| RDH5 | CCCAGGTTGGGATGCCAA | AGGCTTGGGAAGGACCCA | 12247 & 12248 |
| RDH8 | ATCAGCTCGACTCGACCA | CGCACATACAGGCTGCCA | 12249 & 12250 |
| RDX | GAATTTGCCATTCAGCCCA | GCAGTTTCTGGCGGGCA | 12251 & 12252 |
| REC8 | CAGCCTCATCCCACCAGA | CCATGGGCACCTCAGGGA | 12253 & 12254 |
| REEP1 | CCTACACAAAAGGCTCCA | CCGAAGTGCACAAGGGCA | 12255 & 12256 |
| REEP5 | CATGAGGGAGAGGTTCGA | GAGAGGCTCCATAACCGA | 12257 & 12258 |
| REEP6 | CAAGCAAGGACGACGACA | TGCCTTAGGAACAGCGGA | 12259 & 12260 |
| REG1A | GCCGCTGGCACTGGAGCA | TGAGGTCAGGCTCACACA | 12261 & 12262 |
| REG1B | CTGCCCAGAAGGCACCAA | CCCACTACTCCAGTGCCA | 12263 & 12264 |
| REG3A | AACTGCCCTCTGCACGGA | CACTGAGCACAGACACCA | 12265 & 12266 |
| REG3G | AACTGCCCTCTCCACGGA | GCCGCTTCTGGCAAGCCA | 12267 & 12268 |
| REG4 | GGCAGCAGTGGCAGTGGA | GGAGCTCATCTCAGCACA | 12269 & 12270 |
| REL | GACGGCTACTATGAAGCA | GGGTTCGAGACAACAGGA | 12271 & 12272 |
| RELA | ACCTGGCATCCGTCGACA | CAGGGTACTCCATCAGCA | 12273 & 12274 |
| RELB | CCTACGAGGACCTGGAGA | ATGGTCGCGAGGCAGGTA | 12275 & 12276 |
| RELN | GCCTGACAGCAGAGAGGA | GCAGCTGGAAGCTCCAGA | 12277 & 12278 |
| RELT | CCCGACCAGGGTTCCCAA | GTCAGGGAGATCACCCCA | 12279 & 12280 |
| REN | CCGAGTGGAGCCAACCCA | CTGGAGGAATCCGAAGCA | 12281 & 12282 |
| RENBP | TGGCTACCTGAGCCGAGA | CTCGCACATGGCTAGGCA | 12283 & 12284 |
| REPIN1 | GACGCTTCTGGCGACGAA | AGCTGGTCCCACTGGGCA | 12285 & 12286 |
| REPS1 | TCATCCCAGCGGTGGGAA | GACCACACTGCATCACCA | 12287 & 12288 |
| REPS2 | CTGAGTCACTGCCGGCAA | GGACAGGAAGGTCAGCCA | 12289 & 12290 |
| RER1 | TGGCTAGACAAGTCCACA | TGGTAGATCCCCAAGGCA | 12291 & 12292 |
| RERE | GTATCCACGCAGAGCGCA | GGTAGGGGAAGCGAGCCA | 12293 & 12294 |
| REST | GCAGGTGGTCCAGAAGGA | CCTTCTGAACCACCCCCA | 12295 & 12296 |
| RETN | GCCAGAGCGTCACCTCCA | GTGGTCTCGGCGCGCACA | 12297 & 12298 |
| RETNLB | GTCAAAAGCCAAGGCAGA | AGGTGGCAGCAGCGGGCA | 12299 & 12300 |
| RETSAT | GCCAGGTGTGAAGCAGCA | TGGTGCCTCGCAGGCAGA | 12301 & 12302 |
| REV3L | CAAGCACCAACCACGGGA | GGATCACTTGCAGAGGCA | 12303 & 12304 |
| RFC1 | GCAGAGCAGCAGACAGCA | CGAGTGCTTCCCCAGCCA | 12305 & 12306 |
| RFC2 | GGCGCTGAACAACCTGCA | TGAGTAGCCCAGATGCCA | 12307 & 12308 |
| RFC3 | CACCAAAGATGCTCAGCA | CAATGCTGGGAGCAGGCA | 12309 & 12310 |
| RFC4 | GAGTCGAAAACCACCCGA | ACAGAGGCTTGAAGCGGA | 12311 & 12312 |
| RFC5 | GAAGGGGTTGGCACTGCA | CAGCAATGAGGGAGCTCA | 12313 & 12314 |
| RFNG | CTGCCGGATGACTGCACA | GGGTTCTCAGGACCCCCA | 12315 & 12316 |
| RFTN1 | CCATCAGAAGTGCCGGCA | AGACTGCGTTCACCAGCA | 12317 & 12318 |
| RFWD2 | AGCGGCAGCAGGAAGCGA | AGCAGATGGGGCATACGA | 12319 & 12320 |
| RFX2 | CAAGCTGACCCTGCAGCA | TCAGGTCCCGGATCACCA | 12321 & 12322 |
| RFX5 | AGTGGGCAGGCTCCACCA | CCTTGAGGACTGGGCAGA | 12323 & 12324 |
| RFXANK | TGGAGCGTGACGTGGACA | CATCGGGGTGTAGCCAGA | 12325 & 12326 |
| RGL1 | CCAAGCCTCGGAAGAGCA | CGCAGGATGACACGCTGA | 12327 & 12328 |
| RGL4 | GGACGACCTGGATGGCAA | GCTCCAGCTGGCAGGACA | 12329 & 12330 |
| RGMA | CGTGGAGATCCAGGCCAA | TCCCAGTCCTCCACAGCA | 12331 & 12332 |
| RGMB | GGCCATGTCCTACGAGGA | CAGTGTGTAGCCAGGCCA | 12333 & 12334 |

FIG. 1 Cont.

| | | | |
|---|---|---|---|
| RGN | ACCTGCAGACAGGACAGA | ACCCAGAGCTTCCCCTCA | 12335 & 12336 |
| RGS1 | GACTTCCGCACTCGAGAA | CCCTTCAGCCAGGGACCA | 12337 & 12338 |
| RGS11 | ATGACGCCCAGCTGCACA | TCCCAGCCTCTGCCAGGA | 12339 & 12340 |
| RGS12 | CCGAGAAGGACAAGGCCA | GCTCACAGAGTCCGGACA | 12341 & 12342 |
| RGS16 | CGAGGATGAACCTGCAGA | GCGGCTGAGGCTTGGGCA | 12343 & 12344 |
| RGS3 | ACCCCCTCTACCTCCAGA | GTTCTCCGACAGGCACCA | 12345 & 12346 |
| RGS4 | GGGAAGAGACAAGCCGGA | AGCTGGACGGGTTGACCA | 12347 & 12348 |
| RHAG | GCCACCCTTGCTGGAGGA | TGCCTGCAAGGCCTCCCA | 12349 & 12350 |
| RHBDD3 | CCAGCTTCTCCCCAGGGA | TGGCCCGTCAAGAAGCGA | 12351 & 12352 |
| RHBDF2 | TCACAGGCAACCTCGCCA | AGCCGAAGATGTGGGCGA | 12353 & 12354 |
| RHCE | AAGTCGGCCAAGATCTGA | ACCTTCCCCAAGACAGCA | 12355 & 12356 |
| RHCG | ACATCCCTGAGGACCCCA | AGGGTACCGAGGAAGCCA | 12357 & 12358 |
| RHD | TCAGCGTGGTGACAGCCA | CCGACGGAGATCAGCCCA | 12359 & 12360 |
| RHEBL1 | CATCTGGTGGACACAGCA | AGCTATGCAGAGAGGTGA | 12361 & 12362 |
| RHO | GCCACCACACAGAAGGCA | GGCAAAGAACGCTGGGA | 12363 & 12364 |
| RHOA | GACACAGCTGGGCAGGAA | GATGGGCACGTTGGGACA | 12365 & 12366 |
| RHOB | GCCCGCATGAAGCAGGAA | GGCAGAGCACTCGAGGTA | 12367 & 12368 |
| RHOBTB3 | CGACAGTGCCAGCCCACA | GGAGACACATGGCCTGGA | 12369 & 12370 |
| RHOC | GGCCAAGATGAAGCAGGA | TGCGGACCTGGAGGCCA | 12371 & 12372 |
| RHOD | ACCACAGGGGCCAGGAGA | CCTGGAAGACGGCGTGGA | 12373 & 12374 |
| RHOF | GCCTGCGAACAGATCCGA | TCAGAGCGCTGAGAGCCA | 12375 & 12376 |
| RHOG | ACTGGCCAAGCAGATCCA | GGTTGAGCACAGCCCGGA | 12377 & 12378 |
| RHOH | AGCCCACAGTGTACGAGA | GCACAGGGGTACAGGGCA | 12379 & 12380 |
| RHOQ | GCAAGACGTGCCTACTCA | GGTCGAAGACGGTGGGCA | 12381 & 12382 |
| RHOT1 | GCCCAGAGGAGAAGGAGA | CGTCGAAGCACAGTCCAA | 12383 & 12384 |
| RHOT2 | TCACCCAGCTCGCCACCA | AGCTGAGGACTGCGGCCA | 12385 & 12386 |
| RHPN2 | CTGACACCCTTGGCCACA | CCTGTGCGGCACACAGCA | 12387 & 12388 |
| RIBC2 | TCAACAAGAGCCAGGCCA | GCGGGTTCTCGGAGAGCA | 12389 & 12390 |
| RICTOR | CAGGGAGGTTCCAAGACA | GGCCTGGATCTGGCACGA | 12391 & 12392 |
| RIMBP2 | CGACGATTACGGGCGAGA | GGGAGCTCTTCGGCACCA | 12393 & 12394 |
| RIMS1 | TCACGCCTCAGCAGCACA | GCTCCAACTGTACCCACA | 12395 & 12396 |
| RIMS2 | TCGACAGGCAAGCCGAGA | CGTCCCACTAGCTGAGCA | 12397 & 12398 |
| RIN2 | CTGACAGCAAACCCCCGA | TGACGCAGGGAGGCAGGA | 12399 & 12400 |
| RIOK3 | GGCCTGGGGACCCAGCAA | CAGCATAAGGTCACTGGA | 12401 & 12402 |
| RIPK1 | CCCAGTGCCTGAGACCAA | GATGAACTCGTCCCACCA | 12403 & 12404 |
| RIPK2 | AGAAGCCTGCCTTAACCA | GGTAAGGCTGAAGACCCA | 12405 & 12406 |
| RIPPLY1 | GACCTAGCACAAGCCCCA | AGACAGCCAGGGCCTCCA | 12407 & 12408 |
| RIT1 | AGTCCGACGTACTGACGA | GTAGCGGTATGCAGCAGA | 12409 & 12410 |
| RIT2 | CGGGAGCAGTACATGCGA | TGTTACCCACCAGCACCA | 12411 & 12412 |
| RLN3 | CCTGACCAAGTCACCCCA | ACATCTCGGCTGCCCCGA | 12413 & 12414 |
| RNASE1 | GCCCGAAGGAGAGACACA | GAGTCCTCCACAGAAGCA | 12415 & 12416 |
| RNASE10 | TAGGCTTGACCAGACAGA | CCCTTGAGCTCACAGGCA | 12417 & 12418 |
| RNASE11 | CAATTCCCCAGGTGCCAA | GAGAATGACCTGTCAGCA | 12419 & 12420 |
| RNASE12 | TCAGGGAACCTGACCACA | GTACCTGCAGGCAGGGTA | 12421 & 12422 |
| RNASE2 | ATGCGCAGACACCAGCAA | CCAGGTGAACTGGAACCA | 12423 & 12424 |
| RNASE3 | CCATTGCAATGCGGGCAA | ACCCGGAATCTACTCCGA | 12425 & 12426 |
| RNASE4 | AGGGCACCCAACTGCAGA | GGGTTACCCTCACAGGCA | 12427 & 12428 |
| RNASE6 | AACTGCCACCAGAGCTCA | CTATAGCGGCACTGGGGA | 12429 & 12430 |
| RNASE7 | GCTCACCTCAGGGAAGCA | GGGGAGGCTTACAGGCCA | 12431 & 12432 |
| RNASE8 | CCAGCCCTCAAGCATGCA | GGTGATGGCCACACTGGA | 12433 & 12434 |
| RNASEH1 | GACAAACCAAAGAGCGGA | AGCCTCTCCAGTGCCACA | 12435 & 12436 |
| RNASEH2A | TGGCTCAGGCTACCCCAA | TGCGCCAGCTGAACCGGA | 12437 & 12438 |
| RNASEL | CCACGTGCACAGCGGGAA | CTCACAGAGGGTGACACA | 12439 & 12440 |
| RNASET2 | CAGCACTGGCCTGAGACA | CAGGCCAGTATGCCCTCA | 12441 & 12442 |
| RND3 | AGGACTGCTTCCCCGAGA | ATCAGCACAGCATCCGAA | 12443 & 12444 |
| RNF103 | CATGTGAAAGGAAGGGGA | ATAAGAAGGCCACCGGCA | 12445 & 12446 |
| RNF11 | GACTCGGCTAGCAACTCA | GGCACGTGAAGGATCTCA | 12447 & 12448 |
| RNF123 | GGGCACTGACATCCGAGA | CCAGGAGGTTCCTCACCA | 12449 & 12450 |
| RNF128 | AGCAGGAAGCAGAGGCAA | CAGCCATGGGTCAACACA | 12451 & 12452 |
| RNF130 | AAGATCAGCCCTCGGCGA | AGGGCACTGAGGAGGCCA | 12453 & 12454 |
| RNF144B | ACTTGGCCACTCAAGAGCA | CCGACAGGACTTGCAGACA | 12455 & 12456 |
| RNF146 | GAAGAACTCAAGGCAGCA | TCGTACTGCCACCACCCA | 12457 & 12458 |
| RNF148 | GGGGAGAATGCACATGCA | AGGCAATTGTGGCAGCCA | 12459 & 12460 |
| RNF150 | CACCATCGGAACCCGGAA | GACGAGCCATGCGAGGGA | 12461 & 12462 |
| RNF167 | ACCCTGCCTCAGAAAGGA | GGGAGCTGGGGCTAAGGA | 12463 & 12464 |
| RNF19A | TGGAGTCTCAGCAGGCAA | CTGCCAGTCAGCCCACCA | 12465 & 12466 |
| RNF19B | TGGAAGCAGCACGGAGGA | TCACTGCCTCCGCCACCA | 12467 & 12468 |
| RNF2 | ATCAGGAAGCAGGCCCTA | AACAGTGGCGTTACCAGA | 12469 & 12470 |
| RNF207 | CAGGCTGGCAGAGAGGAA | GGCCAAGCTGAGGAAGGA | 12471 & 12472 |
| RNF213 | GCCATCTGCAGCAGCACA | GTCCTGCAGAATCCACCA | 12473 & 12474 |
| RNF219 | AGCAGCCTGGCTCATCCA | CAGAACTGGTGTCACACA | 12475 & 12476 |
| RNF220 | GAAGGCTCGGGTCAGAGA | AGCACTCCTCGCAGTGCA | 12477 & 12478 |
| RNF31 | CAGTCTACGCACTCCCCA | CACACTCCTGGGCAAGCA | 12479 & 12480 |
| RNF34 | GCAGGATGAGGAAGACGA | CACCACATACTGCCGGCA | 12481 & 12482 |
| RNF4 | CCCAGGACCATGCTGACA | AGGCCTGTAGCGCCCTCA | 12483 & 12484 |
| RNF43 | AGAAACCGGAGTCCCCCA | GAGGCGTCAACTGGGCCA | 12485 & 12486 |
| RNFT1 | ACTCCCACAGTGAAGCAA | GCGGAATTCTGAGAAGGA | 12487 & 12488 |
| RNH1 | TCCTCAGGGCCAAGGAGA | GCTGAAGTGGGAGCAGCA | 12489 & 12490 |
| RNLS | CCAAAGGCAGCAACTGGA | GGAGACGAAGCGTATGCA | 12491 & 12492 |
| RNMT | GGAAAGACACTCCATCCA | GCCTTCAGCATCACCACA | 12493 & 12494 |
| RNMTL1 | CGACTCGGACTGGACAGA | GGCTGTCCACACCAGGCA | 12495 & 12496 |
| RNPEP | AGACCCTCGCCAAGGAGA | GCCACGATCTGCTGGACA | 12497 & 12498 |

FIG. 1 Cont.

| | | | |
|---|---|---|---|
| RNPS1 | GCTCAGGAAGCTCCAGCA | TGTCTGCGCCGAGAAGGA | 12499 & 12500 |
| ROBO1 | GGATACGGATGCGCCAGA | CATGGACCCCGTGACAGA | 12501 & 12502 |
| ROBO2 | CCAGGTGGTACTGGAGGA | GACGGTGAGTGTAGCAGA | 12503 & 12504 |
| ROBO4 | GGAGCTGCAGCATGCCAA | GCTGGAGGGAGATGACGA | 12505 & 12506 |
| ROCK1 | GAAGTGAGGTTAGGGCGA | GAGCGTTTCCCAAGCCCA | 12507 & 12508 |
| ROPN1 | GGTGAGAGAGCGGTCTGA | TCCGTGAAGCGACCCACA | 12509 & 12510 |
| ROR1 | GAAGACTGCCCACCCAGA | TGGGCTGGCACTGAGGGA | 12511 & 12512 |
| RORA | CGGGAGGTGATGTGGCAA | AGGCACGGCACATTCTGA | 12513 & 12514 |
| RORB | GATACCAACCATCACGGCA | CCGGTGGCACAGTCAGGA | 12515 & 12516 |
| RORC | GAGCCTGTGTAGCCAGCA | AAGCGGCTTGGACCACGA | 12517 & 12518 |
| ROS1 | CCTCTAGGCTCCCAGGAA | AGGCTTGCCAGAAGGGCA | 12519 & 12520 |
| RP1 | ACCCAGAGCTTCGAGGCA | CGCCACCACAGCTCCAGA | 12521 & 12522 |
| RPA1 | AAGAGCTATGAAGACGCCA | CACAGTGTAGCAGTCACCA | 12523 & 12524 |
| RPA2 | GAGCCCGAGCCCAGCACA | CCCACTGGCGAACGTCCA | 12525 & 12526 |
| RPA3 | TAACCGCCAAGGCCACCA | ACTGAGGGAAGTCATGGA | 12527 & 12528 |
| RPE | CACCATGGGCTAATCAGA | ATAGCACTGCCAGACACA | 12529 & 12530 |
| RPGR | CAGCCATCAGCAAGCCAA | CGGAATTGTCACCCCACA | 12531 & 12532 |
| RPGRIP1 | GACCCACAGGAGCAGCAA | ACTCCAGGATCTGCCACA | 12533 & 12534 |
| RPL10 | GGCCCTGCGCAGGGCCAA | GAACTTGGTGAAGCCCCA | 12535 & 12536 |
| RPL10L | AGAACGAGGAGCATGTGA | AAGGGGCCATGACTGGGA | 12537 & 12538 |
| RPL14 | AAGTGAGGAGACAGGCCA | GGTGGGCACTGTGCGGAA | 12539 & 12540 |
| RPL18 | CCGAGAGGTGTACCGGCA | GCCCTTGGAGCGGACGTA | 12541 & 12542 |
| RPL19 | GCCCGAATGCCAGAGA | GCCTGGTCAGCCAGGA | 12543 & 12544 |
| RPL3 | GCTACAAAGGGGTCACCA | CAGCGCGTGCCACAGAGA | 12545 & 12546 |
| RPL34 | GGTGTGTGCCCAGGCAGA | GCACACATGGAACCACCA | 12547 & 12548 |
| RPL36 | TGAGCAAGCCCAGGCACA | CCCGAATCATGTCCCGCA | 12549 & 12550 |
| RPL39L | CCAAAAGGAGGCATTGGAGA | CCACCCTACTAGCACAGAGCA | 12551 & 12552 |
| RPL3L | CTATCACCACCGCACGGA | ACCCAGCGGTGTGATGGA | 12553 & 12554 |
| RPL5 | CTATGAAGGCCAAGTGGA | TGGCAAGGCCTGCATCCA | 12555 & 12556 |
| RPL6 | AAGCCCAGACACCAGGAA | AGGTAGCCCTGGAGCTGA | 12557 & 12558 |
| RPL9 | GTGGGGTAACAGAAAGGA | AAGCAACACCTGGTCTCA | 12559 & 12560 |
| RPLP2 | GGGGCAACTCCTCCCCCA | CCAGCAGGTACACTGGCA | 12561 & 12562 |
| RPN1 | CAGCCGCAGAAGCCAGGA | GGTGGAGATGTCCCGGGA | 12563 & 12564 |
| RPN2 | CCAGAAGACTGGCCAGGA | GTGTAGGTGCCAGAGGCA | 12565 & 12566 |
| RPS10 | CGAGGCTACGTGAAGGAA | CAGGTCGCTCACCCTCCA | 12567 & 12568 |
| RPS12 | GCACGTGGAATTCGCGAA | CACAGTTGGATGCAAGCA | 12569 & 12570 |
| RPS14 | GGCCCAGAGGTGCAAGGA | AAGGGCTCTGAGGGCCGA | 12571 & 12572 |
| RPS19 | GAAGCTGAAAGTCCCCGA | CCCCAGCGCCACCCCGGA | 12573 & 12574 |
| RPS2 | CCGACCTCTGGAAGGAGA | CTGAGTCCGCTGCACGGA | 12575 & 12576 |
| RPS3 | TGCCATTGCCCAGGCAGA | ATCATCAGGCCATCCACA | 12577 & 12578 |
| RPS5 | CCTGCGCCGTGTGAACCA | GAGCTCATCTGCCAGGCA | 12579 & 12580 |
| RPS6 | AGCTAGCAGAATCCGCAA | GGAGTAACAAGACGCTGA | 12581 & 12582 |
| RPS6KA1 | GGACCTGAAGCCCAGCAA | AGCCCTGGCGCTTCAGCA | 12583 & 12584 |
| RPS6KA2 | CCGTGGGTGGTCAACAGA | ATGACAGCACGGGCTCCA | 12585 & 12586 |
| RPS6KA3 | ACAGACAGGATGCACCACA | TCCGCTGAGCAAGAGTAGA | 12587 & 12588 |
| RPS6KA5 | CACATTAGGCAGTCGCCA | GGAGATGTTCGAGGGCAA | 12589 & 12590 |
| RPS6KB1 | CTGACTGGAGCACCCCCA | GTGTGAGGTAGGGAGGCA | 12591 & 12592 |
| RPS9 | GGCCAAGTCCATCCACCA | TCTGGGAATCCAGGCGGA | 12593 & 12594 |
| RPSA | CCATGCAACAACAAGGGA | GTGAACTCAGGAGCGGGA | 12595 & 12596 |
| RPTOR | GTCCGGATCTGGGACACA | GTACGTCATGACGCGGCA | 12597 & 12598 |
| RQCD1 | GCACACCAGTCTAACAGA | CAAGGCTGGTGAGCCGGA | 12599 & 12600 |
| RRAD | GTGGACGGAGAAGAGGCA | CCACGAGGATGATGGGCA | 12601 & 12602 |
| RRAGD | TGGAGCAGGAACCCCCTA | AATGGCCTTCCGGAAGCA | 12603 & 12604 |
| RRAS | GCGTCTCAACGTGGACGA | TGGGAGGGCTCGGTGGGA | 12605 & 12606 |
| RREB1 | GGAGATCACAGAGGGGGA | CGGCGATGTAGTCGCAGA | 12607 & 12608 |
| RRM1 | TGACCTTGCCAAGGAGCA | GCTGTAGGCATCGGGGCA | 12609 & 12610 |
| RRM2 | CATCACGGACCCGCAGCA | GGACGCGGGTCCCGCTCA | 12611 & 12612 |
| RRM2B | GGAGGTGCAGGTTCCAGA | TATCCATCGCAAGGCCCA | 12613 & 12614 |
| RRP12 | CACTGCCCTCATCCCAGA | AGGCCAGAAGCAGGCACA | 12615 & 12616 |
| RRP8 | AAGTGGCCACTGCAGCCA | CCTGGGCCATGTCACACA | 12617 & 12618 |
| RRP9 | CTTCACAGGACACCGGGA | CCCAGCCGTCACACAGCA | 12619 & 12620 |
| RS1 | ACTCGGACCGCACCTCCA | CGCACTCCAGCAGCTCCA | 12621 & 12622 |
| RSAD2 | AGGACATGACGGAACAGA | AGATTCAGGCACCAAGCA | 12623 & 12624 |
| RSC1A1 | CAGGCCTGAAACCAGAGA | GCATTCCCACCAACTCGA | 12625 & 12626 |
| RSF1 | GCAAACGGCTACACCGGA | TCTGAGGGCAGGACCCTA | 12627 & 12628 |
| RSL1D1 | CTGGAACCTCCACCTCGA | GCGTCAAGAGAGCGTCCA | 12629 & 12630 |
| RSPO1 | GCCCTGCTCCAAGAAGCA | GCCCCTCAGGACACGGCA | 12631 & 12632 |
| RSPO2 | GCAACCGATGGAGACGCA | TGACATCGGCTACACCCA | 12633 & 12634 |
| RSPO4 | CGGCAAGTGCCTGCACGA | GCTGAAGCAGCTCTCACA | 12635 & 12636 |
| RSPRY1 | GAAGATCCACTGGGACCA | TCTCGGCCAAGCAGCCTA | 12637 & 12638 |
| RSU1 | AGGAGCTGCCCACACAGA | CAATATCTGGCGGCAGGA | 12639 & 12640 |
| RTBDN | CCGAGCCCTGAATGCGAA | CGAACCAGGCCTGGCAGA | 12641 & 12642 |
| RTN1 | GAAAACCGACGAAGGCCA | CCACAGCCATGAGCAGCA | 12643 & 12644 |
| RTN3 | TCAGAAGAAGGCCATCCA | CATAGGTCATCAGCCACA | 12645 & 12646 |
| RTN4 | GGCCACCCATTCAGGGCA | ACCCACATCAACACTGCA | 12647 & 12648 |
| RTN4RL1 | CCTCCGCCTCAACGGCAA | AGTCCTCGGCCCTCAGCA | 12649 & 12650 |
| RTN4RL2 | GCGGCTGCTCACAGAGCA | TAGCGTTGAGCCGCAGGA | 12651 & 12652 |
| RTP4 | GATCCCATGACACAGCCA | GCGAGGTACACAGCACCA | 12653 & 12654 |
| RTTN | GGCCATGCTCCTGAGGAA | GGCAGACAAGCCTGCACA | 12655 & 12656 |
| RUFY1 | GCCGGAACTGTGGCCACA | AGCTGTCGCACACTCGCA | 12657 & 12658 |
| RUNX1 | ACTCTCAACGGCACCCGA | GTGGTAGCGCGTGGCCGA | 12659 & 12660 |
| RUNX1T1 | CTAGACGCGCATCGGGAA | TCCGCTCCGCCTCAGACA | 12661 & 12662 |

FIG. 1 Cont.

| | | | |
|---|---|---|---|
| RUNX3 | CCTTCCCCACGCTGCCAA | GTAGGGGAAGGCAGCTGA | 12663 & 12664 |
| RUVBL1 | CCGTGAAGAGGCAGGGCA | GCTGGCCCATCATGGACA | 12665 & 12666 |
| RUVBL2 | CGTCACTGCGCTACGCCA | AGCGGGACTCGTCCAGGA | 12667 & 12668 |
| RXFP3 | CGCTCACCACCTGGAGCA | GAGGACGGGGTTGAGGCA | 12669 & 12670 |
| RXRA | GGAGGCCTACTGCAAGCA | TGAGCCCGATGGAGCGCA | 12671 & 12672 |
| RXRB | TACCCTGAGCAGCAGGGA | GATGGGGAGCCTCAAGCA | 12673 & 12674 |
| RXRG | TGGGATGCCTGCGAGCCA | GCAGCAGCAGCTTGGCAA | 12675 & 12676 |
| RYR1 | CCACTAGCAACGCGCAGA | TGGGATGACTCCACGCCA | 12677 & 12678 |
| RYR3 | TCCTGGGCATGCACGAGA | GGCAGCAGCTAGCAACCA | 12679 & 12680 |
| S100A1 | TGAAGGAGCTAGACGAGA | CAGGCCACTGTGAGAGCA | 12681 & 12682 |
| S100A11 | CAGCCCTACAGAGACTGA | CAAGCCATAGCTAGGCCA | 12683 & 12684 |
| S100A12 | AGGAGCTTGCAAACACCA | TGGGCAGCCTTCAGCGCA | 12685 & 12686 |
| S100A13 | GCCGGAAGGATAGCCTCA | TCATCAAGAGAGCCCACA | 12687 & 12688 |
| S100A16 | GGACACAGGGAACCGGAA | GCCGCCTATCAAGGTCCA | 12689 & 12690 |
| S100A2 | GCAGGTGGACTTCCAGGA | GTCTGGGCAGCCCTGGAA | 12691 & 12692 |
| S100A4 | GGGCAAAGAGGGTGACA | GCAGGACAGGAAGACACA | 12693 & 12694 |
| S100A5 | GGGGAGAGAGGGTAGCA | ATGGTCAGGAACACCGA | 12695 & 12696 |
| S100A6 | CAAGCACACCCTGAGCA | CCCCAGGAAGGTGACA | 12697 & 12698 |
| S100A7 | GAGCAACACTCAAGCTGAGA | GGCACTAAGGAAGTTGGGGA | 12699 & 12700 |
| S100A8 | GTTGACCGAGCTGGAGA | CCAGAATGAGGAACTCCTGGA | 12701 & 12702 |
| S100A9 | GTCGCAGCTGGAACGCAA | GGGTGCCCCAGCTTCACA | 12703 & 12704 |
| S100B | CAATGATGGAGACGGCGA | GGCAGGCAGTAGTAACCA | 12705 & 12706 |
| S100G | CAAAGAAGGTGATCCAGACCA | CATAGGATAAGACCACAGCACA | 12707 & 12708 |
| S100P | GCGAGGGCAGCACGCAGA | GATTGCAGCCACGAACA | 12709 & 12710 |
| S100Z | CGTGCCAAAAGGAAACCCA | CAACTGTCAGAGCTGCCA | 12711 & 12712 |
| S1PR1 | ACTCCGGCACCAACCCCA | AGAGTCTCCGCTCGGGCA | 12713 & 12714 |
| S1PR2 | GCCTCTCTACGCCAAGCA | CGTGGCTTGAGCGGACCA | 12715 & 12716 |
| S1PR5 | CTGCGGGGACCACCTCGA | GCCAGTCCCAGGAAGGGA | 12717 & 12718 |
| SAA1 | GGAGAGCCTACTCTGACA | AGTTCCCCCGAGCATGGA | 12719 & 12720 |
| SAA2 | GGAGAGCCTACTCTGACA | GCAGCCCAGGCACCCCCA | 12721 & 12722 |
| SAA4 | GCAGAGCCTATTGGGACA | AGACCCTGGAACGGCTGA | 12723 & 12724 |
| SAC3D1 | CCCTGCCCTACCTGCCAA | GGGCCAAGAGGTTGACCA | 12725 & 12726 |
| SAGE1 | TGGCCAACAGGCACCTGA | GACAGGAAGCCATCAGGA | 12727 & 12728 |
| SALL3 | GCCTCAAGTCCGTGGAGA | AGGACGAGGACTCGGACA | 12729 & 12730 |
| SAMD9 | GATGTGTGGAAGGAGGAA | TAAGCAAGTGGGCCTCCA | 12731 & 12732 |
| SAMD9L | TGGTCAGGCTGAAGGCAA | CAGAGGGCCTTCAATGGA | 12733 & 12734 |
| SAMHD1 | AGCCCGAGAACCCCCTCA | GCGCCTGAGGAAGGAGCA | 12735 & 12736 |
| SAMM50 | CCAGGAACTGGCAGGCTA | GCATGCTGAATCCGCGGA | 12737 & 12738 |
| SAMSN1 | AGAGCTCATCAAGTGGCA | GGTCCTGAATAGGGGCCA | 12739 & 12740 |
| SAP30 | GGATAAGAGCGCAAGGCA | ACAGGTGAATCACCTCCA | 12741 & 12742 |
| SAR1A | GGTGGGCACGAGCAAGCA | GGATTCCACGAGGCGAGA | 12743 & 12744 |
| SARDH | GGGCGCAACATGAGGAGA | TCGTACTCGAGGACCGGA | 12745 & 12746 |
| SASS6 | CATTCCAGCAGCAACACA | GAACCAGGGTGGCTGGTA | 12747 & 12748 |
| SAT1 | ACTGCGGCTGATCAAGGA | CACTTCTGCAACCAGGCA | 12749 & 12750 |
| SATB1 | CTACCAGTGGGTACGCGA | GGCAGGACCCATGGCCGA | 12751 & 12752 |
| SATB2 | CGCTGGAAGGAGAACCCA | GGAAGGTTCAGGAAGCGA | 12753 & 12754 |
| SAV1 | CCAGCCACAGCAAACTGA | CCAGGTCAGCCAGCTGGA | 12755 & 12756 |
| SBDS | AGAGACCATACACCGTGA | GGATGAACCGAAGCCTCA | 12757 & 12758 |
| SBNO2 | CCTGGACGTGGAGAAGGA | TCCTCGATACCGGGAGCA | 12759 & 12760 |
| SC5DL | ATCAAGTCCGTCGAGAGA | TCCAGCAAGAACAGTGCA | 12761 & 12762 |
| SCAF1 | GAAGGGGTCTCGTCGGAA | CCGGGAAGAACAGGAGGA | 12763 & 12764 |
| SCAI | CGCAGAGGCCTATGGGAA | CTTGTGAGGAGCAAGCGA | 12765 & 12766 |
| SCAMP3 | CCGAAGGGCAACACAGCA | GCACCGCAGGGTTGGAGA | 12767 & 12768 |
| SCARB1 | CGGTCACGGGAATCCCCA | GGCAGATGACAGGGACCA | 12769 & 12770 |
| SCARB2 | GACTCACACAGTTGACGA | GAGAGATATCGGGCCTGA | 12771 & 12772 |
| SCARF1 | CTGAGCACGTGGAAGCCA | CGGAAGACAGAGCGGACA | 12773 & 12774 |
| SCD | CTTGTGCGCAAACACCCA | GGGCAGCACTGTTCACCA | 12775 & 12776 |
| SCEL | CACACGGAAGCAGCAGGA | CGGTTGAGCACCACCCTA | 12777 & 12778 |
| SCFD1 | GGCCAGATATCACAGACA | AGGGCCTCTGGAAGCTGA | 12779 & 12780 |
| SCG2 | GACTGAGGCCCTACCAGA | ACATGTGGAATCCAGGCA | 12781 & 12782 |
| SCG3 | CAGTGAAGACAACTTTGAGGA | GGAAACACCTTCTTCTGGAGA | 12783 & 12784 |
| SCG5 | CACCCCTGACACTGCAGA | CACTTGCCCAAGCCTGGA | 12785 & 12786 |
| SCGB1C1 | AAGATGCCAAGGCAGCAA | GCACCAGCAGCTTGACCA | 12787 & 12788 |
| SCGB1D1 | TGCTACCGGGCAAATGCA | GGCCATCGTATCCACGCA | 12789 & 12790 |
| SCGB1D2 | CTGCTGCTACCAGGCCAA | ACAGCTTCCGGAGGGGCA | 12791 & 12792 |
| SCGB1D4 | AGCTGAGCTCACAGCCGA | AGAAGCAACAGCTGGGCA | 12793 & 12794 |
| SCGB2A2 | CCCGCGACTGAACACCGA | CAATAAGGGGCAGCCAGA | 12795 & 12796 |
| SCGB3A1 | TGCTGAGCAGCCTGGGCA | GCCTGGGGACCCAGCTCA | 12797 & 12798 |
| SCGN | ACTGGACAGCAGCGTGGA | CTCGGAGGAAGTTGCGGA | 12799 & 12800 |
| SCHIP1 | CCACCGACCTGAGAGACA | ATGTCCACCAGCATGGCA | 12801 & 12802 |
| SCLT1 | TGGGCACAGAGGTAGGAA | CAGAGTTCCACAGCCTGA | 12803 & 12804 |
| SCMH1 | CAGCACCTCCCAAAGGCA | TCCGACCCTGGGGAACGA | 12805 & 12806 |
| SCML2 | CCCCAAGAGCAGTCCCCA | GCCTGAAGAGGTCGGCGA | 12807 & 12808 |
| SCN10A | CAGGAGCAGCTGCAGCAA | TCAGCAGGGACCTGAGGA | 12809 & 12810 |
| SCN11A | TGCGTGTCGCAAAGCCAA | GGCCATCAGAGCCACCGA | 12811 & 12812 |
| SCN1A | GACACGGAGAGAGACGCA | AGGTCCACCAACCAAGGA | 12813 & 12814 |
| SCN1B | GGACAAAGCCAACAGAGA | GCCAGGTATTCCGAGGCA | 12815 & 12816 |
| SCN2A | GAGCAAAGGGGATCCGCA | TCCATCCCAGCCAGCAGA | 12817 & 12818 |
| SCN3A | CCATACCTCGCCCAGCAA | GGGAGACGAGCTTCAGCA | 12819 & 12820 |
| SCN3B | CGAGGAGGCTGGAGAGGA | GGGATGGCAAGGTAGTCA | 12821 & 12822 |
| SCN4A | TGGACCTGGGCATCACCA | GGTTGCCCACAGTGAGCA | 12823 & 12824 |
| SCN5A | GCTCCAAGAAGCCCCAGA | TAGTAGTGGCGCAGGGCA | 12825 & 12826 |

FIG. 1 Cont.

| | | | |
|---|---|---|---|
| SCN8A | GGAGAAGTTCGACCCCGA | ACCCGCTTGGTGAAGGCA | 12827 & 12828 |
| SCN9A | GAGCAAAGGGGATCCGCA | AGCAATCCATCCCAGCCA | 12829 & 12830 |
| SCNN1A | AGCCATGCAGCGTGACCA | ACAACACCGAGGAGCCGA | 12831 & 12832 |
| SCNN1B | CAACCGGGACTTCCCAGA | CAGAAGGCCAGTCAGCCA | 12833 & 12834 |
| SCNN1D | GGAACCGCCTCAAGACGA | CGTCACACAGGGTGACCA | 12835 & 12836 |
| SCNN1G | CATGGAGAGCCCAGCCAA | GGCGGGCAATGATAGAGA | 12837 & 12838 |
| SCRN1 | GCAAGCTGAGGAGCACCA | AGGGTCCAGTGGCTCGGA | 12839 & 12840 |
| SCRT2 | ATGCCCGACGTGCGGCAA | CTTGCCGCAGTGCGCGCA | 12841 & 12842 |
| SCT | GGATGCCCCTGGACGGGA | CCTTCTGCAGCAGCGCCA | 12843 & 12844 |
| SCTR | TTCCAACGAGAAGCGGCA | TGGACAGGGCACGAAGGA | 12845 & 12846 |
| SCUBE1 | GCTACATCGAGTCCCCCA | CATCCTCGATGGGCAGGA | 12847 & 12848 |
| SCUBE2 | AGGAGGCCTTGCCACCAA | GTTCCCACTGGGCAACGA | 12849 & 12850 |
| SCUBE3 | CCAAGCATGAAGGGGCCA | TCCCCACCACACTGACGA | 12851 & 12852 |
| SDC1 | GGGCCTCCTGGACAGGAA | CCCACCAGGCACACAGCA | 12853 & 12854 |
| SDC2 | ACCTTGACAACAGCTCCA | TCATCAGCTCCCGAGCCA | 12855 & 12856 |
| SDC3 | ATGCCATCGACTCGGGCA | AGATGAGCAGTGTGACCA | 12857 & 12858 |
| SDC4 | CACTGTGCAGGGCAGCAA | AGGATCAGGAAGACGGCA | 12859 & 12860 |
| SDCBP | ACCCTGCCAATCCAGCAA | TACCAGTTACAGGAGCCA | 12861 & 12862 |
| SDCCAG8 | GAAGGAGCTGGAGAGGCA | GGGCCTCCAGTTGGGCAA | 12863 & 12864 |
| SDF2 | CAGTGTGTGAGAGGGGAA | CTCACCCAGTAGGGTCCA | 12865 & 12866 |
| SDF2L1 | ACAGCACTGGGAGCGTGA | CCTCATGCTGCCCACGGA | 12867 & 12868 |
| SDF4 | CGCCATCAGGCTCAACGA | CCTCCTCCGTCAGCAGCA | 12869 & 12870 |
| SDHA | GGGAAGCGTGTTGCAAGAA | GATGGTCTGCAGCGCA | 12871 & 12872 |
| SDHAF2 | CTGTCAAGGCACAGCCTA | CTCCTGCCATGGAGGCAA | 12873 & 12874 |
| SDHB | ACTGGACGGGCTCTACGA | TCCAGCGATAGGCCTGCA | 12875 & 12876 |
| SDHC | GGCCAAAGAAGAGATGGA | AACAGGGCCGACATGCCA | 12877 & 12878 |
| SDHD | CTTGTCACCGAGCCACCA | GAGTGAGGGCTGCAGCCA | 12879 & 12880 |
| SDPR | CCGAGAGGGAGAAAGCCA | CCACCAGAGCGCTGGCGA | 12881 & 12882 |
| SEC11A | GCGGATGAACAAGCGGCA | TGCTGCCACTGAGCACCA | 12883 & 12884 |
| SEC14L1 | CTGCAGAGGAGCTGGAGA | ACTGACGAGGCATCCACA | 12885 & 12886 |
| SEC14L2 | CCAAGATGGGAGAGAGGCA | CCGCAGGACATAGATGCCA | 12887 & 12888 |
| SEC14L3 | CATGTACGTGCGGGACCA | AAGCCGATGTCCGCACCA | 12889 & 12890 |
| SEC16B | TGAGCCAGGGAGAGAGCA | CCGAAGTTGCGCTAGCCA | 12891 & 12892 |
| SEC22B | GAACAGTCCCCTACCAGA | GTCGGGACACAGTGGGCA | 12893 & 12894 |
| SEC22C | CACTCTGGAGGACACAGA | GAGCAGGCTCCAAGTGCA | 12895 & 12896 |
| SEC24D | CCAGATGGCAGGCGCACA | TAGTGACCAGGGGAGGGA | 12897 & 12898 |
| SEC31A | GTACGCAGCACAGCACCA | GGCAGCTCACTGGCAGCA | 12899 & 12900 |
| SEC31B | AGGGTCCCAGGACACAGA | AGGAGTCTCAGGCAGGGA | 12901 & 12902 |
| SEC61A1 | AGCTGAAGGAGCAGCAGA | CGCCTAGGAAGTCAGCCA | 12903 & 12904 |
| SEC61B | CTGTGGGACAAGGAGTGCA | GGCCAACTTTGAGCCCA | 12905 & 12906 |
| SEC61G | GATTGCCATGGCAACAGCA | CCCTCACACTTGTTCACCA | 12907 & 12908 |

| | | | |
|---|---|---|---|
| SECISBP2 | GGAGATCCCCAAGGCCAA | AACTGGTCATCACCACCA | 12909 & 12910 |
| SECTM1 | CAGCTCCAGGTTCAGGGA | ACAGCGGCACCTGTACCA | 12911 & 12912 |
| SEL1L | AGCTGAAGCCAGCCCAGA | GTTCCCAACAGCAGCGCA | 12913 & 12914 |
| SEL1L2 | CGAGTCCAGATGCCCACA | CCAGGAACAATGAGGCCA | 12915 & 12916 |
| SELE | GCCTGGCAGTTCCGGGAA | TTCCGAAGCCAGAGGAGA | 12917 & 12918 |
| SELENBP1 | CAGTGCCTGGGACAAGCA | TAGCGGAGCTCATGGGCA | 12919 & 12920 |
| SELL | ATGCAGTGGCCATGGAGA | TCAGAGCAGCTGAAGGCA | 12921 & 12922 |
| SELO | GCTGCAGAGCAGGAACCA | TGGCGTGCATCACGCGCA | 12923 & 12924 |
| SELP | CTGCACAAACAGCATGCCA | GTAGAAGCCACCGCTCCA | 12925 & 12926 |
| SELPLG | TCCCATGGCAGCCAGCAA | CCTCACCCCCATCAGGCA | 12927 & 12928 |
| SELT | GCCAGCGGTACCCAGACA | CCCCACTGCCAGATGCTA | 12929 & 12930 |
| SEMA3A | GGCAATTCCAGAGGCGAA | AACCCATGTTCCACCGCA | 12931 & 12932 |
| SEMA3C | ACGGACAAATGGTCCCCA | AGTGGCTGAATGCCCCCA | 12933 & 12934 |
| SEMA3D | GCAAAGCCCAGGAGCACA | TCAACCGTGACTCAGCCA | 12935 & 12936 |
| SEMA3E | GCAGCCTTCAACGGACCA | CGGATGGCATCATCAGGA | 12937 & 12938 |
| SEMA3F | CGGAAACCCCATCAGGCA | GTGCAGGAGTAGAGGCCA | 12939 & 12940 |
| SEMA3G | GCGAGTCTTGCACACGGA | GGACCACAGTCTGGGAGA | 12941 & 12942 |
| SEMA4A | TGGACAGCCAGGACCAGA | CTCTCAATGGGGAGGCCA | 12943 & 12944 |
| SEMA4B | AGCCAGCTACTGCCCAGA | AGCAGCACGGCCAGCACA | 12945 & 12946 |
| SEMA4C | GCCCTGTCCTGAACCAGA | GCCGAGTTGGAGAAGGCA | 12947 & 12948 |
| SEMA4D | GCGTGTTGAAGGCCGAGA | AGGCACTGGTACACCCCA | 12949 & 12950 |
| SEMA4F | GGACACCTCCACCGAGCA | GCTCTGGAGACGGCCACA | 12951 & 12952 |
| SEMA4G | GCCTGAGCACAGTGGCAA | AGGATGAGGCAGAGGCCA | 12953 & 12954 |
| SEMA5A | GCAACAACCCCGAACCCA | GGGACCAGCAAGACCACA | 12955 & 12956 |
| SEMA5B | GGAGCAAGTGCAGCAGCA | CTTGAACTCCACGCCGCA | 12957 & 12958 |
| SEMA6A | AGCAGAAGCGGAAGCCCA | CGTGGGAATCACAGGGGA | 12959 & 12960 |
| SEMA6D | AGAAGACCCTGCAGGCCA | GGGGAATGAGGTGGCGGA | 12961 & 12962 |
| SEMG1 | AAGGCGGATCCCAAAGCA | GTGCGCAGGACAGAGTGA | 12963 & 12964 |
| SEPHS1 | TGGCCTACCAGGAGGCGA | TCTTGGCCAGCACCGGGA | 12965 & 12966 |
| SEPHS2 | GCTGTCAATGCCCACCAA | CCTGATAGGCCAGCTCCA | 12967 & 12968 |
| SEPN1 | CCACCTGCCTTCAGGGGA | AGGCCTCAGTGAACGGCA | 12969 & 12970 |
| SEPSECS | GGCCACGAATAGACCAGA | AGAATGCAATCAGGCCCA | 12971 & 12972 |
| SEPX1 | AGACCATTCACGCCGACA | GCCACACTTGCCACAGGA | 12973 & 12974 |
| SERBP1 | GACCACCTCGTGAACGAA | CGGCCCATTCCACGTCCA | 12975 & 12976 |
| SERGEF | CTGTTCAAGACCACCGAA | AAGGAGTGGCCAGCCCCA | 12977 & 12978 |
| SERINC1 | GGGGACGATGTTCACCGA | GAACAAGTGGTGCCACGA | 12979 & 12980 |
| SERP1 | CAGCAAGAACATCACCCA | TAACCAGGGTCCTACAGA | 12981 & 12982 |
| SERPINA1 | GGACTTCCACGTGGACCA | GCAGCACCCAGCTGGACA | 12983 & 12984 |
| SERPINA10 | CACAGACTTGGTGGAGACA | GCCTAAGCAGCTCATGCA | 12985 & 12986 |
| SERPINA11 | CCTGAGAAAATGGGGCCA | GCCCAGTGACTCCTGAGA | 12987 & 12988 |
| SERPINA12 | GACTCCACATGACGGGCA | GGCTGCGATGAGGGGCGA | 12989 & 12990 |

FIG. 1 Cont.

| | | | |
|---|---|---|---|
| SERPINA3 | GGAAGCCTTCACCAGCAA | GCACAGCCTTATGGACCA | 12991 & 12992 |
| SERPINA4 | GGATGAGGCTGGCACCGA | AATCGCAGGATGTGGCGA | 12993 & 12994 |
| SERPINA5 | CATGATGAGCCGCGAGGA | CTTGGTAGGGGACCCCCA | 12995 & 12996 |
| SERPINA6 | CTCACGCATCACCCAGGA | GAGCCAGCTGTGTCCACA | 12997 & 12998 |
| SERPINA7 | GCAGCACCCAAACTGAGA | ATCAGATGCTGGAAGCCA | 12999 & 13000 |
| SERPINA9 | TCCCCATGATGCACCAGA | CCCTTGCTAGGGAGGACA | 13001 & 13002 |
| SERPINB2 | AGCGCACACCTGTACAGA | TCCAGCAGCTCCAAGCCA | 13003 & 13004 |
| SERPINB5 | AAAGGAGCCACTGGGCAA | TAGCACCCACTTGAGCAA | 13005 & 13006 |
| SERPINB6 | GCCGTAGAGAAGTCCAGA | CAGCATTCACCAGAACCA | 13007 & 13008 |
| SERPINB8 | GCAGCAGAATGGAGCCAA | AGAAGAGAACCTGCCACA | 13009 & 13010 |
| SERPINC1 | CGTGGCTGAAGGCACCCA | GCAGCACCTCTGGGGTGA | 13011 & 13012 |
| SERPIND1 | GAACGAGGAAGGCACCCA | GGTCGACAGTGAAGCGGA | 13013 & 13014 |
| SERPINE1 | GAACCTGGGAATGACCGA | CTGTGGATGAGGAGGCCA | 13015 & 13016 |
| SERPINE2 | GTCGACAAGTGCCCCCAA | TCGGCAGTGCAATCAGCA | 13017 & 13018 |
| SERPINF1 | AAGCTCGCCAGGTCCACA | CAGCCTTAGGGTCCGACA | 13019 & 13020 |
| SERPINF2 | GTCCCAGGTACTGGCCAA | GATGCTGCACGCCGGACA | 13021 & 13022 |
| SERPING1 | GGGTGGCCAAGAACACCA | AGGAGGACAAGGCGGGTA | 13023 & 13024 |
| SERPINH1 | CCAAGGACGTGGAGCGCA | CGTGATGGGGCATGAGGA | 13025 & 13026 |
| SERPINI1 | AAATGTAGCCGTGGCCAA | AGGGCCAGATAAGTGGCA | 13027 & 13028 |
| SERPINI2 | CAAAGGCTTGTGCAGAGA | TTCACCAGGACAAGCCGA | 13029 & 13030 |
| SERTAD1 | CCAACCCTTGGCAGACGA | AACAGGCCCTCAAGCCCA | 13031 & 13032 |
| SERTAD3 | GCTGGACACCTCCATGGA | GTCCCCCAAGTACCGGGA | 13033 & 13034 |
| SERTAD4 | TGGCCAGATACCTGCCAA | TCGTGGCTGAGGGGGCCA | 13035 & 13036 |
| SESN1 | GGACAGGGACCAAGCAGA | TGTAGGGGTAACGGCCCA | 13037 & 13038 |
| SET | CAGCAGGAAGAGGCAGCA | AACTCATCAGCACCTGCA | 13039 & 13040 |
| SETBP1 | CCCCATCCGAAGAACCCA | GCTGGTGAAGACGCCACA | 13041 & 13042 |
| SETD1A | GTCAGATGGTGGCCGACA | GCAGTTAGGCGTGCAGCA | 13043 & 13044 |
| SETD2 | GCCTGAACCCTTACCGGA | CACTCCAGGTCCTCAGGA | 13045 & 13046 |
| SETD3 | CTACGCCATGAAGGCCGA | AGCGCTGTCTCCCAGCAA | 13047 & 13048 |
| SETD4 | GAGAGCCCACGTGCAGGA | GACGGTGCACCAAGCCCA | 13049 & 13050 |
| SETD5 | GACCCTCAGACTCGCCAA | TACTGGTGCACACCCCCA | 13051 & 13052 |
| SETD6 | GCCCTTCATGGAAGCCCA | AGGCACCATCACGGGGGA | 13053 & 13054 |
| SETD7 | AGAGGTTGACAGCAGGGA | GGAGGCACAGTACTTGGA | 13055 & 13056 |
| SETD8 | CGACGCCAAGAAACGGGA | AGCCGCGATGTCTCGGGA | 13057 & 13058 |
| SETDB1 | AGAATCCGGGCTGGGACA | TGGCCCCACAGCAACAGA | 13059 & 13060 |
| SETDB2 | GACAGCAAGGAATGCCAA | TAGACAGCGTACACCCCA | 13061 & 13062 |
| SETMAR | TTGGACCTGGAGCAGACA | CTCTCCATGGCGGAGACA | 13063 & 13064 |
| SEZ6 | CTGCCACGATCCTGGAGA | GCACCATTCTCAGGGGCA | 13065 & 13066 |
| SEZ6L2 | AGGTCCCGAGGAACGACA | CCTAGCAGCTCGTAGCCA | 13067 & 13068 |
| SF3A1 | TCACCCTCCAGGAGCAGA | AGTGATGGGTGGAGCCGA | 13069 & 13070 |
| SF3A3 | CAAAGCCTTCCAGCGACA | GCCCACAAGGAGACAGCA | 13071 & 13072 |
| SF3B1 | CCTGGCAAGCGAGACACA | GCTTCAGCCAAGGCAGCA | 13073 & 13074 |
| SF3B2 | GGGATGCCAGTAGGACCA | GCGAGTTCAGCCCAGGGA | 13075 & 13076 |
| SF3B3 | AGCTCCCAAGGCTGGCAA | CCTTGGCCACACCCACCA | 13077 & 13078 |
| SFMBT1 | CCACGAGGGCCTGAGGAA | GGACCTCTCTAAGGACCA | 13079 & 13080 |
| SFN | ACCAGGAGGCCATGGACA | AGCCATGGCCTCGTCGAA | 13081 & 13082 |
| SFPQ | AGGCAAGAGGAGGAACGA | TAACCTATGCCACCACCA | 13083 & 13084 |
| SFRP1 | CCGCCCAATGCCACCGAA | AACTCGCTGGCACAGAGA | 13085 & 13086 |
| SFRP2 | GACGAGACCATCCAGCCA | AACGGTCGCACTCAAGCA | 13087 & 13088 |
| SFRP4 | TGAAGCCATCGTCACGGA | CAGCCACTCCTCTGCACA | 13089 & 13090 |
| SFRP5 | CCGCAAAGTGGATGGACA | GTAGAGGGAGCAGGGGTA | 13091 & 13092 |
| SFTA2 | GCAACTGAAGCTGAAGGA | CGCTGGTCCCTGAAGGGA | 13093 & 13094 |
| SFTPA1 | GGCCCTCCAGGGCTTCCA | GCCGCCTGCTCTGGCACA | 13095 & 13096 |
| SFTPA2 | AGGCAGGGACGGGAGAGA | CTCCACGCTCTCCAGGGA | 13097 & 13098 |
| SFTPB | AGAATGGCTGCCGCGAGA | CAACACAGGCCTGGAGCA | 13099 & 13100 |
| SFTPD | AAGTAGGTGCCCCAGGCA | GACTTCCCTGGGGACCCA | 13101 & 13102 |
| SFXN4 | CATGGACAAGGAAGGCAA | ATCAGAGCTGAGGTCCCA | 13103 & 13104 |
| SFXN5 | CCTGGACAGCGATGGCAA | CGATCGGGGGTAGCACCA | 13105 & 13106 |
| SGCA | AGTGCCGGAGCCTGCAGA | TGACCAGAGCATCCACCA | 13107 & 13108 |
| SGCB | AGGCTGTTGAGAGAAGGA | AATGCGAATCACGGCCCA | 13109 & 13110 |
| SGCD | AGCCACCTGCAGGACAGA | CCCATTGGCGCAGACGCA | 13111 & 13112 |
| SGCE | ATGTGCTGCCGACGGGAA | AAGCGTTGACAGGGGCCA | 13113 & 13114 |
| SGCG | TAAGCATGGATGCCCCAA | GCTGCCAGAGGGACCCCA | 13115 & 13116 |
| SGK1 | GCGTCCTCGTCACAGCCA | GAGTCCGTGGGAGGCGCA | 13117 & 13118 |
| SGK2 | CCCAGAGTTCACCCAGGA | AATGCACTTGAGGCCCCA | 13119 & 13120 |
| SGMS1 | GGAGACTGGGAAGCCCAA | TCCAGTGATACCACCAGA | 13121 & 13122 |
| SGMS2 | GCTCCAAAGCTCAATGGA | TACCACCAGAAGTGACGA | 13123 & 13124 |
| SGPP1 | GAGTACAGCATGCCCTCCA | TAGAGAACACCAGCAGGGA | 13125 & 13126 |
| SGPP2 | GCAGGCTCTACACTGGGA | TCGATGAAGGTCCAGGCA | 13127 & 13128 |
| SGSH | GGGAGCTCTACGACCGGA | CCAGCTGGTCCCGAAGCA | 13129 & 13130 |
| SH2B1 | CCCTTGGACACTCCGGAA | AAGACACCGTGGGAGCCA | 13131 & 13132 |
| SH2B2 | AGCTTACGACACGCCCGA | TCGGCCCAGCCACCAGCA | 13133 & 13134 |
| SH2B3 | GGAGAGCACAGAAGCAGA | GGCCCTGCAGCTGAACCA | 13135 & 13136 |
| SH2D1A | GCAGGGAAACCGGCGAGA | ACCGTGATACAGCACACA | 13137 & 13138 |
| SH2D1B | GGAAGGGGTGGATGGCAA | ACGAGACACAGAGGCACA | 13139 & 13140 |
| SH3BGR | CCTCCAGACTCAAAGGGA | TCAGGGAGGTTGCCCACA | 13141 & 13142 |
| SH3BP1 | CCCCGAGAACCTCAGCAA | TCTCAGGTGGCCACAGCA | 13143 & 13144 |
| SH3BP4 | TTGTGGACAGCGAGGCCA | CGTCCAGGGAGTTCACCA | 13145 & 13146 |
| SH3BP5 | CCAGGTACAATGCCGCCA | GCCTGCAGGTCATCCACA | 13147 & 13148 |
| SH3GL1 | CTTCGAGCCCGAGAACGA | GCACCTCCACGTAGCTGA | 13149 & 13150 |
| SH3GL2 | ACAAGCAGGCAGTCCAGA | GTGTGGGAGAGACCCCCA | 13151 & 13152 |
| SH3PXD2A | GCAGAGTCGCAGAGCCAA | CCTTGAGCCCTCCACGGA | 13153 & 13154 |

FIG. 1 Cont.

| | | | |
|---|---|---|---|
| SH3TC1 | TGGCCCTAGCACTCAGCA | GCGAGTTGCAGAGCGACA | 13155 & 13156 |
| SHANK1 | GGGCAAACACCGACCCAA | TGCCGGAGCATCAACCCA | 13157 & 13158 |
| SHBG | GGGACACCAGAGAACCCA | GGTTAAGGAGGGGAGCCA | 13159 & 13160 |
| SHC1 | CGGGAGAGCACGACCACA | CCGCAGAGATGATGGGCA | 13161 & 13162 |
| SHC3 | GAAGGCACGATCCGGACA | CACTGGCTGCTGGAGACA | 13163 & 13164 |
| SHE | GGGTCAAAGGGATGCAGA | CTGTCAAGCAGCTGGAGA | 13165 & 13166 |
| SHH | CACGGTGCACCTGGAGCA | GGAAGTCGCTGTAGAGCA | 13167 & 13168 |
| SHISA5 | TCGCCCTGGCTACAACGA | GGCTGAGGATAAGGGGCA | 13169 & 13170 |
| SHKBP1 | TCGTGCAGCACCCGGAGA | GCGGAAGCGAGTCACAGA | 13171 & 13172 |
| SHMT1 | TAGAGCTGACCCTGCAGA | GAGGGAAGAGAGAGGCGA | 13173 & 13174 |
| SHMT2 | CGGACATCGTCACCACCA | GCAGGGAGTACTCCCGGA | 13175 & 13176 |
| SHOX2 | CCACCACCTGCATCCGCA | CCAGCGTGGCGAGCGGCA | 13177 & 13178 |
| SHPRH | CTGCTGCCCCTGCACACA | GCCTGAAGCTCATGGGCA | 13179 & 13180 |
| SHROOM1 | ACTGGACGCCATCAGGGA | GGCGGCTGAACTGGAGGA | 13181 & 13182 |
| SHROOM2 | GGGAACCCTACCTCGAGA | TGAGCTCACTGGCCACGA | 13183 & 13184 |
| SHROOM3 | AAGGAGAACCTGGATCGCA | CAGGCTCTCCAGCAGACA | 13185 & 13186 |
| SI | GGCCATCCAGTCATGCCA | AGGGGATGTTAGCAGCCA | 13187 & 13188 |
| SIAE | GCTATGTCCCCAACCCAA | TGCAGCCGATAAGCCACA | 13189 & 13190 |
| SIAH1 | ATACGATGGTCACCAGCA | AGCTCAAGTCGGTAAGCA | 13191 & 13192 |
| SIAH2 | TGCACGCCCACAAGAGCA | ATCATCACCCAGTCGACA | 13193 & 13194 |
| SIDT1 | CCCTGGAAGCCAAGGACA | GCATGCACAGGCCAGCGA | 13195 & 13196 |
| SIDT2 | CAGAGTCGAGGGAGCACA | ACACCAGGAAGGACCCGA | 13197 & 13198 |
| SIGIRR | CTCAGAGGTGGACCCGGA | CGAGATCCGAGACGTCCA | 13199 & 13200 |
| SIGLEC10 | CATCCTGCAGCTGCCAGA | GATGATCAGGGCCAGGCA | 13201 & 13202 |
| SIGLEC12 | GGAAGGGGGATTCAGGGA | CCCCTGTTCACAGGCCCA | 13203 & 13204 |
| SIGLEC15 | GTCACGGCCACCTAGTGA | GCAGCGCCTTGAAGCCGA | 13205 & 13206 |
| SIGLEC6 | CCAGGACCACAGCACCAA | GGGGAAGCCCTGGAACCA | 13207 & 13208 |
| SIGLEC7 | AGCAGCGGACGTGGGAGA | CTGAGGAGTGGGCAGCCA | 13209 & 13210 |
| SIGLEC9 | GTCACTCCCAGAGGGCCA | ATCCCTCAGGTGCACCCA | 13211 & 13212 |
| SIGMAR1 | TCTTCCAGCGCGAAGAGA | CGCATTCACGAACACCCA | 13213 & 13214 |
| SIK1 | CGGCCTCGGAGCTCGGA | CGGGAAGAACAAGGGCCA | 13215 & 13216 |
| SIK3 | CCGTCCATGAGCACCACA | GCATCCGACATCCGGGCA | 13217 & 13218 |
| SIKE1 | CCAGGTCAGGCAGAGGTA | TGGGACAGCAGAATGTGA | 13219 & 13220 |
| SIL1 | CCCAGAGAAGCTGCAGCA | GGGCATCATGCTCGGGCA | 13221 & 13222 |
| SIN3A | CCAAAGGAGCGAGCCACA | CCTCAGACCACGAAGGGA | 13223 & 13224 |
| SIPA1L1 | TGGCACCCCTATGGCACA | AACCACTGGGCTGGCAGA | 13225 & 13226 |
| SIRPA | AGCCCACCCGAAGGAGCA | CCGCCATCAGTAGGGCCA | 13227 & 13228 |
| SIRPB1 | CTGTGCCCACAGGGACGA | GCTGAGATCTCCAGGGCA | 13229 & 13230 |
| SIRPB2 | GATCATCCAGCCCCAGGA | CTGATGGGTCCAGGGGGA | 13231 & 13232 |
| SIRPD | CAAGCCTGGCAACACAGA | CTGAGTGCCCCGACCTGA | 13233 & 13234 |
| SIRPG | GCATCCGCAGCACAGCCA | AAGTTGGCAGTCCCACGA | 13235 & 13236 |
| SIRT1 | GAGTGGCAAAGGAGCAGA | GAATATACCTCAGCGCCA | 13237 & 13238 |
| SIRT2 | CCTGGGCAGTTCAAGCCA | GCGTGTAGCAGCGCAGGA | 13239 & 13240 |
| SIRT3 | GCATCCTCGCAGCAGGGA | GCTGCACAAGGTCCCGCA | 13241 & 13242 |
| SIRT4 | TCCAAGTCCTGAACCCCA | ACGCAGGTTGGGACCTGA | 13243 & 13244 |
| SIRT5 | CGATGAGCTGCACCGCAA | GCCTCTTCACACCGGGGA | 13245 & 13246 |
| SIRT6 | CGCAGTACGTCCGAGACA | GCGATGTACCCAGCGTGA | 13247 & 13248 |
| SIRT7 | GCAGTGGACCCCGAAGGA | CTGCACAGCGACTTCCGA | 13249 & 13250 |
| SIT1 | TGCCAGGGCTGCAGAGGA | GTCCAGCACCACCTCCGA | 13251 & 13252 |
| SIX4 | CAGGCCTGATACCCAGCA | GAAGCTGCCACTGACACA | 13253 & 13254 |
| SKAP1 | TCCAGCAGAAGCCAGAGA | GGAACCACAACTTGGGGA | 13255 & 13256 |
| SKAP2 | GCTCCAGTGAAAGTGGAA | TCTCCTACCCACCAGCCA | 13257 & 13258 |
| SKI | CGGCCTCCATAAGACCCA | GAGGGTGAACACAGCCCA | 13259 & 13260 |
| SKIL | CTGGGTGGACCAGCAGCA | GGGCCAGGAAGAACCTGA | 13261 & 13262 |
| SKIV2L2 | CCTGGGCAACTGGAGCTA | AGGCGCCTCATACAACGA | 13263 & 13264 |
| SKP2 | GGAAACGGCTGAAGAGCA | TCATCAGACGCTAGGCGA | 13265 & 13266 |
| SLA | GTCCAGACTGCAGGAGGA | AGGGACAGGTAAGAGGCA | 13267 & 13268 |
| SLA2 | ATAACATCCCCAGCGTCCA | GCGGTGAGATGTACAGCCA | 13269 & 13270 |
| SLAMF1 | AGGAGAACGGGACCTGCA | GAGGGACAGGAGGTGGGA | 13271 & 13272 |
| SLAMF6 | GAGGCCTTGGGAAACACA | AAGCTTCTGGGCAGAGACA | 13273 & 13274 |
| SLAMF7 | GCAGCCAATGAGTCCCA | CAGAGCTTCCTGGCAAGGA | 13275 & 13276 |
| SLAMF8 | GGCGACGGGAGACAACCA | CAGCATCAGGAGCAGCGA | 13277 & 13278 |
| SLBP | CCTCCAGCGGAAGAAGGA | GGTGTGCCAGAGTACACA | 13279 & 13280 |
| SLC10A3 | CAGGCATCCGGCTACCCA | GCAGCATGGCCAAGGCCA | 13281 & 13282 |
| SLC11A1 | GCCCACCCTCATGCAGGA | GGCAACAGGTCCAGACCA | 13283 & 13284 |
| SLC11A2 | GGCGGATTGCAGGAGGAA | TAAGCCACGCTGACCACA | 13285 & 13286 |
| SLC12A1 | CCGAGATGCCACCGGGAA | CCTTGCACAGAGCCTGGA | 13287 & 13288 |
| SLC12A2 | CTCCACGACGAGCTGGAA | ACACCCTTGATCCAGCCA | 13289 & 13290 |
| SLC12A3 | TGAAGGAGGAGCAGGCCA | CGCCTACGAACACACGGA | 13291 & 13292 |
| SLC12A4 | GGTGAACCCACATGGGCA | CACAGGCGAGGTTCACGA | 13293 & 13294 |
| SLC12A5 | TGAAGCCGGAGTGGGAGA | GCCCAGGCATGTTGAGCA | 13295 & 13296 |
| SLC12A8 | GACAAGGGAAGGGGCCAA | GGAACACATGGACAGGGA | 13297 & 13298 |
| SLC12A9 | GGACCCTGTACAGCCGCA | CCGGAGATTCGCAGCAGA | 13299 & 13300 |
| SLC15A1 | TGCAGACCGTGAACGCCA | CCTGCACGATGGCAGCCA | 13301 & 13302 |
| SLC15A3 | CTGTACAACGCGGCACCA | GTAGAGGTCCATCCGGCA | 13303 & 13304 |
| SLC16A1 | GACATGGTAGCCCGACCA | CAATACGGAGCTGAGCCA | 13305 & 13306 |
| SLC16A3 | GGGCGTGCCCGACACCAA | CCACCATGCCGTAGGAGA | 13307 & 13308 |
| SLC16A4 | GGGCCTAACAGGAACAGA | GACTGACCGTCTCAAGGA | 13309 & 13310 |
| SLC16A6 | TCCTCAACAGGGAGCCCA | GTAGACCCCAGCTGCAGA | 13311 & 13312 |
| SLC16A7 | GCCCCACCTGTGCATCCA | CTGCGTACATAACAGCCA | 13313 & 13314 |
| SLC17A5 | CAGTGCCGTGGGTACCCA | GTCAGCAGCTTGACCAGA | 13315 & 13316 |
| SLC18A2 | ATCGCCATGCTGGAGCCA | GCAAGAAGGCAACGCCCA | 13317 & 13318 |

FIG. 1 Cont.

| | | | |
|---|---|---|---|
| SLC19A1 | AGGCGGGAAGCTGGGACA | CCACCTCGTTCCACAGGA | 13319 & 13320 |
| SLC19A2 | CACCCCAGCTTCTAACCA | CAGCAGAGAAGAGGGCGA | 13321 & 13322 |
| SLC1A1 | CCATCAGTATCACGGCCA | GGCCCACGGCACTCAGCA | 13323 & 13324 |
| SLC1A2 | ATGAAGCGGTAGCCGCCA | TGAGGAGCATGGTGACCA | 13325 & 13326 |
| SLC1A3 | GACAAGCGCGTCACCAGA | CCGCGATGATGAGCGTGA | 13327 & 13328 |
| SLC1A4 | CCCTCAACGAGGCGACGA | TCCCCAGGCTGGTCACCA | 13329 & 13330 |
| SLC1A5 | ATGGCGTGGCCAAGCACA | ACGCTGTGGCCGTGACCA | 13331 & 13332 |
| SLC1A6 | AGGCGGGTCTGGTCACCA | TGCGAAGCCGGTCAAGGA | 13333 & 13334 |
| SLC20A1 | CCAGACCATGGGGAAGGA | CAGACACAACAGAGCCCA | 13335 & 13336 |
| SLC22A1 | GCTGAGCTGTACCCCACA | AGCAGGCCCAACACCGCA | 13337 & 13338 |
| SLC22A11 | GCCTAACCTGCCTCACCA | AGAGGAGAGGAGGCAGCA | 13339 & 13340 |
| SLC22A12 | GGAGCTGAGCATGGGCCA | GCTGGGATGTCCACGACA | 13341 & 13342 |
| SLC22A15 | CACACCCAGCCAACAGGA | GCACTCAGAGTTAGGCCA | 13343 & 13344 |
| SLC22A18 | ACGTGGTCACCGACAGCA | GTCCCAGAGTTCGGAGCA | 13345 & 13346 |
| SLC22A4 | GGAAGGTGCCCCTCACCA | TGCAGGAAGCTGAAGCCA | 13347 & 13348 |
| SLC22A5 | CTACGTGTACACAGCCGA | AGGAAGCGGTCGTAGGCA | 13349 & 13350 |
| SLC22A6 | GGAGCTGACCATGGGCAA | CCACAAGCTTGGCAGGCA | 13351 & 13352 |
| SLC22A8 | ATCAGCCCTTGCCAGAGA | CGTGAGGCTGTAGAGGGA | 13353 & 13354 |
| SLC23A1 | CAGGGGCATCTTCACCGA | CGATGGTGCCCAGGACCA | 13355 & 13356 |
| SLC23A2 | GCCAGCTCATTGGGACCA | GGATCCGGGGATACCAGA | 13357 & 13358 |
| SLC23A3 | TCTGCCCCCACCAAGGCA | CCCCACCAACAACAGGCA | 13359 & 13360 |
| SLC24A3 | GCAGCAACTGCGACGCAA | GAAGGCCAGCCTCAGAGA | 13361 & 13362 |
| SLC24A4 | GACAAGGCCTTGGGGACA | TGAGAGCGACAGAGCCCA | 13363 & 13364 |
| SLC25A1 | ACCAGGGCCTCACAGCCA | GTACCAGTTGCGCAGGGA | 13365 & 13366 |
| SLC25A10 | ACCATGGCATCCAGCCGA | CATCCAGGGGCTGGCACA | 13367 & 13368 |
| SLC25A11 | CTACTCCCAATCCAAGCA | TGGCAATGTCCACAGGCA | 13369 & 13370 |
| SLC25A12 | GAAGAAGGGCCCTCAGCA | TCAGGGTTGGCAGGAGGA | 13371 & 13372 |
| SLC25A13 | CTGCGTGAAGAAGGACCA | CAGGATTCGGGGCAGGCA | 13373 & 13374 |
| SLC25A14 | CAAGGGAGCATGATTGGA | GGCCAGAGCCCCAGCCAA | 13375 & 13376 |
| SLC25A15 | GCAGGCAAAGCTGAGTGA | GTCCATGGTAGAACCCCA | 13377 & 13378 |
| SLC25A16 | GCAGACCTTCATCAGACA | GCATTCGCCGACGAGTCA | 13379 & 13380 |
| SLC25A17 | GCCAAACTGCTGCAGACA | GTGCACGCTTCAGCCCCA | 13381 & 13382 |
| SLC25A19 | AGCTCAGGGTGAGCCCAA | ACACCAGCTCCACTGCCA | 13383 & 13384 |
| SLC25A20 | TGACTCCTGGAGAACGGA | CCAGCCACCAAGATCCGA | 13385 & 13386 |
| SLC25A23 | CACGACTCGGCAGACCCA | GCAGACCCAGCATGGACA | 13387 & 13388 |
| SLC25A25 | GCTGCGGAAGACAGGCCA | TAGTGCTGCAGCCAGGCA | 13389 & 13390 |
| SLC25A28 | CGGAAGTGGTCAAGCAGA | TCCAGAGAGGACGTGGGA | 13391 & 13392 |
| SLC25A3 | GGCTACTCCATGCAGGGA | TCCATAGGAGCCAGGGCA | 13393 & 13394 |
| SLC25A37 | CGCAGCACCGGTCAGCAA | GGATGGACTGGAAGGGGA | 13395 & 13396 |
| SLC25A38 | ACGCTGCCCTGAGGAGCA | CCACCTGGTCATGAGGCA | 13397 & 13398 |
| SLC25A4 | AGTGTGACGGCAGTCGCA | AGCACATTGGACCAGGCA | 13399 & 13400 |
| SLC25A48 | CCTTCCCCCTCGCCAGCA | TCTGACAGCGTGCGGGGA | 13401 & 13402 |
| SLC25A5 | GCGCGGTAACCTGGCCAA | GCACCACCCGATGCCAGA | 13403 & 13404 |
| SLC25A6 | ACGATACGGCCAAGGGCA | TGTCGAAGGGGTAGGACA | 13405 & 13406 |
| SLC26A2 | CAGGGATCCACACACTGA | GATTGCACTGAGCCAGCA | 13407 & 13408 |
| SLC26A3 | CAGATCAGCAGTTCAGGA | TGTAGAGGCGCCAGGAGA | 13409 & 13410 |
| SLC27A1 | CCGAGTGCAACTGCAGCA | ATGCAGAGGCCCTGGGCA | 13411 & 13412 |
| SLC27A2 | GGGAAAATGTGGCCACCA | GAGGCCATGCCAATGCGA | 13413 & 13414 |
| SLC27A4 | CAAGCACAGAACACCTGGA | AGTACACCAGGGCAGCCA | 13415 & 13416 |
| SLC27A5 | CCGATGGAAGGGCGAGA | CAGGGAGCCAAGCGCGAA | 13417 & 13418 |
| SLC27A6 | GATGAGCAATGAGCCGGA | CCACAGGCGCGGATGCAA | 13419 & 13420 |
| SLC28A2 | GAAGCTGCCAGCAACGGA | CCACCATCTCAGCCACCA | 13421 & 13422 |
| SLC29A1 | CAGAGACCGCAGGAGCCA | TGCCCGGAACAGGAAGGA | 13423 & 13424 |
| SLC29A2 | CTCCACCAGTCCTGGGAA | TCTGGGGCACGTGGCACA | 13425 & 13426 |
| SLC29A3 | GCCAGGGCCCAATAGCAA | CCAGCAGGGAGCTGAGGA | 13427 & 13428 |
| SLC29A4 | GGGTGATCTGGGCCGACA | GAAGACCACACGCAGGCA | 13429 & 13430 |
| SLC2A1 | CCACGAGCATCTTCGAGA | AGGGTAGCTGCTCCAGCA | 13431 & 13432 |
| SLC2A13 | CACCTGGAATGGGACCAA | GTCTCAGGAAGACAGCCA | 13433 & 13434 |
| SLC2A2 | AAATTGGGCCAGGCCCGA | AAGGCCAGGAGCACTCCA | 13435 & 13436 |
| SLC2A3 | AAATTGGACCAGGCCCCA | AGTGAGCAGCGGAGGGGA | 13437 & 13438 |
| SLC2A4 | CCTGGGGACGCTCAACCA | AGAAGGGCAGCAGGACCA | 13439 & 13440 |
| SLC2A5 | GCTGTCAACTCCCCAGCA | CGACCAGGAGGGATCCGA | 13441 & 13442 |
| SLC2A8 | AGGGCGTGGCGACAGGCA | AAGCGGAGGCAAGCCAGA | 13443 & 13444 |
| SLC30A1 | CCTGACCCCTGCAAAGCA | AGCACCCAGCAAGGACCA | 13445 & 13446 |
| SLC30A10 | CAAGGGCTGTGCTAAGCA | GTGTCTAGAGAGGGCCCA | 13447 & 13448 |
| SLC30A3 | ACAAGGCAGCCGACCCCA | GATGGCCAGGTGTGCAGA | 13449 & 13450 |
| SLC31A1 | TGCAAACAGTGCTGCACA | CTTCCAGCTGAAGAGGAA | 13451 & 13452 |
| SLC31A2 | CGCAGAGACAGACGGGGA | TGAAGTAGCCGATGACCA | 13453 & 13454 |
| SLC34A2 | CTTGGAGGAGGCGCAGGA | TTGAGTCCGAGGCAGGGA | 13455 & 13456 |
| SLC34A3 | GCACATCCATCACCAGCA | GACCAGCACTGTGAGCCA | 13457 & 13458 |
| SLC35B1 | GGACCACATGCGGGCTCA | AAGCTCTGACCCAGGGCA | 13459 & 13460 |
| SLC35B2 | AGCTCCCCAGCCACCACA | GCCCACTGTGAAGAGGCA | 13461 & 13462 |
| SLC35D1 | CGTCGGCCGAAACGCTGA | CCACCCAGAGAACTGCCA | 13463 & 13464 |
| SLC35E3 | CGCCGGTGATCATAGCCA | GAGCCTGGTAGTACAGCA | 13465 & 13466 |
| SLC37A1 | GTCAGTGGGCCCTACACA | TGGCCGTCACGGTGGAGA | 13467 & 13468 |
| SLC37A3 | GCTAAGGAGACAGGCTCA | GGCAGACTCGAAGCCCCA | 13469 & 13470 |
| SLC38A1 | TGACAACGTGCAGTCCGA | AACCACGGTATGACGACA | 13471 & 13472 |
| SLC38A2 | CCACCTTAACACAGCCAA | ATGGGAAGAACAGCAGGA | 13473 & 13474 |
| SLC38A6 | GAACTTCACAGACAGCGA | TAAGAAGCCAGGAGAGCA | 13475 & 13476 |
| SLC38A8 | CTACTGCAGCATGCGCAA | AGATGAGGCAGCAGGCCA | 13477 & 13478 |
| SLC39A10 | CCAGTGGCACCACAAGCA | GCACCAATTGCGAGCCCA | 13479 & 13480 |
| SLC39A14 | GAAGCTGCAGAACGGGGA | GCGGACACCTTTCAGCCA | 13481 & 13482 |

FIG. 1 Cont.

| | | | |
|---|---|---|---|
| SLC39A4 | AGTCAGCGAGGAGAGCGA | CCACGTTGTGCAGCAGGA | 13483 & 13484 |
| SLC39A5 | AACAGCCAGCACCCACCA | ACAGCCCTGACTGGAGCA | 13485 & 13486 |
| SLC39A6 | CCACCACCAAAACCACCA | ATCACCATCCAGGCCAGA | 13487 & 13488 |
| SLC39A8 | TCAATGCAGGGATGAGCA | ATGCCTCCAGCAAGTGCA | 13489 & 13490 |
| SLC3A1 | ACCGCATACCTCGGGAGA | CTGCCACCAGTCTAGGCA | 13491 & 13492 |
| SLC3A2 | CTGCTCAGCACCCAGCCA | CGTAGGGGAAGCGGAGCA | 13493 & 13494 |
| SLC44A1 | GGTACGGTGGCAAAAGGA | CAGCACACATCGTGCACA | 13495 & 13496 |
| SLC44A3 | TCCACAGGCATCACGGCA | CAGTTCCCAGGCTCAGCA | 13497 & 13498 |
| SLC45A2 | AGGGCATGGACTGCGCCA | CCTATCAGTGCCACCGCA | 13499 & 13500 |
| SLC45A3 | AAGGCGTTCGGATGGGCA | AAGCTGTCACCACGGCCA | 13501 & 13502 |
| SLC46A3 | TCCAGGAGGAAGTTCAGA | ACGCTGGTTGCAAGAGCA | 13503 & 13504 |
| SLC4A1 | TCACGTCGCTCAGCGGCA | CGTGGACTTCACCACCCA | 13505 & 13506 |
| SLC4A10 | GCTGGACATGCATGCCAA | CAGGCTGGAGCAGACTGA | 13507 & 13508 |
| SLC4A4 | CCCTAGTAGGCGTGGACA | GCCGGGATAGCAGCAGCA | 13509 & 13510 |
| SLC5A5 | GCACAGCATCCACCAGCA | GGCTGCCACGGTGAGACA | 13511 & 13512 |
| SLC5A6 | GGCCGTCATCTGGACAGA | CGAAGGCCAAGGTCCAGA | 13513 & 13514 |
| SLC6A1 | GCTGTGCAGATGACGCCA | TGTACCCGGGGATGAGGA | 13515 & 13516 |
| SLC6A11 | ACCCCAAGGCGGTCACCA | ACTGGCTGTCCAGGCCCA | 13517 & 13518 |
| SLC6A12 | CCTAGGGCTGGACAGCCA | GGTAGCACATGACGGCGA | 13519 & 13520 |
| SLC6A14 | CCAGAGGCTCTAGCCCAA | AACCAAGCAGCAGCCCAA | 13521 & 13522 |
| SLC6A15 | GAATTCGGCGAGGCAGCA | GACACTGATCCCAAGGCA | 13523 & 13524 |
| SLC6A17 | GACCGTGAAGGAGGACCA | TGGCCTCAGTGAAGGCGA | 13525 & 13526 |
| SLC6A2 | GCCACTCACCTACGACGA | GCGTGATGCCATAGGCCA | 13527 & 13528 |
| SLC6A20 | CACGATGGAGGCTGGGAA | GCCCGTACACGTAGCACA | 13529 & 13530 |
| SLC6A3 | GGCAGTTCAGCGACGACA | CACCATGGCCATGGAGGA | 13531 & 13532 |
| SLC6A4 | GTCGCGCTGATCGAAGCA | CCCAGCAGATCCTCCAGA | 13533 & 13534 |
| SLC6A6 | CCTGGAATCGACCACCCA | AGGCGGGTGATGTCAGGA | 13535 & 13536 |
| SLC6A8 | CAGAGCAGGGCGTGCACA | GCACAACAGAGGGCCACA | 13537 & 13538 |
| SLC6A9 | CATCCCCCTCACCAGCCA | AGAGACGAAGCGCCAGCA | 13539 & 13540 |
| SLC7A1 | GAAGGGAGGCTCTCACCA | AGCACTGGCAGGAAGGGA | 13541 & 13542 |
| SLC7A10 | GCGACACGTACACGCTCA | CCAGCAGGAAGGCCCAGA | 13543 & 13544 |
| SLC7A11 | TGCTCCAGAACACGGGCA | CAGTAGCTGCAGGGCGTA | 13545 & 13546 |
| SLC7A14 | CCAGTGCTCTGAGCAGCA | TGGTCACGATGACCGCGA | 13547 & 13548 |
| SLC7A2 | GGAGGTGGCCAAGGCAGA | GCCAGTGATGAAGGCCCA | 13549 & 13550 |
| SLC7A5 | CCCTGGCCATCATCGGCA | TCCAGAAGGAGACGGCGA | 13551 & 13552 |
| SLC7A6 | CCAGGGACACTCTGAGCA | AGGGCAGAGTAGAGGGCA | 13553 & 13554 |
| SLC7A8 | CTGGCAACACAAGCCCAA | CCACCTCGGGGTACACGA | 13555 & 13556 |
| SLC8A1 | CCATCTACCACGCAGCCA | GATACAGCAGCACCCCCA | 13557 & 13558 |
| SLC8A2 | CTGACACGTTCGCCAGCA | CAATGCCCACGAAGGCGA | 13559 & 13560 |
| SLC8A3 | TGCAGCAGGGGATGAGGA | AGCCGAAGTGCGAGGCCA | 13561 & 13562 |
| SLC9A10 | CAGGTCCAAAGATACGCA | TACAGATGCCAGATGCCA | 13563 & 13564 |
| SLC9A3 | GCTGGAGCCCATTGACCA | CCTTCAGCCACTGCACCA | 13565 & 13566 |
| SLC9A3R1 | CAGTGACACCAGCGAGGA | TGGCCATGGCCAGGGAGA | 13567 & 13568 |
| SLCO1A2 | CATCCATTGGAACGGGAA | ATCCAGGTATGGCAGCCA | 13569 & 13570 |
| SLCO1B1 | GAATAGGGGAGACTCCCA | TTAAGCCACCAAGCTCCA | 13571 & 13572 |
| SLCO1B3 | ACAAGACGCTGCAATGGA | ACCAGCAAGAGAAGAGGA | 13573 & 13574 |
| SLCO2A1 | CCCGCATAGCTACCACCA | GGGTAGACTTCGGCCACA | 13575 & 13576 |
| SLCO3A1 | CCCGAAGGTCACCAAGCA | CCAGACAAGCACACGGGA | 13577 & 13578 |
| SLCO5A1 | GTGGCAACTCCACCGCCA | TATCCCACTGCAGGGCCA | 13579 & 13580 |
| SLIT1 | GGCAGATCCTCAACGGCA | GCAGATGCCATGCAGGCA | 13581 & 13582 |
| SLIT2 | TGGACCGCTGAGGAGCAA | ACACCTCGTACAGCCGCA | 13583 & 13584 |
| SLIT3 | GGTGGCCACTGACAAGGA | AGCGTCACCAGCTCCACA | 13585 & 13586 |
| SLITRK3 | CACCCTCACCACCCAGCA | AACAGCACCACCCCACCA | 13587 & 13588 |
| SLITRK5 | GAAGCTGTGGGTGGAGCA | CTATTCAACCGGACCGCA | 13589 & 13590 |
| SLITRK6 | CCATCCATGCCAACACAGA | CCACTATCCCTGCAGCACA | 13591 & 13592 |
| SLN | GCGAGGAGAAACCTGCCA | ACCTCACAAGGAGCCACA | 13593 & 13594 |
| SLPI | ACCTGAGTGCCAGAGTGA | GGGTGTCAACAGGATCCA | 13595 & 13596 |
| SLTM | GCCCGGAGAAGGAAAGCA | GCTTGACCAGAGGCCCCA | 13597 & 13598 |
| SLURP1 | GCAAGGAGCCCATGACCA | CTGCCTCCACCGTCACCA | 13599 & 13600 |
| SMAD1 | CAGCAACCCAACAGCCA | GGCGTATCAGCTGGCA | 13601 & 13602 |
| SMAD2 | GCAGAATACCGAAGGCAGA | GCAACGCACTGAAGGGGA | 13603 & 13604 |
| SMAD3 | GGAGCGGAGTACAGGAGA | ACAGCGGATGCTTGGGGA | 13605 & 13606 |
| SMAD4 | TCCACAGGACAGAAGCCA | GTCGATGACACTGACGCA | 13607 & 13608 |
| SMAD6 | TCAACCTGGAGCAGCGCA | CGCGGTTGTAGGCCCACA | 13609 & 13610 |
| SMAD7 | CACACTGGACAACCCGGA | CTCTAGCCAGCACGGGCA | 13611 & 13612 |
| SMARCA1 | GATGCCAGGAGAGTGGGA | AGTTGAGTAAGGCCCACA | 13613 & 13614 |
| SMARCA2 | GCCTTGATGGCACCACCA | TTTAAGCCCAGGCCACCA | 13615 & 13616 |
| SMARCA4 | CGTGGCTAACCTCACGGA | GGATCACCTTCACCGGGA | 13617 & 13618 |
| SMARCA5 | GCAACGAGCTCCAGGACA | GCGAATACACTGTCGCAA | 13619 & 13620 |
| SMARCAD1 | CCCAAGGCCTTCCTACCA | CTGGGCCCACCACCTGCA | 13621 & 13622 |
| SMARCAL1 | ACGTGCAGCACATCCGCA | TGATGGACAGCACGGCCA | 13623 & 13624 |
| SMARCB1 | GGAGGACCAGTCAGACCA | GCCCAACCCCAGCTCCGA | 13625 & 13626 |
| SMARCC1 | GGTCAGATACCAGGCCCA | GGTAGGGCCACTCCCAGA | 13627 & 13628 |
| SMARCC2 | CTCACCGTTCCCCAACCA | GGTTAGGAGGAGCGGGGA | 13629 & 13630 |
| SMARCD1 | CCTGGGCATCCATACCCA | GGTGGCATAAGCAAGGCA | 13631 & 13632 |
| SMC1A | CCCAGGCTGAGGAAGAGA | CGGCAATACGCTGAAGCA | 13633 & 13634 |
| SMC2 | GGTGCTCGATCCCAGGCA | TCTAGAGCCCGCAGCTCA | 13635 & 13636 |
| SMC3 | CAGCAACAGGAAAGGCCA | AGCAGTGACTTCCACGCA | 13637 & 13638 |
| SMC4 | GGTTCTAAGCCCAGAGGA | ACTCTGCGATGGCACCGA | 13639 & 13640 |
| SMG5 | GGAGGAAGCTCGTCGGAA | TGGCGGATGACAGGGAGA | 13641 & 13642 |
| SMG6 | GCCAGCAAAGAGGAGCCA | GGGATGTCCCGTACAGGA | 13643 & 13644 |
| SMNDC1 | TGAAGCGGAGATTGAGGA | GCATTGCCATAACCAGCA | 13645 & 13646 |

FIG. 1 Cont.

| | | | |
|---|---|---|---|
| SMOC1 | CAGCCAGCTGGACAGCAA | AGGCAGCCCTTCAGCTCA | 13647 & 13648 |
| SMOC2 | CCAGTGGAGACATCGGCA | TTTCGCCACGCCCAGGCA | 13649 & 13650 |
| SMOX | GCTCAAAGACAGCGCCCA | TGGCCGGACAGCAGAGCA | 13651 & 13652 |
| SMPD3 | GGTCCTGGAGAGTGAGGA | CCTCCCCCGAAGACACCA | 13653 & 13654 |
| SMPDL3A | GACTGACCCAGCCAACCA | AAGATGGCAGATACCCCA | 13655 & 13656 |
| SMPDL3B | CGAGTACCAGCTGACCGA | CAATGTCCACCTGGCGCA | 13657 & 13658 |
| SMR3A | AGACCCTATCCACCTGGA | GCAGGAGTAGGGAGGGCA | 13659 & 13660 |
| SMS | TACGCCAAAGAAGGGAGA | GGAGACGTGGAGATTGGA | 13661 & 13662 |
| SMTN | CTCAGAACCGACGCCAGA | ACCTCCACCAGGGGCACA | 13663 & 13664 |
| SMURF1 | TCTGGCAAGCGGTGGAGA | TGAAGCCTTGGAGCGGGA | 13665 & 13666 |
| SMURF2 | GATGAAGAGCGACGAGCA | GGCCTGCAGCACCTTGCA | 13667 & 13668 |
| SMYD1 | CGGGTGGACGTGGACACA | GACAGTACAGTTGGGCCA | 13669 & 13670 |
| SMYD2 | CCCCAAAGGCAGAAGCCA | TGTACAAGCAGACACCCA | 13671 & 13672 |
| SMYD3 | ACACTGGAAGTGGGAGCA | GCAGGCATCCATGGCGCA | 13673 & 13674 |
| SMYD4 | CCTGTAGCCCCAACACCA | ACAAGCTGGACAGGCGCA | 13675 & 13676 |
| SMYD5 | CGAGGCAGCAACTGGAGA | GCGCTCCCGCTGACAGCA | 13677 & 13678 |
| SNAI1 | GGCCCACCTCCAGACCCA | ACATCCTGAGCAGCCGGA | 13679 & 13680 |
| SNAI2 | GGCTCATCTGCAGACCCA | TGCTACACAGCAGCCAGA | 13681 & 13682 |
| SNAI3 | GCACCCACACAGGGGAGA | GGAGGGACATGCGGGAGA | 13683 & 13684 |
| SNAP25 | CGGAGTGGTGGCCAGCCA | CCAGGGCCATGTGACGGA | 13685 & 13686 |
| SNAP91 | CAGCAGGCGTTCCACCAA | GGCATGCCTGTCCCAGCA | 13687 & 13688 |
| SNAPC4 | GGCTGGGACTTCAGCCAA | GCCTGAGACTGTCCGAGA | 13689 & 13690 |
| SNCA | GAAGCAGCAGGAAAGACA | GCCACTGTTGCCACACCA | 13691 & 13692 |
| SNCB | CAAGCAGGGGGTCACCGA | AAGCCACACCTTGTACCA | 13693 & 13694 |
| SNCG | GCGAGGCTGTGGTGAGCA | CCCCGGAGGTGACCGCGA | 13695 & 13696 |
| SND1 | TGATGATGCCCGCACGGA | GCACCTCCACCATGACCA | 13697 & 13698 |
| SNED1 | GGCTACCACTGCGAGACA | TAGGTGACCGCGTAGCCA | 13699 & 13700 |
| SNN | CAGAGGACGAGGAGAGCA | TGGCCGAATACTGCACCA | 13701 & 13702 |
| SNRPA | AGCCCAAGAGCCAGGAGA | GGGATCTGGCCAGGTGCA | 13703 & 13704 |
| SNRPA1 | CGCGGTGCGCGACCGGGA | TCTGTCAGACAGGGCAGA | 13705 & 13706 |
| SNRPB | CCAGGCATGATGGGCCCA | GGAGGCCGCATTCCCGGA | 13707 & 13708 |
| SNRPB2 | CAGACTGCAACAACCACA | GGGTAATCAGGGACCTGA | 13709 & 13710 |
| SNRPD1 | CTCAGAGGCTTCAGCCCA | GCCAACCAAAGACAGCGA | 13711 & 13712 |
| SNRPD2 | GAGGTACCCAAGAGTGGCA | TTCCGCAGGACCACGA | 13713 & 13714 |
| SNRPD3 | GACATGCTGAAGAACGCA | TCCTCGGCCAGCCCCTGA | 13715 & 13716 |
| SNRPE | AGGGTCAGAAAGTGCAGA | TCATAGAGCCACACCTGA | 13717 & 13718 |
| SNRPG | GCAGACATGTCCAAGGAA | AGTCGCCATCTCCACACA | 13719 & 13720 |
| SNTB1 | GAAGCCTGGTTCAGCCCA | AAGGACAGATCCACACCA | 13721 & 13722 |
| SNTB2 | CAGGCTCTCGACAGGGCA | CTCAGCAGCAGCATGGCA | 13723 & 13724 |
| SNX10 | CGTGGATCAGCGTCGCCA | AAGAGGTGAAGGCTGCTA | 13725 & 13726 |
| SNX14 | AAGAGCAGTTGGACACGA | GGAAGCTGGGCATCAGGA | 13727 & 13728 |
| SNX2 | GACAGCCCTGAAAGGGAA | AGATCACGGGAGCAGACA | 13729 & 13730 |
| SNX29 | GTCCCAGATGAGGCAGGA | ACACTGAGGGGATCCAGA | 13731 & 13732 |
| SNX4 | TTGTGGAGAGGCGACGGA | GTGAGATGACAGACTGCA | 13733 & 13734 |
| SNX7 | GTCAGCGTCAGAAGAGGA | AGGGCCTCTGAGAGTCCA | 13735 & 13736 |
| SNX9 | GGCACTCACAAGGGAGCA | GCTCCAGGTACAGGCGGA | 13737 & 13738 |
| SOAT2 | GCCGAGAGCCCTTCAGCA | GCCAGTCATGGACCACCA | 13739 & 13740 |
| SOCS1 | CGACAGCCGCCAGCGGAA | GGACGGGGTTGAGGGGGA | 13741 & 13742 |
| SOCS2 | CTCTACACGTCAGCACCA | GGCAGTCCCCAGATGGCA | 13743 & 13744 |
| SOCS3 | CAGCCGTCTGCCCAGCCA | ACGGTCTTCCGACAGAGA | 13745 & 13746 |
| SOCS5 | GGACCGTTATGAAGCAGA | ACGGGTCATGGGCGTCGA | 13747 & 13748 |
| SOD1 | AGAGAGGCATGTTGGAGA | GTGCGGCCAATGATGCAA | 13749 & 13750 |
| SOD2 | GGGAGTTGCTGGAAGCCA | TCAATCCCCAGCAGTGGA | 13751 & 13752 |
| SOD3 | CGCCATCCACGTGCACCA | AGAGGCTGCCGTCGCGGA | 13753 & 13754 |
| SON | CCTGGCCAGTTCACAGGA | ATCCAGGCTTGGGCACCA | 13755 & 13756 |
| SORBS1 | GATCACACTGCTCCGGCA | CCACGTAGGTGATGGGGA | 13757 & 13758 |
| SORBS2 | GCCCGGAGAAATCGGAGA | CTCAGTGACAGCTCCACA | 13759 & 13760 |
| SORBS3 | GCCCCAGAACGAAGACGA | TGGGTCCTCCGGGAGACA | 13761 & 13762 |
| SORCS1 | GCAGGTCTCAGCTGGGAA | CCCTCCTCCACTCAGGGA | 13763 & 13764 |
| SORD | GCAAGCCGGAAGTCACCA | TCTCAGAGCCCAGCCCCA | 13765 & 13766 |
| SORL1 | GTGGGTCCCAGATGGAGA | CCTGAGGGCAGTCACACA | 13767 & 13768 |
| SORT1 | AGCCGAATGCCGTAGGCA | TGCCTCCAGAATCCAGGA | 13769 & 13770 |
| SOS1 | CCTCCTAGGCAACCCACA | AAGGGAGGGCTTTCAGGA | 13771 & 13772 |
| SOS2 | CCTGATACCCCTCCACCA | GGAGCTGGAGGATGAGCA | 13773 & 13774 |
| SOST | CACCCGCTACGTGACCGA | CGGGACACAGCAGCTGCA | 13775 & 13776 |
| SOSTDC1 | ATGGCCAGTGCACCAGCA | ACACCGCCACTCCTGGGA | 13777 & 13778 |
| SOX10 | CTGCCCACGGTCTCACCA | GATGGAGGGGAAGGCTGA | 13779 & 13780 |
| SOX15 | GCTGCCCACCTATACCCA | GTTAGGGGCATGGGGGCA | 13781 & 13782 |
| SOX17 | GAGGTGGACCGCACGGAA | GCAGTAATATACCGCGGA | 13783 & 13784 |
| SOX2 | ACATGAACGGCTCGCCCA | CTCGGACTTGACCACCGA | 13785 & 13786 |
| SOX3 | GCCTGCAGTACAGCCCAA | GCTGAGAGTGCGATGCGA | 13787 & 13788 |
| SOX5 | AGCCCAGGCCAAAGCGCA | GCAGGTGAGGGGAGGGCA | 13789 & 13790 |
| SOX8 | CAAGACGGAGCTGCAGCA | CGAACTCGTGGACGTCGA | 13791 & 13792 |
| SOX9 | CGACTACACCGACCACCA | GGGATGGAAGGGACCCCA | 13793 & 13794 |
| SP1 | CCAGATGCCCAACCCCAA | AGCGCAAGTGTGCCCGCA | 13795 & 13796 |
| SP110 | GAGAGCTGCTGAAGCGGA | ATGGAAGACTCGTGGACA | 13797 & 13798 |
| SP140 | TGGTCGCAGAGATCCAGA | CTCGGAGGCCCATAAGGA | 13799 & 13800 |
| SP7 | CACTTGCGCTGGCACACA | AGCGCTTGGAGCAGAGCA | 13801 & 13802 |
| SPA17 | GGGAAGGAGGAAGAGACA | CCCGGAAGGCAGCTTGGA | 13803 & 13804 |
| SPACA3 | ACAACGGGATCTTCCAGA | TCCGGCACACGTTGGGGA | 13805 & 13806 |
| SPACA4 | CACGACGGGCGTCAAGGA | CGTCATCGCCACAGTGCA | 13807 & 13808 |
| SPACA5 | GAACGGCTACAAGGGCTA | TCCACGAAGGCGGTGTCA | 13809 & 13810 |

FIG. 1 Cont.

| | | | |
|---|---|---|---|
| SPAG1 | CAGCAGCAACAGCAGCCA | AACCACGAACTGGAGGCA | 13811 & 13812 |
| SPAG11A | CCCACCTTACCAAGGGGA | GCCTGTCCCAGAATGGCA | 13813 & 13814 |
| SPAG17 | AGCCAGGCACCCTAACCA | CCCATGACCTTGACCGGA | 13815 & 13816 |
| SPAG4 | CCTCCATCGACCTGCAGA | CCGGCAGTTGGATCACCA | 13817 & 13818 |
| SPAG5 | GTGCGGAGACAGAGACCA | CACCTCCTGAGAGAGCCA | 13819 & 13820 |
| SPAM1 | CTTGAAGACCTGGAGCAA | AGTGTGGAGGGTGAAGCA | 13821 & 13822 |
| SPARC | AAGCGCCTGGAGGCAGGA | GCTGGTCCAGCTGGCCGA | 13823 & 13824 |
| SPARCL1 | GGGGACCAAAAAGGGGCA | TGGGATGGTCCCCAGCCA | 13825 & 13826 |
| SPATA13 | GCAAAAGCCAGCAGCGGA | CTGACGAGCTTGAAGGCA | 13827 & 13828 |
| SPATA18 | CTGAGACCGTTCAGCGGA | AGTCAACGACAGGAGGGA | 13829 & 13830 |
| SPATA20 | CTTCACGGGCCACAAGGA | GGCCTGACGGTCTCCACA | 13831 & 13832 |
| SPATA6 | CCCAAGTCCCAGGGCTGA | TTGGGTCGGCAGCAGCCA | 13833 & 13834 |
| SPATA7 | AGAAGGCCCAGAAGCACA | TGCGAGGAGTGAATGGCA | 13835 & 13836 |
| SPC24 | AGGCTGGGGAGGAGGACA | AGCCACGTACACGGCCGA | 13837 & 13838 |
| SPC25 | GGTTGAAAAGGCTGCAGA | GAGGGGCACTATCTGACA | 13839 & 13840 |
| SPCS1 | TACAAGGGCCAGAAGCTA | TATAGACAGTCCACCCGA | 13841 & 13842 |
| SPDEF | AGGAGAGCTGGACCGACA | CACCTAATGAAGCGGCCA | 13843 & 13844 |
| SPECC1 | CGGTGGTTCCAAGCGCAA | AGGGGATGTGGGCAGGCA | 13845 & 13846 |
| SPEG | TATACGCTGGAGCGGCGA | TGGGCAGCAGATGGCACA | 13847 & 13848 |
| SPHK1 | TGCACTCGCACCTGGGCA | AAGGCGACCACGGGCACA | 13849 & 13850 |
| SPHK2 | CTGCACACCTACCGCGGA | CCCCACCGTTGAGGGACA | 13851 & 13852 |
| SPHKAP | CGTCCATGCCAGACAGCA | GCAGAGACCGGATGAGGA | 13853 & 13854 |
| SPI1 | CCGAGAACAACTTCACGGA | GAGACCTGGTGGCCAAGA | 13855 & 13856 |
| SPIB | CGAGGCAGGGACTCGCAA | CTCCACCCACCACACGCA | 13857 & 13858 |
| SPINK1 | TGACTCCCTGGGAAGAGA | GTCCCACAGACAGGGTCA | 13859 & 13860 |
| SPINK13 | CTACAGACTCCTGGAACAGCA | GTGGGGAAAGGCAGCCA | 13861 & 13862 |
| SPINK14 | GGTACAATGGAACGGTCA | ACACACAGAATGCAGGGA | 13863 & 13864 |
| SPINK2 | AACGCCAAACTGCTCTCA | GGACATGTCACTGCCACA | 13865 & 13866 |
| SPINK5 | AGAGGAAGACAGCCCAGA | TGACAGAGCATGCAAGGA | 13867 & 13868 |
| SPINK6 | CTTCAGTCAGGGAGGACA | CTGGCCATCAGAGCCACA | 13869 & 13870 |
| SPINK7 | ATCCCCTGCCCCATCACA | CTCGGTACACAAGTGACA | 13871 & 13872 |
| SPINK8 | GGATCTGCTCAGACGCCA | AACCTGGTCACTGCCACA | 13873 & 13874 |
| SPINK9 | TACCACCAGGACAACAGAGA | GATGAGTAGGCAATGTGGCA | 13875 & 13876 |
| SPINT1 | CCCCAGTGACAAAGGGCA | CTTGGAGATGCCGCGACA | 13877 & 13878 |
| SPINT2 | TGAAGACCACTCCAGCGA | ACCACCACCTTTGAGCCA | 13879 & 13880 |
| SPN | CTCCAACGACCTCCACCA | CGCCACAGCAGGAGCAGA | 13881 & 13882 |
| SPNS1 | GTGACACCGGGTCTAGGA | AATGCCGGAGCCCACAGA | 13883 & 13884 |
| SPO11 | AGCGGCTCCTAGATGACA | TCAGAAGGGAGAAGACCA | 13885 & 13886 |
| SPOCK1 | CAGCTCCAACACAGCCCA | CTGAAGGGTCAAGCAGGA | 13887 & 13888 |
| SPOCK2 | GGCTCAAGGAGGGCGAGA | GTACTGCGAGATGGACGA | 13889 & 13890 |
| SPOCK3 | CAGAGACAGCAAGACCCA | CACTGTCCAACACTGCCA | 13891 & 13892 |
| SPON1 | AAGGGCATGCGAACCCGA | TTCCGACCACTGGGACCA | 13893 & 13894 |
| SPON2 | TCGGGACCAAGAGCAGGA | GCAGTTATCAGGGACGCA | 13895 & 13896 |
| SPOP | CGTGGAGAACGCTGCAGA | TCCAAGACATCCGAAGCA | 13897 & 13898 |
| SPP1 | TGGACAGCCAGGACTCCA | TGGGGACAACTGGAGTGA | 13899 & 13900 |
| SPP2 | CGGGCATTCAGAAGCTCA | CCCTGCACCTGCTGGGCA | 13901 & 13902 |
| SPPL2A | CAACCAAGGACTACTGCA | GGCAGCTTCCCCATGGAA | 13903 & 13904 |
| SPR | CCTCCGTGGACCCAGACA | ACACCTTGCAATCCACCA | 13905 & 13906 |
| SPRED2 | ATGTCGGACCCCGAGGGA | GTGCTTCCCGCCACAGCA | 13907 & 13908 |
| SPRR2B | AAGCAGCCCTGCCAGCCA | TGGGCAGGGCTCAGGGCA | 13909 & 13910 |
| SPRR3 | CTGAGCAAGGATACACCA | GGAGTGACCGTTGAAGGA | 13911 & 13912 |
| SPRY2 | CGCCTACAGGTGTGAGGA | AGAGGGACATGACACCCA | 13913 & 13914 |
| SPRY3 | GAAGGGAGAAGCTGAGCA | ACTAGGCCCACAAGAGCA | 13915 & 13916 |
| SPRY4 | CTGACCAGGCCTCACCAA | CTGGTTGCAGACCCAGCA | 13917 & 13918 |
| SPRYD3 | GGAGCATGAGGGCAGGAA | TCTCCCCGCAGCTCAGCA | 13919 & 13920 |
| SPSB1 | GCCACTGTGAGATCCGAA | CCTTGAGGGAAGCCGGCA | 13921 & 13922 |
| SPTA1 | GGCTCTCAGAGGCAGAGA | AAGTCCCGCTGGAGAGCA | 13923 & 13924 |
| SPTAN1 | TGAGGAGGTCGGAGCAGA | AGCAGACTTCCACGGGGA | 13925 & 13926 |
| SPTB | TCCAGCTCAAGCGGGAGA | CGGAACTTGTCCCGCAGA | 13927 & 13928 |
| SPTBN1 | GGAAGGGAAGAGCACCGA | CGTTCAAGGGCTCCAGCA | 13929 & 13930 |
| SPTBN2 | GGTTGCACGGTCGACGAA | GCTTCTCCAGCGCACAGA | 13931 & 13932 |
| SPTBN4 | GGATGGATGGCATCGCCA | AGGTGGTCAGCTCAGGCA | 13933 & 13934 |
| SQLE | AGCAGCTCGAGGCCAGGA | GCAGAGCCAAGCACGCCA | 13935 & 13936 |
| SQRDL | GATCATCCAGGAGCGGAA | TCCACATCCACCCAACCA | 13937 & 13938 |
| SQSTM1 | TACCCACATCTCCCGCCA | CAGGAGCCTGGTGAGCCA | 13939 & 13940 |
| SRCRB4D | GTCAATGGAGCCCACCGA | AGCTGGCGGCACAGGACA | 13941 & 13942 |
| SRD5A1 | GGAGGAAAGCCTATGCCA | CAACATGCCCGTTAACCA | 13943 & 13944 |
| SRD5A2 | GCTCAGGAAGCCTGGAGA | AGCTCGCAGCCCAAGGAA | 13945 & 13946 |
| SRD5A3 | CAGGGAGGGGAGCTGGCA | CTCAGCACAGTTAGGCCA | 13947 & 13948 |
| SREBF1 | GGTCAGCTGATGGGGACA | AGCTGTCAGAGAGGCCCA | 13949 & 13950 |
| SREBF2 | GTGGCCACCTATGGAGCA | GCAGGTCACAGGTGAGCA | 13951 & 13952 |
| SREK1 | CAGAGAGAGAGAACGGGA | CCTGCTGGAACTACGAGA | 13953 & 13954 |
| SRF | GATGTACCCTAGCCCGCA | TCAGGAACACCTGGGGGA | 13955 & 13956 |
| SRGAP1 | CCTGCCACTTCCACGGAA | GCTTCAGCTGCACGCCCA | 13957 & 13958 |
| SRGAP2 | AGCAGCGCCTCATGGAGA | TGGGCACAGAGCTGGGAA | 13959 & 13960 |
| SRGAP3 | TGGAGAACCCAGCCGAGA | GCATGAGGGTAGGCCCGA | 13961 & 13962 |
| SRGN | ATCCTACGCGGAGAGCCA | AGCCGGAGCCGGAGCCGA | 13963 & 13964 |
| SRI | GCAGAGATGTCTGACACA | GCCATTCAGTACAGCCCA | 13965 & 13966 |
| SRL | AGGGGCGTGAATCCCAGA | CATTGATGAGAGGGGCCA | 13967 & 13968 |
| SRM | CTGACTCCTCAGACCCCA | CATAGGCCACCACGGGGA | 13969 & 13970 |
| SRP19 | AGGGAAGGCGAATCCCCA | ACAAGGCAGAGGCTCCCA | 13971 & 13972 |
| SRPK1 | GGCTGCAGAAGCAACAGA | GCTGGGGAGCAGTACTGA | 13973 & 13974 |

FIG. 1 Cont.

| | | | |
|---|---|---|---|
| SRPR | AGCATGGTGGCCGCACCA | CTGCCGTGTCCACCAGCA | 13975 & 13976 |
| SRPRB | CACTGGACAGTTCCAGCA | TGGCACTGCACTCCAGGA | 13977 & 13978 |
| SRPX | CATGAAGTGCTCCAGCGA | GCCGTTCTGACACCCACA | 13979 & 13980 |
| SRPX2 | CTGTCAGTCCAGCCGCCA | CGGTTGGAAGGATCAGGA | 13981 & 13982 |
| SRRM1 | CCACCCGTTCGAAGAGGA | TGGCTCAGGAGACCCGGA | 13983 & 13984 |
| SRSF1 | GGCCGTGGAACAGGCCGA | CCACTTGGAGGCAGTCCA | 13985 & 13986 |
| SRSF11 | AGCAGTTGTGGCACAGCA | CCAGGAAGCCCAAGTGCA | 13987 & 13988 |
| SRSF2 | ATCCGCACGAAGGTCCAA | CCTGGACCGAGACCGGGA | 13989 & 13990 |
| SRSF3 | CCTCCACCTCGTCGCAGA | TCTCTCCCGAGACAGCGA | 13991 & 13992 |
| SRSF6 | AGCAGGTCTCGGTCCCGA | TGGAACAGGTAGCGGCGA | 13993 & 13994 |
| SRSF7 | GTGTGGCGAAAAGGGACA | CCTGCTGCGTGAGCGAGA | 13995 & 13996 |
| SRXN1 | TCCGGGAGGACCCAGACA | TAGCGGTGGCAGCCCCCA | 13997 & 13998 |
| SS18 | GCAGCAGTACCCAGGGCA | ACCTGGACCACCCTGTGA | 13999 & 14000 |
| SS18L1 | CCAGCAGTACTACCCCGA | CGTGGACTCCTCGAAGGA | 14001 & 14002 |
| SSBP1 | GCGATCAGGGGATAGTGA | CTCTGAGGCCTGGCCGGA | 14003 & 14004 |
| SSC5D | GCCACAAGCATGGACCCA | AGGGGGTCAGGGGACACA | 14005 & 14006 |
| SSH2 | GCAGGGCTCACCAAACCA | GGGGATTCACAGGAGGCA | 14007 & 14008 |
| SSH3 | CTGCAAGAGCACAGGGCA | AGATCTGCAGCTGGCGCA | 14009 & 14010 |
| SSPN | CGGAGCCGCTCAGCAGGA | AGCAGGCCAACAAGCACA | 14011 & 14012 |
| SSR1 | CCCATGGGCGGACGACCA | AGGAGTTGATGAAGGCCA | 14013 & 14014 |
| SSR2 | CACCTGGACAGGGAGGAA | CGATGGAGGGAAGGGTCA | 14015 & 14016 |
| SSR3 | AGGCAGCTCCAAACAGCA | CGCGGAGGACTTGGCCGA | 14017 & 14018 |
| SSRP1 | CCGGGAGGAGAATGCCAA | ACTGGAGGAGCTGGCAGA | 14019 & 14020 |
| SSTR1 | ACAGCTGCGCCAACCCCA | GTCCATCCAGCTGAGGCA | 14021 & 14022 |
| SSTR2 | CCCCAGCCCTTAAAGGCA | GCTCACCTTGACCAAGCA | 14023 & 14024 |
| SSTR4 | TGATGCCACCGTCAACCA | CAGCAGCGCAGGCAGAGA | 14025 & 14026 |
| SSTR5 | CGCCAACAGCTGTGCCAA | AGCGTCCTTGGCACCAGA | 14027 & 14028 |
| ST14 | GTGTGACGGGAAGGAGGA | GACCAGCCAGTTGGGAGA | 14029 & 14030 |
| ST3GAL1 | CAACTGGCTGCAAGGGCA | AGTCCACCTCATCGCAGA | 14031 & 14032 |
| ST3GAL4 | AACTGCTGAGCCTGCCAA | CACAGAGGTGGAGGGCCA | 14033 & 14034 |
| ST3GAL5 | AGTGCACCAGTTGAGGGA | GTCGTACCCAGAATGGCA | 14035 & 14036 |
| ST3GAL6 | CTACTATGGGAATGCCACCA | TCACCAGGCAGCAACAGA | 14037 & 14038 |
| ST5 | GATGCGAGAGGCAGAGGA | AAGCGCCTGCAGTAGCCA | 14039 & 14040 |
| ST6GAL1 | CCTCCCATCCAAGCGCAA | ATAGAGCAGCGGGTGGTA | 14041 & 14042 |
| ST6GAL2 | TCCCATCCGTGCGGCAGA | TCAGGCGCTGCACCAGGA | 14043 & 14044 |
| ST6GALNAC2 | CAAAGGCTTCGAGCGCGA | GCATCACATAGTCGCGGA | 14045 & 14046 |
| ST6GALNAC3 | TGGGAAGGACAGAGTCCA | CCGTAGACGTGAATGCCA | 14047 & 14048 |
| ST6GALNAC4 | GTACCTGGCACACGAGCA | ACGGATGGGCGAACACGA | 14049 & 14050 |
| ST6GALNAC6 | CAAGATGCAGAAGCCCCA | CACACAACTCCACCGCGA | 14051 & 14052 |
| ST8SIA1 | AAGACAGGAACAGAGCCA | GGCATGGCATGGAAGCCA | 14053 & 14054 |
| ST8SIA2 | TGCTGCAACGGCTGCACA | CGCGAACGGCGTGCAGCA | 14055 & 14056 |
| ST8SIA4 | ACCAGGAGACGCAACTCA | GAAGAGCCAGCCTTTCGA | 14057 & 14058 |
| ST8SIA6 | GGAGGACATTGCAACCTA | GCCGGTGGACAAGCGGTA | 14059 & 14060 |
| STAB1 | GGCCTATGGCATCGACCA | CTGTGACCCCTCAGGACA | 14061 & 14062 |
| STAG1 | GGGAAGAAACAGCCCGAA | CCCCTTCCCACTGGAGGA | 14063 & 14064 |
| STAG2 | CAAGGGGAGAGCCATCCA | AGACATCAGTGGAAGCCA | 14065 & 14066 |
| STAG3 | GCTGCTGAGCCTCAAGCA | GGCTGATTGGAGGAGCCA | 14067 & 14068 |
| STAM | CCACCATCCGCAAACCCA | ACATCGGCAGTTGCAGCA | 14069 & 14070 |
| STAM2 | GCACATTACCCACCTGCA | GGCAGAGATCTCAGTGGA | 14071 & 14072 |
| STAP1 | CCGGAAAGAGGCAACTGA | CACTACCAGGCCTCAGGA | 14073 & 14074 |
| STARD10 | TCCTGGCTCCCAAGGCCA | ACAGCTCCGACAGCGCCA | 14075 & 14076 |
| STARD13 | CCCACATCAGCAGCCAGA | ACCCACCTGATCGAGGCA | 14077 & 14078 |
| STARD3 | CGTGGTCTCCCCAAGGGA | TGGCCGACTTGAGCACGA | 14079 & 14080 |
| STARD4 | GATACAGCCATGGCAAGCA | CAGGCCATGTAGCTGAGAGA | 14081 & 14082 |
| STARD7 | GGAGGTGATTGAGAGGGA | GACTCTGGCACACTCGGA | 14083 & 14084 |
| STARD8 | CTGGCTTGCAGGAAGGCA | GCATCAGGGCTTCCAGCA | 14085 & 14086 |
| STAT1 | TCCAGGCCAAAGGAAGCA | ACAGAGCCCACTATCCGA | 14087 & 14088 |
| STAT2 | GCCAGTGCCAGAGCCAGA | GCCAACAGTGGGTCACCA | 14089 & 14090 |
| STAT3 | CCAAGCGAGGACTGAGCA | CAGCCAGACCCAGAAGGA | 14091 & 14092 |
| STAT4 | GGCTCGACCAGCTTCAGA | AGTACCAACGGCCTCTGA | 14093 & 14094 |
| STAT5A | AGTCCGTGACAGAGGAGAA | GCATTGTCCCACAGCACA | 14095 & 14096 |
| STAT5B | GGCCGAAGTGCAGAGCAA | GTTGAACTGGGACCAGGA | 14097 & 14098 |
| STAT6 | GACCGTGGAAAGGGACCA | TGGAGGAATCAGGGGCCA | 14099 & 14100 |
| STATH | GAGTAAAAGAGAACCCAGCCA | GGCCATACCCATAACCGA | 14101 & 14102 |
| STAU1 | GCCACCTCTGATCAGCCA | GGTCCAACTCAGACAGCA | 14103 & 14104 |
| STBD1 | CCGGGTTGACCACGAGGA | GGAGCCTTAAGACTGCCA | 14105 & 14106 |
| STC1 | AGCGGAACCCTGAAGCCA | TCCAGCAGGCTTCGGACA | 14107 & 14108 |
| STC2 | AGGAGGTGAAGGAGGCCA | CCGAGGTGCAGAAGCTCA | 14109 & 14110 |
| STEAP3 | GCCCTCGTGCTGAGCACA | TGCGGCTGATGCAGGGCA | 14111 & 14112 |
| STEAP4 | GGCACAAAATACCGTCGA | ATCACTGAGCCAGGCTGA | 14113 & 14114 |
| STIL | TGAAGAGGAACCTCCCGA | GGTCCCCACAGATTCACA | 14115 & 14116 |
| STIP1 | CCCCAGGCACTCAGCGAA | CAATCAGACCCACATCCA | 14117 & 14118 |
| STK11 | ACGACACCTGCCGGACCA | GAGGGTGACCCCAGCCGA | 14119 & 14120 |
| STK19 | AGTCCTCACCGTCCGAGA | CCAAGCCGCACCACGACA | 14121 & 14122 |
| STK25 | GGAGCCCGTCAAGAGGCA | TCCAGCTCCTCCAGCGCA | 14123 & 14124 |
| STK31 | GAGAGCAGCCACCTACCA | GGACCATCAGATAAGCCA | 14125 & 14126 |
| STK38L | CACAGTTGGGACACCAGA | AAGACCACCAGTCACACA | 14127 & 14128 |
| STK39 | AAGGCCCACAGCAGCAGA | AGGTGACCACTTGACCCA | 14129 & 14130 |
| STK4 | GGAATCAGACCTCCAGGA | GATACAGAACCAGCCCCA | 14131 & 14132 |
| STOM | AGCAGAAGCGTCCCGCGA | CGGAGCTGAAGGGCTGCA | 14133 & 14134 |
| STOML2 | AGGCAGCAGGAGAGGCCA | ACATACTGCTCGGCCACA | 14135 & 14136 |
| STOX1 | GACCAAACAGACTCCGCA | CGCCAACTGGGTAATCCA | 14137 & 14138 |

FIG. 1 Cont.

| | | | |
|---|---|---|---|
| STRA6 | CTCCGAGGACAAGCAGGA | GTGTCACCAGTGAGCGCA | 14139 & 14140 |
| STRBP | TACCCACAGTGCACAGCA | AGAGCTGAAGACCCAGCA | 14141 & 14142 |
| STRC | GCAGCCATGGGCAAAGCA | TGGCTCACATGCCGACCA | 14143 & 14144 |
| STRN | GAAAACAGCCCCAGCCAA | AGTCCATCAGTACCACCA | 14145 & 14146 |
| STS | CCTTGCCTGAGGACAGGA | TCTGAGGGTGCCAGCGCA | 14147 & 14148 |
| STX11 | TGGAGAAGCAGGCCGACA | GCAGGGACAGCAGAAGCA | 14149 & 14150 |
| STX12 | TGATGAGCCAGCTAGGAA | GAAGGGGCAAGGACCCTA | 14151 & 14152 |
| STX16 | GGTGTGACAAAACGGCCA | CCCCTCCTGCTCGGAGCA | 14153 & 14154 |
| STX3 | ACCTAGAGCAGCTCACGA | AATCCGAAGGTCTGCCGA | 14155 & 14156 |
| STX4 | GGAACGTGGGCAGGAGCA | CTAGGAGGACGACGGTGA | 14157 & 14158 |
| STX5 | GAACGTGCTAGGAGCCCA | CACCGGTTGGAGGTGACA | 14159 & 14160 |
| STXBP1 | AGGACCCTATGCGAGCCA | AATCGGTGACGATGGGCA | 14161 & 14162 |
| STXBP6 | CACGGACAGGAAGCCAGA | CACGCTGTCAGCAGCTGA | 14163 & 14164 |
| STYK1 | ACCCAGTAGCTGCACACA | GGCAGCTTCTAGGCGCAA | 14165 & 14166 |
| SUCLA2 | GCAGCAACAGCAAAGGAA | CCTTTGGGAACGGAGACA | 14167 & 14168 |
| SUCLG1 | CCAACTGCCCTGGAGTCA | ACCTCCAATGCCAACGCA | 14169 & 14170 |
| SUCLG2 | GGCTGCTTCAAACCCGGA | AAGGCCCAACGAAGCCTA | 14171 & 14172 |
| SUDS3 | GAAACCTGCTCCAGCCCA | GCAGGCAAGTGCTCAGGA | 14173 & 14174 |
| SUFU | GTGACAGCTCCACGGCCA | AGTGCCGTCCATGCAGGA | 14175 & 14176 |
| SULF1 | AAGGAGGCTGCTCAGGAA | GTGAAGCAAGTGAGGCCA | 14177 & 14178 |
| SULF2 | CTCCAACCTCGTGCCCAA | CGATGGCCACTGAGCGGA | 14179 & 14180 |
| SULT1A1 | CTGGGGACTGGAAGACCA | TGAGGCTGCAGCCTGCCA | 14181 & 14182 |
| SULT1B1 | GGCTCGTAATGCCAAGGA | ACCAGGAACCATAGGCCA | 14183 & 14184 |
| SULT2B1 | CTACGAGGAGCTGCAGCA | CGCGACGGTGGTCCAGCA | 14185 & 14186 |
| SUMF1 | GCAGCCCAAAGGCCAGCA | CCATTGGGAGGGAAGGCA | 14187 & 14188 |
| SUMF2 | GCATCCTGGATCGACACA | CGTCTGCAGCACAGCGGA | 14189 & 14190 |
| SUN2 | CGAAGACCTGCAGCAGGA | GGATCCGCAGCTCCACCA | 14191 & 14192 |
| SUPT4H1 | CCAAGTGGCAGCGAGTCA | CCTTGGGGCAGGCGACCA | 14193 & 14194 |
| SUPT5H | GCTCAGGCATCGAGCAGA | CCAGGTAGGTGTCCCGCA | 14195 & 14196 |
| SUPV3L1 | GGCCCCACAAACAGTGGA | TCACATGGCACACCAGCA | 14197 & 14198 |
| SURF1 | GCCAACTTCCAGAGCACA | GTCCATACCAGGTCACGA | 14199 & 14200 |
| SUSD1 | CACGCCTCAGACTGAGGA | CTTTGGAGGGCCAGGGGA | 14201 & 14202 |
| SUSD2 | GCTGAGCTTCACCGAGCA | CAGGCAGCAGGACGGACA | 14203 & 14204 |
| SUSD3 | TGCAAACTGGTGCCACCA | GGAGGCAGCAGGTGAGGA | 14205 & 14206 |
| SUSD5 | AAGCGAGGGCATGACCCA | CCCTCAGTCTCGGAAGCA | 14207 & 14208 |
| SUV39H1 | ACATGGAGAGCACCCGCA | GCAGGACTCAGTCCCACA | 14209 & 14210 |
| SUV39H2 | AGCTGAAAGACGAGGACA | CGTATCGAGCCGCATCCA | 14211 & 14212 |
| SUV420H1 | AGACGACGCGGTACCAGA | CAACCGACGGGTGAAGGA | 14213 & 14214 |
| SUV420H2 | AGTGCTCTCCACCCACCA | CACGCACCACGTAAGGCA | 14215 & 14216 |
| SUZ12 | GGGGAAGTAGAACAGCAA | TGGACGGAGAGGTAAGCA | 14217 & 14218 |
| SVEP1 | GCCACCCATTGTGGACCA | CCCTGGGCATTGCAGAGA | 14219 & 14220 |
| SVIL | GTGGAGCTGGACGAGGAA | GACAGGCCACTTCCAGCA | 14221 & 14222 |
| SWAP70 | GGAGGAGGTTGGCAGCAA | ACACAGTCTGCCGGTCCA | 14223 & 14224 |
| SYAP1 | GTACGGCCCAAAACGCCA | TTACAGGCATCGAAGGCA | 14225 & 14226 |
| SYBU | CAGCCTGCGTGGAAGAGA | CCCACAGAACCGTGGGGA | 14227 & 14228 |
| SYCN | GTGGTCCCGGCAAGGCAA | CCTGCAGTAGAGCGCGGA | 14229 & 14230 |
| SYCP1 | TCAGACCCTGGGAGGCGA | CCTGCTCAAGCACGGGCA | 14231 & 14232 |
| SYK | CTACAAGGCCCAGACCCA | TGGACACCCTGCAGGGCA | 14233 & 14234 |
| SYMPK | GGCGCCACTCATCACAGA | AGCTGAGGTCGAGGAGGA | 14235 & 14236 |
| SYNCRIP | GGCAAAGACTTGGAGGGA | CTACCTCCACGCCCTCGA | 14237 & 14238 |
| SYNE2 | TGAGCTCCTGGAGCAGCA | TGCCGAACACCCTGGACA | 14239 & 14240 |
| SYNGAP1 | GCAGCAGGCAGAGAAGGA | CATTCCACGGTGGGGCCA | 14241 & 14242 |
| SYNGR1 | AAGCCGTCCTGTCCGACA | GGTTGGCCAGGTAGCAGA | 14243 & 14244 |
| SYNGR2 | CAAGGCTGGCGTGGACGA | ACCTGGGTAGGAGGCGTA | 14245 & 14246 |
| SYNJ1 | GCAGGACTTGCAGGCCCA | ACTCCAGCACGAGGAGGA | 14247 & 14248 |
| SYNJ2 | GCGATGAAGCCAGAGGCA | TTGGCAGCTGAAGCGCCA | 14249 & 14250 |
| SYNPO | GCCAGTCACGGATGGAGA | GGACCCCGTTCTCAGGCA | 14251 & 14252 |
| SYNPO2 | CCTTCTCGCCAACCCGAA | GAGAAGGCGTCAGGGGGA | 14253 & 14254 |
| SYNPR | GTAACCTCAGCATCGACA | GAAGACGAGGAGTCACCA | 14255 & 14256 |
| SYP | CGCCAGACAGGGAACACA | AGAGCACCAGGTTCAGGA | 14257 & 14258 |
| SYT11 | GATGACCAGACCCAGGGA | GGACAAGGAAGTGCAGCA | 14259 & 14260 |
| SYT12 | CGACAAGACCACAGCGGA | CACAATGGCTGGCACCGA | 14261 & 14262 |
| SYT13 | ACCCCGTGTGGAACGAGA | CTGCAGTGGCCAAGCGCA | 14263 & 14264 |
| SYT17 | GACCGGGGTCAAACGCAA | AATCAGCGCCTTCCACCA | 14265 & 14266 |
| SYT2 | CGGCCAGCCCATTGAGGA | CCGTGGGCACATAGCGCA | 14267 & 14268 |
| SYT4 | GCCAGCCATGGATGAGCA | TGTGAAGTGCAAGGCCAA | 14269 & 14270 |
| SYTL2 | CCAAACTCCCTGGAGCCA | CGACCATGGATTAGCCCA | 14271 & 14272 |
| TAB1 | CCAGCTGCAGGAGGACGA | GGAGGGCATGACAAGGGA | 14273 & 14274 |
| TAC1 | GAGACCCAAGCCTCAGCA | GAGCCTTTAACAGGGCCA | 14275 & 14276 |
| TAC3 | TAAGGAGCCACAGGAGGA | TGGAGCAGCTGGTAGAGA | 14277 & 14278 |
| TACC2 | CGATGCCCCGAAGAAGCA | TGAACACGGCGTCGGGGA | 14279 & 14280 |
| TACC3 | GCATCCAGTCGCTGGAGA | GGAGATGAGGTCGTCGCA | 14281 & 14282 |
| TACR1 | ATCTCCAGACCCAGGGCA | GGAGGTCAGGTCCAGGGA | 14283 & 14284 |
| TACR3 | CCCACAAGCGCATGAGGA | GAAGTTCTGGAAGCGGCA | 14285 & 14286 |
| TACSTD2 | GAGGGACATCAAGGGCGA | CCACCACGACCACCACGA | 14287 & 14288 |
| TADA2A | GGTAGACGGAGTGCACCA | CTCCAGGGACCAACCTCA | 14289 & 14290 |
| TAF1 | GCTCAGCAGCATCCGGAA | CGTATGCGCACATAGGCA | 14291 & 14292 |
| TAF10 | AGGGCACGGCCTCCGGCA | CGCTGAGGGCAGGGGTCA | 14293 & 14294 |
| TAF13 | GATGAGGAAGAAGACCCCA | GGTCATCCCCAAAGCCA | 14295 & 14296 |
| TAF15 | CGAGGAGGCTATGGAGGA | CGGTCTCCACCGTAGCCA | 14297 & 14298 |
| TAF1C | TACCACCCCAGAGGGACA | GGGGCTGAGAGCTAGAGA | 14299 & 14300 |
| TAF2 | TCCAAGCAGTCACCCACA | CGGGAGCTAGCTGGCCGA | 14301 & 14302 |

FIG. 1 Cont.

| | | | |
|---|---|---|---|
| TAF3 | CCGAGATGAGTGGGGCAA | TCGCACACTTGGGGCAGA | 14303 & 14304 |
| TAF6 | GCTCAGGTTCCACCACCA | CGGGGGAGGAACTGGAGA | 14305 & 14306 |
| TAGLN2 | AGATCCAGGCCTCCACCA | TCCGCTGCACACAGGCCA | 14307 & 14308 |
| TAL1 | CAAGCTGATCCCCACACA | ACTTCATGGCCAGGCGGA | 14309 & 14310 |
| TAL2 | CAAGGACCCCACCTGCCA | CTTGGACCAGGTGAAGGA | 14311 & 14312 |
| TALDO1 | GGAGCTCGAGGAGCAGCA | CCACATGCCAATCAAGGA | 14313 & 14314 |
| TANK | CCTGGAGACCATAATGCA | GGGGAATCGAGTGAGGGA | 14315 & 14316 |
| TAOK1 | GGAGGAACAGACCCGGAA | ACGCATTCAACAGCTCCA | 14317 & 14318 |
| TAOK2 | GGGGCAGTACGATGGCAA | TGACTGGAGCACGGGGGA | 14319 & 14320 |
| TAP1 | CCGCGGATAGCACCA | CTAGAAGCCGACGCACA | 14321 & 14322 |
| TAP2 | ACATGGACCGACAGCCAA | AGCGCCGTCACCTCACCA | 14323 & 14324 |
| TAPBP | CCGCTCTCAGAAGGCCGA | AGACAGCAGCCCAGCCCA | 14325 & 14326 |
| TAPBPL | CCAGGTTGTCCCACCAGA | GCCGTCTCTGAAGCCCCA | 14327 & 14328 |
| TARBP1 | GACAGTGGACAGGAGCCA | GGGCCCAGCATGGAGAGA | 14329 & 14330 |
| TARBP2 | CGGTTGCCGGAGTACACA | CCGTGTGCACTCGAAGCA | 14331 & 14332 |
| TARDBP | CAGAACCAGTCAGGCCCA | GCACCAGAATTAGAGCCA | 14333 & 14334 |
| TARS | CCCATGAACTGCCCAGGA | CAGCTAGCCGCAGAGGCA | 14335 & 14336 |
| TAS1R1 | GGACTGGAATGGACCCAA | AGGAAGGTCCCAGCCCCA | 14337 & 14338 |
| TAS2R4 | TCTCCCCAAAGATCCCCA | ACTGGAGAGATGAGCTCA | 14339 & 14340 |
| TAS2R60 | AACCTCAGGATTCCGAGA | GGGGTGAACTGCTGCACA | 14341 & 14342 |
| TAT | ATCCCTGGACTCCGGCCA | CGGGGACTGTGATGACCA | 14343 & 14344 |
| TATDN2 | GCCTGTCCCAGAACAGCA | GTAGCTGCCGGTGAAGCA | 14345 & 14346 |
| TAX1BP3 | AGGTGGAATCGACCAGGA | AGCAGGGCCTCCTTCAGA | 14347 & 14348 |
| TAZ | GCGTCTACCAGAAGGGGA | CATGCCACAGGGGCAGGA | 14349 & 14350 |
| TBC1D23 | TATGGCACTGCAGCAGCA | GAGCCTGAGGTACTAGCA | 14351 & 14352 |
| TBCD | CGCTGATCCGGAAGACCA | CGCCCAGAAGGTCACACA | 14353 & 14354 |
| TBK1 | CAACCTGGAAGCGGCAGA | GCCAGTGATCCACCTGGA | 14355 & 14356 |
| TBL1XR1 | GGAGGAGAATGGAGCACA | CAGACCCTGATGCTAGGA | 14357 & 14358 |
| TBL2 | CCAACGACTCACGGAGGA | TGCCACTGGCCAAGGCCA | 14359 & 14360 |
| TBP | CCACGCCAGCTTCGGAGA | CGGCGTTTCGGGCACGAA | 14361 & 14362 |
| TBRG4 | CCTGAACAGAGCGCAGGA | GCACACACAGGGCCCACA | 14363 & 14364 |
| TBX10 | CATCCGGGCTGATAGGGA | GGCCCCAGGCACACCACA | 14365 & 14366 |
| TBX18 | GCCATCACCCTCCAGCAA | CACTCGGTGAGGACCCCA | 14367 & 14368 |
| TBX2 | CCACATAGTGCGAGCCAA | ACAAGCGTAGAGACGGCA | 14369 & 14370 |
| TBX21 | GGACTGAGATTGCCCCCA | GGAGCTGTCACCACTGGA | 14371 & 14372 |
| TBX22 | AGACCTGGATGCGGCAGA | ACCTTCAGTGGGCAAGGA | 14373 & 14374 |
| TBX3 | CCGACCCCGAAATGCCAA | GGTATGCAGTCACAGCGA | 14375 & 14376 |
| TC2N | CAGTTCATCCCAGCACGGA | ACTGGGTACACTGGACAA | 14377 & 14378 |
| TCAP | CCCCATCCAGCTTCAGGA | GCACCGGGCTTGCTGACA | 14379 & 14380 |
| TCEA1 | AAGTACTTCCAGCGGCAA | CCCTACACTTCAACCGCA | 14381 & 14382 |
| TCEB3 | TACCCGCGATACAGGCCA | GGCACACTTGGAACCAGA | 14383 & 14384 |
| TCERG1 | ACGACCAGTAGCCCAGCA | GTGGCTGTAGGAGCAGGA | 14385 & 14386 |
| TCERG1L | CCAAGCCAGAGGAGGCAA | CCCCTCTCTCCAGCAGCA | 14387 & 14388 |
| TCF12 | GTACCAGTCAGTGGCCAA | GTGGAAGGTCCCACAGCA | 14389 & 14390 |
| TCF19 | CGTCCTCGGAAGTACCCA | TGCAGCCAACACAGGCCA | 14391 & 14392 |
| TCF20 | TGCAGCACAGCACAGGCA | GACATTAGGCAGCGCCCA | 14393 & 14394 |
| TCF21 | TCGCCCACTTGAGGCAGA | ATAAGCGGCTCGCGGTCA | 14395 & 14396 |
| TCF3 | GCAAGTGCGAGAGCGGAA | TGGGGGTCTCCAACCACA | 14397 & 14398 |
| TCF4 | GGAGCAGCAAGTCCGAGA | GCCAAGGAGAGAGGGGGA | 14399 & 14400 |
| TCF7 | GCGGTCGAGGGAAAAGCA | CACTGTCATCGGAAGGAA | 14401 & 14402 |
| TCF7L1 | CCTCTCCCTCACCACCAA | GCTGTGGGCATGGACCCA | 14403 & 14404 |
| TCF7L2 | CGCTACACACGACGGGCA | CTATGGAGTGAGCCGACA | 14405 & 14406 |
| TCHH | GGAGCAGAAACGTCGCCA | AGAGAGGGCTGGAGCGCA | 14407 & 14408 |
| TCIRG1 | CCACACTCATCCGCACCA | GGCCCATAAGCAGGAGCA | 14409 & 14410 |
| TCL1A | CTATGACCCCCACCCAGA | GGTACACTAAGCGCCAGA | 14411 & 14412 |
| TCN1 | TCCAAACGCTGCAGCCCA | TAGGCTCATCAGCGGAGA | 14413 & 14414 |
| TCN2 | GACTGTCTGGCACCACGA | GCGGCAAGAGACTAAGCA | 14415 & 14416 |
| TCOF1 | GTGAGGACAGCAGCGACA | GAGACTGGGATGGCGCCA | 14417 & 14418 |
| TCP1 | GGGGGTGCTGTAGAAGCA | CGCAAGCTGTTCCCGAGA | 14419 & 14420 |
| TCP11 | GGCAGCCAACAACCCAGA | CCAGCAAGACTGAGGCCA | 14421 & 14422 |
| TCTEX1D4 | CCACGCTACAAGCTGGTA | GGACCGTGGCCACCGCGA | 14423 & 14424 |
| TCTN1 | GCTGAATCCACAGGCCAA | GGTGCAGACACATCCACA | 14425 & 14426 |
| TCTN2 | CGTTGCAATGAGAGGCAA | CGGATGCTCAGGTGAGCA | 14427 & 14428 |
| TCTN3 | TCAACAGGCACTGCAGCA | TGCGGGTTGGACAGGAGA | 14429 & 14430 |
| TDG | GGCTGCTTACAAAGGGCA | GACCTCACTGAGCCCTGA | 14431 & 14432 |
| TDO2 | CGGCTGTCATACAGAGCA | GAGGAACCACCGGTGCCA | 14433 & 14434 |
| TDP2 | AATGCAAGAGGCTCCAGA | AACTCCCAGACATCCACA | 14435 & 14436 |
| TDRD1 | CAACTGCAAAGTGGCCGA | CTTCAGAAGCGTAAGCCA | 14437 & 14438 |
| TDRD10 | CCACCCCTGACTCAGCCA | TAGGATGTGCAACGCCGA | 14439 & 14440 |
| TDRD3 | GGAACTGAAGGTGGACCA | CTTCTAGCACCACCACCA | 14441 & 14442 |
| TDRD5 | GCCTGGAGTCAGTGACCA | AAGGCCTGAAGGCTGCCA | 14443 & 14444 |
| TDRD6 | TGTGCCATCCCCACCGCA | CCCGGTATACCTGGGCCA | 14445 & 14446 |
| TDRD7 | CTGACTCTCCCAACAGCA | GCCACAGGCACATACACA | 14447 & 14448 |
| TDRKH | ACCTCAGGGCTCTCAGGA | CACTGGTCACCTGAGGGA | 14449 & 14450 |
| TEAD4 | GCAAGCAGGTGGTGGAGA | TGGTGACCACCTGCAGGA | 14451 & 14452 |
| TEC | CAGCCGCTTCAGCAGCAA | GGTGGCCTCGAGTAACCA | 14453 & 14454 |
| TECTA | GCTGGGTGAAGAGGGACA | TGGGGATCAGGCTGCACA | 14455 & 14456 |
| TEK | GGGCTCCAGTGTGAGAGA | GTAGGTAGCGGCCAGCCA | 14457 & 14458 |
| TEKT2 | CACCGACGAGGTTCACCA | GGTGTCCAGCAGCATGGA | 14459 & 14460 |
| TENM4 | GACTAGCCCAGACCACGA | TCCAAAGGTGAGCAGCCA | 14461 & 14462 |
| TEP1 | GATGATCACGAGGGCGGA | ACCCTTTGGCCAGCCAGA | 14463 & 14464 |
| TEPP | CCTGAGGAAGCGAGCGGA | CTGCCCACGCCCCACACA | 14465 & 14466 |

FIG. 1 Cont.

| | | | |
|---|---|---|---|
| TERF1 | GAGAAACGACGAGGAGCA | GGCAGAGGAAATCGAGCA | 14467 & 14468 |
| TERF2IP | GGATAGCGGGGAACCACA | GGGCTCTCATCCACCACA | 14469 & 14470 |
| TERT | GCTACGGCGACATGGAGA | CGCAGCCATACTCAGGGA | 14471 & 14472 |
| TES | GACAGCGAGAAACCCCGA | GGCATCCTTGACACACCA | 14473 & 14474 |
| TET1 | CGGCTTGGCAGCAAGGAA | CCTGTGGGGATGAGCACA | 14475 & 14476 |
| TET2 | CCAAGGTACAGTGGACCA | TGCCACACAGTGACTGCA | 14477 & 14478 |
| TEX101 | CATCCCGGAAGGGGAGGA | AGCCACACAGGTTGGACA | 14479 & 14480 |
| TEX11 | AAGATGCTCTGAGCCACA | GGACTTGACCATCAGCCA | 14481 & 14482 |
| TEX264 | CCTTCCCCTACACCACCA | TAGATCTCCAGCCGAGGA | 14483 & 14484 |
| TF | CCGAAGACTGCATCGCCA | CTGCCAAGACAGGCACCA | 14485 & 14486 |
| TFAM | GCCCAGCGTTGGAGGGAA | ACCTGCCACTCCGCCCTA | 14487 & 14488 |
| TFAP2A | CGTGGTGAACCCCAACGA | CAGCGACGCGTTGAGACA | 14489 & 14490 |
| TFAP2B | GCAGGCGCAAAGCAGCAA | GAGACGGCTTTGGCGGGA | 14491 & 14492 |
| TFAP2C | CCTCCCCTGTCAGAAGGA | AGCATTCAGGTGGGGACA | 14493 & 14494 |
| TFAP2D | CCTGCCTGGACGAGCAGA | TTGACCACACAGGTGCCA | 14495 & 14496 |
| TFAP2E | CTCATCCTGGAGCCCGGA | TGGAAGGCAGTGAGGGCA | 14497 & 14498 |
| TFB2M | ACCAAGTAGACCTCCACA | AGCGCAACCACTTTGGCA | 14499 & 14500 |
| TFCP2 | GCAACAGCAGCAGAAGCA | GCTGATCTGGCAAGGGGA | 14501 & 14502 |
| TFCP2L1 | GATCCAGGATGCCCAGCA | TGGCGTTGAAGAGCCGGA | 14503 & 14504 |
| TFDP1 | CCTGACCAACGGTGCAGA | CCGACGTAGGACACCGGA | 14505 & 14506 |
| TFDP2 | GCCACCTTACCCCAGTCA | GAGCAGTGAGAGGCCGCA | 14507 & 14508 |
| TFE3 | GCAGCCTGCAGCTCCGAA | TGCAGGTCCAGAAGGGCA | 14509 & 14510 |
| TFEB | CAGGGAGCTGGAGAACCA | GTTCATGCCGGACGGGGA | 14511 & 14512 |
| TFEC | CACCAAACAGCAGAGCCA | GAAGTGGCAGATAGCAGAGGA | 14513 & 14514 |
| TFF1 | CCTCGGCACCCTGGCCGA | CACACTGGGAGGGCGTGA | 14515 & 14516 |
| TFF2 | GGCATCAGCCCCGAGGAA | GGAAGAAGCACCAGGGCA | 14517 & 14518 |
| TFF3 | CCACAGCCAGGAGGGAGA | GGTTTGCAGACAGGCCCA | 14519 & 14520 |
| TFG | GGATATGGCCAGCAACCA | CCAGGTTGAGAGGCAGGA | 14521 & 14522 |
| TFIP11 | GCCTACATGCAGCCAGGA | GCACAGAGCTAGCGGCCA | 14523 & 14524 |
| TFPI2 | CGGTGGGTGTCACCGGAA | TTGGTGCGCAGAAGCCCA | 14525 & 14526 |
| TFPT | GGAGGATGAGGGCAGCCA | GGCGTCCATCCCGTGGCA | 14527 & 14528 |
| TFRC | GGCACGAGCAGCTGCAGA | ACGAGCAGAATACAGCCA | 14529 & 14530 |
| TG | GGGAATCCGGCTGAGGAA | AGGTAGACTGAGCCGCCA | 14531 & 14532 |
| TGFA | GCCAGAAGAAGCAGGCCA | GGCAGCAGTGTATCAGCA | 14533 & 14534 |
| TGFB1 | GCTTCAGCTCCACGGAGA | CCGAGGCAGAAGTTGGCA | 14535 & 14536 |
| TGFB2 | CAGTGGGAAGACCCCACA | TACGGGCATGCTCCAGCA | 14537 & 14538 |
| TGFB3 | ATCTGCCCACACGGGGCA | CCCAGATCTCCACGGCCA | 14539 & 14540 |
| TGFBI | CAGCCTCCAGCCAACAGA | ACAGGGGCTAGTCGCACA | 14541 & 14542 |
| TGFBR1 | AGGACTGGCAGTAAGACA | CGAGAACTTCAGGGGCCA | 14543 & 14544 |
| TGFBR2 | AGCCCAGTGTGTGGCAGA | AGGGAGCCGTCTTCAGGA | 14545 & 14546 |
| TGFBR3 | CCTGCTCAACTCCCCACA | CCACAGAACCCTCAGACA | 14547 & 14548 |
| TGFBRAP1 | CAGTGGCAAGGGTGCAGA | CCTGCAGCTCGTGCACCA | 14549 & 14550 |
| TGIF1 | CCAACCCTAGGGAGGCCA | TTGTCCCACACCGACCGA | 14551 & 14552 |
| TGIF2 | GCCGCTTCACTCAGGCCA | GGGGCTTGGGAGACTCCA | 14553 & 14554 |
| TGM1 | TCCCGTCACCCTCACCAA | CCTGGTCGCACAGGCACA | 14555 & 14556 |
| TGM2 | GCCGAGAAGGAGGAGACA | ACAGAGCAGGAGGCGGCA | 14557 & 14558 |
| TGM3 | AGGAACAGGAGCCCAGCA | CAGGGACATTGTGGCAGA | 14559 & 14560 |
| TGM5 | CAACCTTCCAGGCCCACA | TGCAGCAGAGACTGGGCA | 14561 & 14562 |
| TH | GCAGCCCTACCAAGACCA | CGCTGGATGCGTGAGGCA | 14563 & 14564 |
| TH1L | GCTGGACGTGATGGAGCA | GAGCAATGACGTCCAGCA | 14565 & 14566 |
| THBD | CAGCGCTGTGTCAACACA | GGCACTGGTACTCGCA | 14567 & 14568 |
| THBS1 | ACTCGTGCCCAATCCCGA | CCTACAGCGAGTCCAGGA | 14569 & 14570 |
| THBS2 | CTGTGAGGACCTGGACGA | GGCAGGCAGTGGAAGCCA | 14571 & 14572 |
| THBS3 | GGGATGGGCATCAGGACA | ATTGGGTACCAGGCGGCA | 14573 & 14574 |
| THBS4 | CTGCCCAGAGAACGCAGA | CTGGTTCAGGACCACCCA | 14575 & 14576 |
| THEG | CCCAAATGGCAGTCCCCA | ATCTCGGTCAGGAACGCA | 14577 & 14578 |
| THEM4 | CCTTACCTGGAAGGACCA | CCCCCAGCCATCATTGCA | 14579 & 14580 |
| THNSL2 | CGTGGCAGTGAACCGCAA | AGAGCCAGAGAGCAGCCA | 14581 & 14582 |
| THOC3 | TGCCACAGGAAGTGCAGA | CCGATGCTGACGCCAGCA | 14583 & 14584 |
| THOC4 | TGGAGTCTCAGACGCCGA | TCCTAAGCTGCGACCAGA | 14585 & 14586 |
| THOC5 | CGAAAGGGGCACAGCCAA | CATCCAGCAGCACACACA | 14587 & 14588 |
| THPO | AGGCTCCCTGCCACCCAA | GGTGGGCGTTGGAGCAGA | 14589 & 14590 |
| THRA | CAGCTTGGTGAAGCGGGA | ACCGCTCGGGCATGGAGA | 14591 & 14592 |
| THRAP3 | TGAGCAGGAGGCAGCCAA | AGGCGGAGATCAACAGGA | 14593 & 14594 |
| THRB | GGGTGGTGTCAGACGCCA | CAGGCAAGCCCCGGGCGA | 14595 & 14596 |
| THRSP | ACCGCAGAGACAGAGGAA | GGAGGCTGGAGAAGTGCA | 14597 & 14598 |
| THSD4 | CTCACCGAGTGGAGCGAA | GGTCATGCACACCACCGA | 14599 & 14600 |
| THSD7A | GCACCTCAAGCGTGCCAA | TGGGTAAGGGCTGGCACA | 14601 & 14602 |
| THUMPD2 | ATAGCGTGGGCAATGGCA | GAGTCGCTGACATCAGCA | 14603 & 14604 |
| THY1 | CCGTGAGACAAAGAAGCA | AGGCGGATAAGTAGAGGA | 14605 & 14606 |
| TIAL1 | ATGGCAAATGGGTGGCAA | CCTTGGGGAGGCTGAGCA | 14607 & 14608 |
| TIAM1 | GGCGAGTGCAGATGCAGA | CCCCCTTCAGTGCACACA | 14609 & 14610 |
| TICAM1 | GCAGGACGCCATAGACCA | GTGCAGGCTCAGGCGACA | 14611 & 14612 |
| TICAM2 | TGAAGCCCTCAGAGTCCA | GCAGACCCATTTACAGCA | 14613 & 14614 |
| TIE1 | CCCTCTCAGACTCCGAGA | GCCACCTGCACCTCCACA | 14615 & 14616 |
| TIGIT | AGGAGGAATGGAGCCCCA | GTCATGCAGCTCGGCACA | 14617 & 14618 |
| TIMELESS | GCCTGAGGAAGACAGCGA | TGGAACGGCCTGGGAGCA | 14619 & 14620 |
| TIMM10 | CAGTGCCTGCCACCGGAA | TAGAGACACATCGGTCCA | 14621 & 14622 |
| TIMM13 | CGTGGCCAACGCGCAGGA | TTGTCCAGGGAGCCCCCA | 14623 & 14624 |
| TIMM17A | AGGGCTCCACAGTTAGGA | GCTCCCGTTAAGGCACCA | 14625 & 14626 |
| TIMM50 | GCACTATGCCCTGGAGGA | CAAGCGGCTGGTGAGGGA | 14627 & 14628 |
| TIMM8B | CGAGCAGCAGAAGGCGCA | GCGGTCTACACAGCTGGA | 14629 & 14630 |

FIG. 1 Cont.

| | | | |
|---|---|---|---|
| TIMM9 | CTGGCAGCCAAAGCAGGA | GGCTACTGCTTTCAGGGGA | 14631 & 14632 |
| TIMP1 | GGGCTTCACCAAGACCTA | TGGCTCCCGAGGCAGGCA | 14633 & 14634 |
| TIMP2 | GGGACGGCAAGATGCACA | GCACGGGATCATGGGGCA | 14635 & 14636 |
| TIMP3 | AGAGGTGGGACCAGCTCA | GGAGAGCATGTCGGTCCA | 14637 & 14638 |
| TIMP4 | CATCGAGCCCTGGGAGGA | TGGCAGCCACAGTTCAGA | 14639 & 14640 |
| TINAGL1 | TGATGCACAGCCGAGCCA | AGGGCTTGGACAGGGCCA | 14641 & 14642 |
| TINF2 | GCCTCGAAGCTGCAGGAA | AGCCACCCCATGTCCACA | 14643 & 14644 |
| TIPARP | CACCAGCTCACTTCCAGA | AACACGAGGTCAAGGGAA | 14645 & 14646 |
| TIRAP | CTGCAACTCCGGGATGCA | GGCCCGACAGCAGGGGGA | 14647 & 14648 |
| TJP1 | TCTGCCGGGACAACAGCA | CACAGTGTGGTAAGCGCA | 14649 & 14650 |
| TJP2 | TGATGCCGAGGAGGAGGA | GTCCCGGTATCGGGCAGA | 14651 & 14652 |
| TJP3 | CTGACCTCAGCTGCGACA | GCCGAGATTCTCCCACGA | 14653 & 14654 |
| TK1 | AGGCATCGACGAGGGGCA | CTTCCCGGAAGCACTCCA | 14655 & 14656 |
| TK2 | GAAATGTCCGTGGCCACA | CCAGCATGGTGAGCTGCA | 14657 & 14658 |
| TKT | CCATCAAGCCCCTGGACA | CCACTACTGCACTGGACA | 14659 & 14660 |
| TKTL1 | CAAGGTGGCATCGGGGAA | TCCCGACACTGCCAGCGA | 14661 & 14662 |
| TKTL2 | GCCGCCAATACCAAGGGA | CATTGACACCGTGGCGGA | 14663 & 14664 |
| TLE1 | GCCACACAGACGGAGCCA | ACGTGCAGCACCTCCACA | 14665 & 14666 |
| TLE3 | CCGACAGCTACAGCAGCA | ACTTGCCGCAGTAGGCGA | 14667 & 14668 |
| TLE4 | CCCACGCATCAAGGCAGA | GCAGATCCCACACAGCGA | 14669 & 14670 |
| TLK1 | CAGCTGGCAAATGACCCA | AGAAGGGGGTGTAGGGGA | 14671 & 14672 |
| TLL2 | GGCAGTGCACAGCACAGA | AGCCGTCCTCTGCCACGA | 14673 & 14674 |
| TLN1 | TCACCATGGCAACCGCCA | CCTTGCAAGCCCGAAGCA | 14675 & 14676 |
| TLR1 | CCTCCCAGGATCAAGGTA | AAGCTGCCACATCCAGGA | 14677 & 14678 |
| TLR10 | AGCCACAACGACACTGGA | AATACCTGAGACCTGCCA | 14679 & 14680 |
| TLR2 | GCAGCAAGCACTGGCCAA | CCGTGAGCAGGATCAGCA | 14681 & 14682 |
| TLR3 | ACAGGCCAGGAATGGAGA | AGGCTTGGGACCAAGGCA | 14683 & 14684 |
| TLR4 | GATCAAGGACCAGAGGCA | TGCAGCCAGCAAGAAGCA | 14685 & 14686 |
| TLR5 | TCCCAGGAGAAAACCGCA | CTGGTACTGGGACAAGGA | 14687 & 14688 |
| TLR6 | TCGGCGCAGGGCCAGGAA | CACCACTCACTCTGGACA | 14689 & 14690 |
| TLR7 | GGAGCACACAAGGGCCAA | TGGCCACCAGCTCAGCCA | 14691 & 14692 |
| TLR8 | GCACATCCCAAATGAAGCA | GTCAAGCAACTCGAGACGA | 14693 & 14694 |
| TLR9 | CAGACTGGGTGTACAACGA | GGCTGCCATAGACCGA | 14695 & 14696 |
| TLX1 | AGGAACGGGAGGCCGAGA | TGCACGCACAGAGGGTCA | 14697 & 14698 |
| TLX3 | CGACTCCATCCAGCCTGA | AGGGAGGTGACAGCGGGA | 14699 & 14700 |
| TM2D2 | CGGTCAGGCCTACAGCGA | AAGGTCCTAGGACTGGCA | 14701 & 14702 |
| TM2D3 | CTGCACGGTGCGGGACCA | CCAGGCCACCGAAGCTGA | 14703 & 14704 |
| TM4SF1 | TGCACGATGCATCGGACA | TCATGGCCACAGCAGCCA | 14705 & 14706 |
| TM6SF1 | GAGTCCCTGAAGAAGCAA | TAGGCCAAGAGCTGAGGA | 14707 & 14708 |
| TM7SF2 | ACCATCTCTACAGCCACA | AGGGCAAGGACCAAGCCA | 14709 & 14710 |
| TM7SF3 | GGACAGACCAGGACTCCA | GCCTTCACCTGGGGCACA | 14711 & 14712 |
| TM7SF4 | TGGAACCAGACCCTGGCA | CGCTTCATGAAGAGGCCA | 14713 & 14714 |
| TM9SF1 | CCGGCAGATTGGAGGCGA | CCGTCAGAAGCAGCAGGA | 14715 & 14716 |
| TM9SF4 | GGACCCTCCGGAAGGACA | GCGACAGCATCCCAAGCA | 14717 & 14718 |
| TMBIM6 | GGCGGCTGCAGGGGCCTA | ACTCCAGGGCAGGGCCCA | 14719 & 14720 |
| TMC4 | ACACTCGGAGTCGCCAGA | ACAGTCTCCCAGCACGGA | 14721 & 14722 |
| TMC8 | CTACCCTCCCAACACGGA | CACGGAGTTCTCCCAGCA | 14723 & 14724 |
| TMCC2 | CTATGAGAGGGCACGGGA | TGGCGATGGTGGACACGA | 14725 & 14726 |
| TMED1 | TGGAGCGCAGCATCCAGA | CGCCACGTTGACAGCTGA | 14727 & 14728 |
| TMED10 | CGTGATACCAACGAGTCA | CCTTGAAGAAGCGTCGCA | 14729 & 14730 |
| TMED2 | TGGACATCGACGTGGAGA | CCATCCATGTGAGCAGCA | 14731 & 14732 |
| TMED3 | GATTGACTCCCAGACGCA | GCACCTGACTGAAGCTGA | 14733 & 14734 |
| TMED4 | GAAGGACCCCGACGGCAA | CATGCTCCCCAACCTGGA | 14735 & 14736 |
| TMED5 | CTGGAAGACATCCTGGAA | GAATGGCTGACACCACCA | 14737 & 14738 |
| TMED7 | GGGTGCAGGCTGCTCGCA | CAGGAAGCTCGAAGGTGA | 14739 & 14740 |
| TMEFF2 | GCATGGGAAGTGTGAGCA | TGATGCAGAGGACCACCA | 14741 & 14742 |
| TMEM100 | TGCTACAGGGGGTACCGA | ACTTTCCAGCACAAGGCA | 14743 & 14744 |
| TMEM108 | TGGAAGCCTGGGACAGCA | GATGGCCAGGATCACCCA | 14745 & 14746 |
| TMEM116 | GTGAACAGTGGGCAGTGA | GCCGTTAGAGCCTGGAGA | 14747 & 14748 |
| TMEM119 | ACCAGAGGCGCAGGAGGA | TGGACACTGCTGCAAGCA | 14749 & 14750 |
| TMEM123 | CACACAACTCCAGTGCTA | GGAGTCTGAGGCAACTGA | 14751 & 14752 |
| TMEM131 | CAAGAGCCCAGGTGGGAA | TGCTGACGGGACTCCACA | 14753 & 14754 |
| TMEM132B | GAAGTCACCGGACCCCAA | CCCTGCTCACTCACAGCA | 14755 & 14756 |
| TMEM132D | CGAGTACCCCACCAGGAA | CAGTCCCCAGGGTCCAGA | 14757 & 14758 |
| TMEM140 | GGAATGAGGACACCAGCA | ACACAGCCAGGAAGCCCA | 14759 & 14760 |
| TMEM155 | GATGCAGAACTGATGCCA | TTCCACCCCTGCAAGCGA | 14761 & 14762 |
| TMEM156 | CCAGGACTTGCCAAGACA | CCAGAGGAGCTACACTGA | 14763 & 14764 |
| TMEM158 | GGCTGAACCGTAAGCCCA | CCATGCCGTTGGGCAGGA | 14765 & 14766 |
| TMEM161A | GGAGCAGCTGCGAAGGGA | CCCAGCGTCTTGAGCAGA | 14767 & 14768 |
| TMEM161B | TAACAGTGGCACTGAGCA | CAGCAATCCACCAGGTCA | 14769 & 14770 |
| TMEM164 | CTCCAGAGCCCCTCAGCA | GGGTCTGAGATGGCCGGA | 14771 & 14772 |
| TMEM165 | CCACCACAGTCATCCCCA | GACCCTCATCAGGGCTCA | 14773 & 14774 |
| TMEM168 | AGTGGATGGACCCAGACA | TCCACCTGCTAGAGCCCA | 14775 & 14776 |
| TMEM173 | ACGCCACCCCCTTGCAGA | CAGGGGCATCTGCCAGGA | 14777 & 14778 |
| TMEM176A | ACAACAGTGCCTGCCGCA | TCCAGACACCCAAGAGCA | 14779 & 14780 |
| TMEM176B | ACAGATGGATGCGGCGAA | ACAGCCAGGAACAGGGCA | 14781 & 14782 |
| TMEM194B | GGAGGAAGCCACTTGTCA | TCCAAGAAGGCACCCCCA | 14783 & 14784 |
| TMEM196 | CCGAGAGCACAAGCCGCA | CGATCCCAATGCACGCGA | 14785 & 14786 |
| TMEM199 | TAAACGGATCACCCGCAA | GACCCACCACAGAGGCGA | 14787 & 14788 |
| TMEM205 | CCAGCTGCGAGAGAAGGA | AGAGCCCATTGCTCAGGA | 14789 & 14790 |
| TMEM213 | CCCTGGGACCCTGGAGCA | CACTCCTGTGCGGCAGCA | 14791 & 14792 |
| TMEM25 | ATCGACCAGGATGGGCCA | CTTCCACCCGGGTAGCCA | 14793 & 14794 |

FIG. 1 Cont.

| | | | |
|---|---|---|---|
| TMEM255A | GCTCATCCCCAAGTGGCA | TCCAGAGGGAGGGGAGGA | 14795 & 14796 |
| TMEM30A | GACAACCTGGAAGAACGA | GCTGCAGTACGCATCCAA | 14797 & 14798 |
| TMEM38B | ATTCCAGCACACCCAGCA | GCCAATGACCCAACGCCA | 14799 & 14800 |
| TMEM44 | TGCCAAGGAAGCCAGAGA | TGTGGTGAGAGGCACCCA | 14801 & 14802 |
| TMEM45A | TGGCATGGCTGGGGAGCA | AGATATCTGCCACACCCA | 14803 & 14804 |
| TMEM50A | GCAGCTGTTATTTATCCCACCA | CGAAAAGCCAAATGCGAGCA | 14805 & 14806 |
| TMEM52 | CAGCCTGTACACCCCGGA | CCCGAGGCCCCAAGGAGA | 14807 & 14808 |
| TMEM54 | CCTTCGACCCCACACGCA | AGGGCCTCAGCTCCAGCA | 14809 & 14810 |
| TMEM56 | GGAACTCAAGGGTAGTATCCA | GCATACAGGGACGCACA | 14811 & 14812 |
| TMEM59 | GAAGAGGAGTTGTACGCA | TCAGCGAATGGCAGCTGA | 14813 & 14814 |
| TMEM62 | GCAACATACGGCACCCTA | TGAGAACAGGTGTCAGCA | 14815 & 14816 |
| TMEM66 | GGACCAGGGTTCTGGACA | GCCTCCATGAAGGGGTGA | 14817 & 14818 |
| TMEM67 | CAAAGATGCCAACAGCCA | AACAGCTAGCCCACCCAA | 14819 & 14820 |
| TMEM70 | AGCCCGTGGGCGGTCGAA | CCGTACTCCAGCCGGCTA | 14821 & 14822 |
| TMEM87A | ACTTGGCAAGATGCACCA | TCTCCAGTAGCAGGCAGA | 14823 & 14824 |
| TMEM8B | GGCACTGCTACCCACCCA | GGCAGCAGGAAGCCCACA | 14825 & 14826 |
| TMEM9 | CGAGTGCAGGTACGAGGA | GGATCAGAGGGTCCACCA | 14827 & 14828 |
| TMEM95 | AGCGCTGCTTCCCAGGAA | ACTCCACCAGGAGGCTCA | 14829 & 14830 |
| TMEM97 | CTGCTACAGGAGCCCCCA | AGGAAGGCATACGTTGCA | 14831 & 14832 |
| TMIGD1 | AGAGGAGGGGAGAGTGGA | AACATTCAGCACCACCGA | 14833 & 14834 |
| TMIGD2 | CAGCTGCCAGCAAAGGGA | GGCCGGTTGCGGGAAGGA | 14835 & 14836 |
| TMPO | CGGTCCTGACAAAAGACA | GCCGGTTGCGAGCCGTGA | 14837 & 14838 |
| TMPRSS11D | TGGCCACACAGTTCCAGA | CACCCTGACATGCGTCCA | 14839 & 14840 |
| TMPRSS12 | GAGAGGTGGGTCCTCACA | CAATCACAGCTGTCCACA | 14841 & 14842 |
| TMPRSS2 | CGCTGATGAAGCTGCAGA | CTGCAGGAAGCCGGCACA | 14843 & 14844 |
| TMPRSS3 | GATCTGCAACCACAGGGA | TGGCAGCTGTCCACGCCA | 14845 & 14846 |
| TMPRSS5 | GAGGCCAGCGCTGAGGAA | ATGCCCAAGGCTCCAGCA | 14847 & 14848 |
| TMPRSS6 | CCACGAAGAGGACAGCCA | CCAGCCCGTAATCCAGCA | 14849 & 14850 |
| TMTC2 | ACAGCCTCCTCACCCGCA | TTGAGCAGAGGCACAGCA | 14851 & 14852 |
| TMUB1 | ACACCCAGACCCTGGGCA | GGATCTGGCAGTACCAGA | 14853 & 14854 |
| TMUB2 | CCCCCTGAGATCTGAGGA | TTCAGGGCACCCACGGTA | 14855 & 14856 |
| TMX1 | GCTATCAGGGTCCAAGGA | ATGATCCCCACACTGGCA | 14857 & 14858 |
| TMX3 | CTGCGGCTCTGCGCCACA | TGGCCACACCATGGCGCA | 14859 & 14860 |
| TMX4 | GCTGGTGATGGAGGGCGA | TAACGGCGGAATATCCCA | 14861 & 14862 |
| TNC | GGGTACAGTGGGACAGCA | GCCCTTCCAGTGGAACCA | 14863 & 14864 |
| TNF | AATGGCGTGGAGCTGAGA | GAGGAGCACATGGGTGGA | 14865 & 14866 |
| TNFAIP2 | CAAGACGGCCGAGCAGCA | GGCCAGCGTAGGGAGA | 14867 & 14868 |
| TNFAIP3 | ATCGAGCCAGCGCAGAGA | GCTGACACTCCATGCAGA | 14869 & 14870 |
| TNFAIP6 | TGTGAAGCCAGGGCCCAA | GTAGCAATAGGCATCCCA | 14871 & 14872 |
| TNFRSF10A | TACAGCAGGCCCAGGGGA | TCTCCAAGGCATCCAGCA | 14873 & 14874 |
| TNFRSF10B | AGGAGCCAGCAGAGCCAA | CATGAGCGGCTCCCAGGA | 14875 & 14876 |

| | | | |
|---|---|---|---|
| TNFRSF10C | CGGAATGAAAACTCCCCA | ACAGTGGCATTGGCACCA | 14877 & 14878 |
| TNFRSF10D | CCCGAACGTGTGCACAGA | AGACCTGGGTGGGCTGCA | 14879 & 14880 |
| TNFRSF11A | CTGCACAGGCTGCCGGAA | AGCCTCCCATCAGCCCCA | 14881 & 14882 |
| TNFRSF11B | CTGGAACCCCAGAGCGAA | TGAGTTAGCAGGAGACCA | 14883 & 14884 |
| TNFRSF12A | GGCGCGACCGCACAGCGA | AAGCAGCCCCAGCACGAA | 14885 & 14886 |
| TNFRSF13B | ACGCGATGGAAGCCGGCA | GTGGGCAAGGCTGCAGGA | 14887 & 14888 |
| TNFRSF13C | AGCCCCTGGACAAGGTCA | CCAGGAGGAGGCCAGGCA | 14889 & 14890 |
| TNFRSF14 | AAGGAGGACGAGTACCCA | AGGCCATTGAGGTGGGCA | 14891 & 14892 |
| TNFRSF17 | GCATCAAGAGCAAACCGA | CACTCAAAGCAGCTGGCA | 14893 & 14894 |
| TNFRSF18 | CCCAGCTTGGACTGCACA | GCGGCACCTCCAGCAGCA | 14895 & 14896 |
| TNFRSF1A | GAGGGGGAGCTTGAAGGA | TGAAGGTGGAACTGGGCA | 14897 & 14898 |
| TNFRSF1B | CATGGGACCCAGGTCAA | CCTCCTTGGAGAAGGGGA | 14899 & 14900 |
| TNFRSF21 | AGAAGTCCAGCACGCCCA | CGGATACTGCACACCACA | 14901 & 14902 |
| TNFRSF25 | CCTTGGACAGCGCCCACA | ATGTCACCTGCGGGCAGA | 14903 & 14904 |
| TNFRSF4 | GAAGTGGGAGTGAGCGGAA | GGGCACAGTCAACTCCA | 14905 & 14906 |
| TNFRSF6B | AGAGCAGTGCCAGCCCCA | GTGCTGAGGGGGAAGCCA | 14907 & 14908 |
| TNFRSF8 | ACTGACGAGGGCTCCCGA | TAGGGGACACAGCGGGCA | 14909 & 14910 |
| TNFRSF9 | TGGGACGAAGGAGAGGGA | CAGCAGGAAGAGCAACGCA | 14911 & 14912 |
| TNFSF10 | GACCCAGCCTGGGACAGA | GTTACAGCCACACAGAGA | 14913 & 14914 |
| TNFSF11 | TCAGAGCAGAGAAAGCGA | TGGTACCAAGAGGACAGA | 14915 & 14916 |
| TNFSF12 | TCTCAGCCACTGCGGCGA | GTCCGAAGTAGGTGAGGA | 14917 & 14918 |
| TNFSF12-TNFS | GGTGTCTCGAGAAGGCCA | GACACCTGCGCTATAGCA | 14919 & 14920 |
| TNFSF13 | GAGGTGATGTGGCAACCA | TCTCGAGACACCACCTGA | 14921 & 14922 |
| TNFSF13B | CAGGAGAAGGCAACTCCA | AAGCTGAGAAGCCATGGA | 14923 & 14924 |
| TNFSF14 | ACCCCGCTACCCCGAGGA | ACCGGGTACCATCACGCA | 14925 & 14926 |
| TNFSF15 | GACAAACTCCCACACAGCA | CACGGAATGTGACCTGGGA | 14927 & 14928 |
| TNFSF18 | CAAGTGGCTCCCAATGCA | GGTGTCCCCAACATGCAA | 14929 & 14930 |
| TNFSF4 | ATGTGGGAAATGCAGCCA | GAAGAGCAGAGAAGTGCA | 14931 & 14932 |
| TNFSF8 | TTCAGAGGACGGACTCCA | CACTTGGAGGTAGGCCCA | 14933 & 14934 |
| TNFSF9 | GCGCTGCACCTGCAGCCA | TGTGAAGATGGACGCCCA | 14935 & 14936 |
| TNIP1 | CCGGTCCATGAAGCAGCA | TGGACTTGGCCAGGAGGA | 14937 & 14938 |
| TNIP2 | GCCCGAGCTGATGAGGAA | GCATCTGCACCCGCTCCA | 14939 & 14940 |
| TNIP3 | CTGAAGCAGCAGGTGCAA | GCAGTTACAGGGTGGGCA | 14941 & 14942 |
| TNKS | TGCAGCCGAAAGAGCCCA | ACTCAGCAGGAGGCGGCA | 14943 & 14944 |
| TNKS2 | GCTGCAAGCTGCACGAGA | GGAGATGCAGCAGCACA | 14945 & 14946 |
| TNN | TCCACCACCCTCTCCACA | TACAGACCACTGGCGGCA | 14947 & 14948 |
| TNNC1 | AGGTGGACGAGGACGGCA | CATGCGGAAGAGGTCAGA | 14949 & 14950 |
| TNNC2 | CACCATCGACTTCGAGGA | CCTGTCGAAGATGCGGAA | 14951 & 14952 |
| TNNI1 | GATGGACCTCCGTGGGAA | TGCCAGACATGGCCTCCA | 14953 & 14954 |
| TNNI2 | GGTGCAGAAGACCAGCAA | AGGGCCTTGAGCATGGCA | 14955 & 14956 |
| TNNI3 | CCGTGTGGACAAGGTGGA | CCCCCAGCAGCGCCTGCA | 14957 & 14958 |

FIG. 1 Cont.

| | | | |
|---|---|---|---|
| TNNT1 | AGCGTGGTAAGCGGCAGA | GGTGGATCCAGTCCGACA | 14959 & 14960 |
| TNNT2 | CTGAGACCGAGGAGACCA | GAGGCACCAAGTTGGGCA | 14961 & 14962 |
| TNNT3 | CCAGGAGGAAGCTGCAGA | TGAGGGCCTGGAGCTCCA | 14963 & 14964 |
| TNP1 | AGGAGGAGCAAGAGCCGA | GGGAGCGGTAATTGCGA | 14965 & 14966 |
| TNPO1 | AACAGCTGGTAGCCCGAA | AGGTCACCTAACAGGGCA | 14967 & 14968 |
| TNPO2 | TGCCCCCACTGATCCAGA | CTGCACCAGGGTGACACA | 14969 & 14970 |
| TNR | GGATGCCACCAAGAGGCA | GTGGTGATGGAGCCCACA | 14971 & 14972 |
| TNRC6B | TCTCCCTGGAGCAGCACA | GGCCATGCTGCATGCAGA | 14973 & 14974 |
| TNS1 | GCCTTGCCAGAGAAGCGA | TGGCGACAGGCGAAGACA | 14975 & 14976 |
| TNXB | GCAATGAGGCCCTGCACA | GTCCCGATCACGGGCAGA | 14977 & 14978 |
| TOB1 | ATGCCCATAAGTGACCCA | AAGCCGAGGTTGATGGGA | 14979 & 14980 |
| TOLLIP | CCCCAACATGGACCAGGA | AGGGAGTTGATGGCGGCA | 14981 & 14982 |
| TOM1 | CACTGGCTGACCAACGGA | GGCTGGAGAGGTTGGGCA | 14983 & 14984 |
| TOM1L1 | CCAGAAGGAAGCCACCAA | CCAGAGTGGCCCTAGGCA | 14985 & 14986 |
| TOMM22 | ACAGCAGCAACTGCAGCA | AGGGTAGAGCCCCTGGCA | 14987 & 14988 |
| TOMM40 | CAAGGATGCAGGACACCA | GGGCCAGTGTCAGGGGCA | 14989 & 14990 |
| TOMM7 | GCTGAGCAAAGAGGCCAA | AAGCCCCAGCGAATGGCA | 14991 & 14992 |
| TOMM70A | GCCAATGCAGCCAAACCA | GATCGATGTCAGCAGCCA | 14993 & 14994 |
| TOP1 | GGAAGGAGAAACAGCGGA | GGAGTCCTTCCCGAGGAA | 14995 & 14996 |
| TOP1MT | TGGACCCCAGGATCAGCA | TGGCGAGAGCCCAGGCGA | 14997 & 14998 |
| TOP2A | AAGCCCTCCTGCTACACA | ACCGGTAGTGGAGGTGGA | 14999 & 15000 |
| TOP2B | GTAAAGGCCGAGGGGCAA | CGACCGGTTCGTGGCAGA | 15001 & 15002 |
| TOPBP1 | AACCCCAAGGGCAGAGGA | TCGTCCACTGCGAGCAGA | 15003 & 15004 |
| TOR1A | GCAAGATCATCGCAGAGA | ACCCCATCCACCAGGTCA | 15005 & 15006 |
| TOR1AIP2 | GAAGGACCTGGCAGGACA | GCAGAACAGTCAGGACCA | 15007 & 15008 |
| TOR1B | GCCGGAAGAAAGAGGGAA | CCACTGTGCCACAGGCCA | 15009 & 15010 |
| TOR2A | CTGTGCTGGACAGCACCA | GAAGAAGGCGATTCGGGA | 15011 & 15012 |
| TOR3A | GCGGAGAAGCTGCACCCA | ACCATCCAGCCTTGAGCA | 15013 & 15014 |
| TOX | TACACTCACCCACCATGCA | CCCGAACGCACATACTCCA | 15015 & 15016 |
| TOX4 | GCCCATACAGTGGAGGCA | TAGAGGCTACCCAGGCCA | 15017 & 15018 |
| TP53 | CACTGCCCAACAACACCA | TCGAAGCGCTCACGCCCA | 15019 & 15020 |
| TP53BP1 | GGTGGAAGGGAAGCGGAA | ACTCCCATGGAGGCACGA | 15021 & 15022 |
| TP53INP1 | AGAGTCACCTACTGAGCA | CTCACTGAGACCAGGGCA | 15023 & 15024 |
| TP53INP2 | TCATCGAGCACCCCAGCA | CGCGTCCGGGAGCGGGGA | 15025 & 15026 |
| TP63 | TCCTGCGGACCCCAAGCA | AAGAGATGGTCTGGCGGA | 15027 & 15028 |
| TPBG | AGAGGTAGTGCAGGGCAA | TCACAGTCCAGGTCAGCA | 15029 & 15030 |
| TPD52 | CTCCACCCGGATCACCTA | GCACTGATCGTGGCAGCA | 15031 & 15032 |
| TPD52L1 | GCAACGTTGGAACGGCCA | GGGCCGTGGAGCTGAGGA | 15033 & 15034 |
| TPH1 | AGAGCCAGATACCTGCCA | GCCTCCTCTGAAGCGCCA | 15035 & 15036 |
| TPI1 | GGCCCAGGAAGTACACGA | GTGCTCTGAGCCACCGCA | 15037 & 15038 |
| TPM1 | CCTGGAACGTGCAGAGGA | AGCCTGAGCCTCCAGTGA | 15039 & 15040 |
| TPM2 | TGGAGCGCTCGGAGGAGA | CTCTGAGGCCATCAGGGA | 15041 & 15042 |
| TPM3 | GCGAGAAGTTGAGGGAGA | GCTCCTGAGCACGGTCCA | 15043 & 15044 |
| TPM4 | GCTCAAAGAGGCCAAGCA | AGGATGACCAGCTTACGA | 15045 & 15046 |
| TPO | TCCCAGAGAGCGTGGAGA | TAGGGGTCCGCGCAGAGA | 15047 & 15048 |
| TPP1 | CCCAAGGCTCTACCAGCA | ATCCCAGCCAGGACCAGA | 15049 & 15050 |
| TPR | CCACATCCACTTCCCCCA | GGAGTCAACTGAAGGCCA | 15051 & 15052 |
| TPRKB | CTTTGTTTCGGAGCGGGA | GGTTACCCTGCATTCGGGA | 15053 & 15054 |
| TPRX1 | GGCAGACTCCAAGGCCCA | ATCGGGGCTCTGAGGCCA | 15055 & 15056 |
| TPSAB1 | TACACCGCCCAGATCGGA | CGTCACGGACGATGCGGA | 15057 & 15058 |
| TPSD1 | GAGGTGGAAGTCCCCGTA | ACAGCATGTCATCGCGGA | 15059 & 15060 |
| TPST1 | GCTGTGGAGAGGAAACCA | GCATGGCAGAATCCAGCA | 15061 & 15062 |
| TPST2 | GATCGAGCGGTCCACGGA | GCCATGTCCCGCACCACA | 15063 & 15064 |
| TPTE | GGAGCAACCGAGGAGGCA | CGGCAAGGATGAGAGTGA | 15065 & 15066 |
| TPX2 | AGGCTGAGGAGCTCGAGA | TTGGGCAAGATGGGCCCA | 15067 & 15068 |
| TRA2B | ACGGCACAGCCACAGCCA | GTGTACAAGCTCAGCCCA | 15069 & 15070 |
| TRABD | TGACGCCGAGCCCAGGAA | TGTAGCCCAGCAGGCCGA | 15071 & 15072 |
| TRAF1 | TGGGCAAGCTGGAGCAGA | CATTCAGGTACAGCCGCA | 15073 & 15074 |
| TRAF2 | GCGAGAGCCTGGAGAAGAA | CAGGTCCTTGAGGCCAA | 15075 & 15076 |
| TRAF3 | GGAAAGACCTGCGAGACCA | CACCACCACGCAGGGACA | 15077 & 15078 |
| TRAF3IP2 | GTCGCAGCTGGACGAGGA | TCTGAAGCCAGGTGGGCA | 15079 & 15080 |
| TRAF3IP3 | GCTGAACCAGAGCCAGCA | TGGCCAGGAACACTGCCA | 15081 & 15082 |
| TRAF4 | ACAGGAGGCCAAGGCCAA | AAGGGCCACTCAAGGAGA | 15083 & 15084 |
| TRAF5 | GCGGTGGATGGGCACACA | GCCTGAATGGCCACTGCA | 15085 & 15086 |
| TRAF6 | CAATCCCACGGAACCCAA | CGGGTGGAGACCTCACA | 15087 & 15088 |
| TRAFD1 | GCGGAATCGAGACAGCCA | CCCTGAAGGCCCAGGGGA | 15089 & 15090 |
| TRAIP | CAAAGGCCCCAGGAAGGA | TAGGGAAGGCACCAACCA | 15091 & 15092 |
| TRAK2 | GTGTCACCCCGACAGAGA | CCTCGAAGGCAACTGGCA | 15093 & 15094 |
| TRAPPC10 | CAGGACTCAGGCCAAGGA | GTGAGGGAGGACGAACCA | 15095 & 15096 |
| TRAPPC8 | TGACAGACGACCAGCGGA | TCGCCACTGCTGAGAGGA | 15097 & 15098 |
| TRAT1 | AGCGTAGAAAGCCCAGGA | CTTAGCACGGATCAATCCA | 15099 & 15100 |
| TRDMT1 | CCAAGACGATTGAAGGCA | GTGAATGGCTGGCAGGGA | 15101 & 15102 |
| TREM1 | CAAGCTCCACCCAAGTCAA | ACCTCAGCGTGACAGCAA | 15103 & 15104 |
| TREM2 | GCGGAATCTACAACCCCA | AGATGCAGGCCAGGAGGA | 15105 & 15106 |
| TREML2 | AAACCGCGTGGAGGGCAA | TCACCCAGACTCGGGCAA | 15107 & 15108 |
| TRERF1 | AATGAGGGCCTCCCCCAA | CAGGGACAGACACGGGCA | 15109 & 15110 |
| TRH | ACCCCACAAACGGCAGCA | TCGGGACAGCATATGCAA | 15111 & 15112 |
| TRIAP1 | CTTCAAGCGCTACCAGCA | CATGGCCCATGAACTCCA | 15113 & 15114 |
| TRIB1 | CCTACGTGAGCCCTGAGA | AGGGGTATCGTCCAACCA | 15115 & 15116 |
| TRIB2 | GAGGAGGAGGCAGCCAGA | TGTACAGCATCACCCCCA | 15117 & 15118 |
| TRIB3 | GGCCTCATACTCGGGCAA | CTCCCGACGAAGGAGGCA | 15119 & 15120 |
| TRIM10 | CTCACCAGACAACCCCCA | GAAGGAGCCCAGAGCCGA | 15121 & 15122 |

FIG. 1 Cont.

| | | | |
|---|---|---|---|
| TRIM11 | GGACTACGAGGCTGGACA | TGCTGGACAGGGGTGAGA | 15123 & 15124 |
| TRIM14 | CACGGCCACCGAGCAGGA | AAGGAGAGGGGCACGGGA | 15125 & 15126 |
| TRIM2 | ACGGGGAGATCCTGGACA | GGGAGACACATCAGCGGA | 15127 & 15128 |
| TRIM21 | AGGTGCCACAGCTCAGCA | GCCCTGGCACATGGCACA | 15129 & 15130 |
| TRIM24 | CATGGCCAGCCAAGACCA | GCTGGAGGCACTAGGTGA | 15131 & 15132 |
| TRIM25 | CTGCAGCCAAAGCCACCA | TGAGGCATCTCAGCCACA | 15133 & 15134 |
| TRIM26 | GCATCTGGGCCAACACCA | CTGGCCACTTGAGCCACA | 15135 & 15136 |
| TRIM27 | CGTGACTCTGGACCCAGA | CCGGCGATGAAGCATGGA | 15137 & 15138 |
| TRIM28 | CGAGACGCGCATGAACGA | TCCTGGGAACTCAGGCCA | 15139 & 15140 |
| TRIM29 | GCCGCTTCACCAAGGAGA | AGGAGCTGCCTTGGACGA | 15141 & 15142 |
| TRIM33 | CAAACCGAGGTCCCACCA | GGCAGAGGGACCTGGAGA | 15143 & 15144 |
| TRIM37 | AGTCTGGGAGCAGGCACA | TCAACCGCAGGCAAGCCA | 15145 & 15146 |
| TRIM5 | TGGAGTGCAATGGCACGA | GGAGGCTGAGGCAGGAGA | 15147 & 15148 |
| TRIM55 | CCGGAAAGCCACCACCAA | TGGAGGGGAGGAGCCTCA | 15149 & 15150 |
| TRIM58 | CATCCCTGGGAGGAGGGA | TCCCACCAGAACCTCCCA | 15151 & 15152 |
| TRIM66 | CCCCAGCCCCAATAGAGA | CTGAGCAAGGCTGGCACA | 15153 & 15154 |
| TRIO | GGAGCTTCAGACGCAGCA | CGAGGCATAGTGGCCAGA | 15155 & 15156 |
| TRIOBP | CCCAGGAGGATGGCCACA | GCGGGGTGACCTTGGGCA | 15157 & 15158 |
| TRIP10 | AGGAACCCACATCCCCCA | GAGCGTGACTCGGAGGTA | 15159 & 15160 |
| TRIP11 | CCATCCATTCCACCACCA | CCACCAGGTCCAAGTCCA | 15161 & 15162 |
| TRIP13 | CAGGGCTGACATCAAGCA | GTCAGCAGCTGCTGGCGA | 15163 & 15164 |
| TRNP1 | AGGGGACGGCAGAGCAGA | AGCCCCGCGATCCCGCTA | 15165 & 15166 |
| TRO | CGACCAAGGACACACCCA | CTCGTGGTAGGAGCGCAA | 15167 & 15168 |
| TROAP | CAGGCCGAAAGCCAGGCA | AAGGGGTTCCGAGGCTGA | 15169 & 15170 |
| TRPA1 | GCCTGGATGAAGACGGGA | GGCTCAGAAGAAGCGCAA | 15171 & 15172 |
| TRPC7 | CCAGGCTGGCATGAGGAA | CATAGCGCAGGCTGGAGA | 15173 & 15174 |
| TRPM1 | CGGTGGGGTTAACCAGGA | GCACTGCAGCTTCCGACA | 15175 & 15176 |
| TRPM4 | ACCGTCCCTACCTGCAGA | GGCATACTGGGAGACGCA | 15177 & 15178 |
| TRPM6 | CACCAACACCCTGGAGGA | GAGCTTCCGGCAGCAGGA | 15179 & 15180 |
| TRPM8 | TCCCCGAGTGGATCACCA | CGACCAGCAGGTTGACCA | 15181 & 15182 |
| TRPV3 | ACTGCAGCTCCTACGGCA | CTCTCTGCAGGCGCCAGA | 15183 & 15184 |
| TRPV4 | CCTGAACCCGTGTGCCAA | ACGAGGGGTAAGTGGGCA | 15185 & 15186 |
| TRPV5 | GCGGCTCACCAACACCAA | GACCACAGCCATCAGCCA | 15187 & 15188 |
| TRRAP | TGGCAGATGCCGTCGACA | TTCCCTCCGAGCCAACCA | 15189 & 15190 |
| TSC1 | CACCACAGCAGAGGCAGA | AGAACTGGAGGCTGCCGA | 15191 & 15192 |
| TSC2 | TCTCAGCCACAGCCAGCA | GACGTGATGGGCCAGACA | 15193 & 15194 |
| TSC22D1 | GCAGGAGTAGGAGCAGGA | CTGCCAGTAGGTACAGCA | 15195 & 15196 |
| TSC22D4 | CCAGACCCCTTCGGAGCA | ACCTCCTCCCGGACCGCA | 15197 & 15198 |
| TSG101 | GGGCGTGATAGACCTGGA | AGGTCACTGAGACCGGCA | 15199 & 15200 |
| TSHR | GTTCCCTGACCTGACCAA | CCTTGGACTGAAGTAAAGCCA | 15201 & 15202 |
| TSHZ2 | CTTGGGCAAAGCCACGGA | ACAGGTAGCGCCTGGACA | 15203 & 15204 |
| TSKU | ACCTCCCGGCACTGCAGA | CTACGCAGTGCAGGGCCA | 15205 & 15206 |
| TSN | TGGCTGCCGAGCAGGACA | AGAAGACCAAGCGCTGCA | 15207 & 15208 |
| TSPAN1 | ACGTCACCAACACAGCCA | CCAATTCCAGCTGCCACA | 15209 & 15210 |
| TSPAN13 | CCAGGAGCAACAGGGTCA | AACACAGCTAGCCAGACA | 15211 & 15212 |
| TSPAN18 | TGCCGGAGGGAACCCCAA | CGGAAGAGGCACATGGCA | 15213 & 15214 |
| TSPAN3 | CAATGGAACCAACCCTGA | AGAGCCTCACACCCCTCA | 15215 & 15216 |
| TSPAN32 | ACCCTGACCCCACGAGCA | CAGCCAGGTGGCAGGAGA | 15217 & 15218 |
| TSPAN4 | GCACCTGTACGGCACGCA | CTCACTGAACTCCAAGCA | 15219 & 15220 |
| TSPAN5 | AATGCAAGTCGAGAGCGA | CCTGGCATCATAGCCACA | 15221 & 15222 |
| TSPAN6 | GGGCAAGGTGAGCCTGGA | CTACGATGGCAGCGACCA | 15223 & 15224 |
| TSPAN7 | GGACTTACACGGACGCTA | GCACACCACAGCAGCTCA | 15225 & 15226 |
| TSPAN8 | GCGACAGGTATCCTAGGA | CAGCAGCTCCATTGACCA | 15227 & 15228 |
| TSPO | GCACGCTCTACTCAGCCA | CCACCAAGGCCCAGCCCA | 15229 & 15230 |
| TSPO2 | AGCTCACCATCAGCTGGA | GGCAGCAGTAACAGGGCA | 15231 & 15232 |
| TSPYL2 | CCTGCAGGCACTGGAGGA | TGCGCTTGAGACGCAGGA | 15233 & 15234 |
| TSSK2 | TCAGCCAGCGGCTCCACA | CCTCTTGAAGGAGGCAGA | 15235 & 15236 |
| TST | AAGGGCGGTTCCTGGGCA | TTGCCGCAGAGGTAGGCA | 15237 & 15238 |
| TSTA3 | CATCAAGGAGGCAGCCGA | TGAAGGGTGTGAACCGGA | 15239 & 15240 |
| TTBK2 | CCACCACCAGGAAAGCCA | AATTTGGGCCAGGCGGGA | 15241 & 15242 |
| TTC13 | CAGGGTTGCAACCCCACA | TGACCTCCAATGCGGCCA | 15243 & 15244 |
| TTC18 | GCTCACAGAGGCTGAGGA | TCAGGCAGACCAGAGCCA | 15245 & 15246 |
| TTC19 | CGTCACAGGCACAAAGGA | CATCCAGGGTAGTAGCCA | 15247 & 15248 |
| TTC37 | ATGCACTCCAAGGCCGCA | GTGCAACAACTCGAGACA | 15249 & 15250 |
| TTC38 | CGCCTGCAGATGGAAGGA | CCAGGGATGCCATCAGGA | 15251 & 15252 |
| TTC39A | CCAGCAGCACTGGAAGCA | AGCTTCAGGCCTGGCACA | 15253 & 15254 |
| TTC39B | GACAGCTTGAAGCAGAGA | CACAGGTGCAGGTAAGGA | 15255 & 15256 |
| TTC9B | GGAGAAGCAGCAGGGCAA | CCTCCTGCAGGTAGCGCA | 15257 & 15258 |
| TTF2 | ACACTCGGAGGCAGCAGA | ACTGGCGGAGTCTCAGCA | 15259 & 15260 |
| TTK | GGCCAGAGCAAACTGCAA | ATGCCCAAGTGAACCGGA | 15261 & 15262 |
| TTL | CATAGACAACCAGGGCCA | ATGATCCACCAAGACCCA | 15263 & 15264 |
| TTLL11 | CTCCATGACCCTGGACCA | GGACAGGTGGTACTCGCA | 15265 & 15266 |
| TTLL6 | CTCTGGCGAGAAGAGGCA | CTGGAGTGGCAATCACCA | 15267 & 15268 |
| TTPA | GCCGCTGCCGCTCACCGA | AGGACTCCATGGTAGCCA | 15269 & 15270 |
| TTR | AGGCTGGCCCTACGGGCA | ACGGCCACATTGATGGCA | 15271 & 15272 |
| TUBA3C | GAAGGCCTACCACGAGCA | GAGGGTCACACTTGACCA | 15273 & 15274 |
| TUBA4A | ACGCTGCCATTGCCGCCA | TTGGCCAGGTCACCCCCA | 15275 & 15276 |
| TUBA8 | CGACGTGGTGCCCAAGGA | GAAGCCTGTGGGACACCA | 15277 & 15278 |
| TUBAL3 | CCACTCCACCACAGAGCA | GAGGGAGGCAGTGATGGA | 15279 & 15280 |
| TUBB1 | CTCCGTGCAGACCAGGAA | CAATGAAGGTGGCGGCCA | 15281 & 15282 |
| TUBB2A | CGTGGAGTGGATCCCCAA | CCGTGAACTGCTCGGAGA | 15283 & 15284 |
| TUBB2B | CTACGGGGACCTCAACCA | AGAAGTGCAGGCGAGGGA | 15285 & 15286 |

FIG. 1 Cont.

| | | | |
|---|---|---|---|
| TUBD1 | TCGCACATCAGCTGGGAA | CTTGAGGAGGCCAGCCCA | 15287 & 15288 |
| TUBG1 | CGGGCTCATGATGGCCAA | AGGCCTCCCGCTTACGCA | 15289 & 15290 |
| TUBGCP2 | CCTGGCACATCCTGGAGA | TCAGGCAGGTGTCCAGGA | 15291 & 15292 |
| TUBGCP3 | CGACCAGCTCTGACGAGA | CCCCCTGGTACCCAGAGA | 15293 & 15294 |
| TUBGCP5 | CCAGCAGGCAGCACACCA | GCATCGACTTGCCAGCCA | 15295 & 15296 |
| TUBGCP6 | GAGGCGCACTATGAGGCA | AGGGCCTTGCTCAGCACA | 15297 & 15298 |
| TUFM | CCAGAAGGTGGAGGCCCA | GGGCAGGATAATCCGACA | 15299 & 15300 |
| TULP2 | CGTCGTGGGACAAGGAGA | CTCGGCCGAACTGGAGCA | 15301 & 15302 |
| TWIST1 | GGTCCTCCAGAGCGACGA | CCGAGAAGGCGTAGCTGA | 15303 & 15304 |
| TWIST2 | AGCTGAGCAAGATCCAGA | CCATGCGCCACACGGAGA | 15305 & 15306 |
| TWSG1 | AGGAGCTGCATGAACCGA | CTGGAATAAGGCGCGTGA | 15307 & 15308 |
| TXK | GAAGTACGGAGGCTGCCA | CCCATCAGCCCAACTGGA | 15309 & 15310 |
| TXNDC11 | GCCTGAGCTGCAGAACCA | TGAGTGGAGCTCGGAGCA | 15311 & 15312 |
| TXNDC12 | CCAGTGGACTGCCCCTGA | AACCCCCGTCAGGGCTGA | 15313 & 15314 |
| TXNDC15 | GGCAGCAGAAGAGGCCAA | CCTCAGCTTCCCCAGGAA | 15315 & 15316 |
| TXNDC5 | CCGAGGCTGACAAGGGCA | CCTCCCAAGTAGGAGCCA | 15317 & 15318 |
| TXNIP | GCCGAACCAGCTCTGAGA | TCCATATAGCAGGGAGGA | 15319 & 15320 |
| TXNL4A | AGCAGGAGATGGTGGACA | AGTCCTTGGGGGACACCA | 15321 & 15322 |
| TXNRD1 | AGGCTTATCAGGAGGGCA | GCCAGACCTCCTGAGCCA | 15323 & 15324 |
| TXNRD2 | CCACCTCTGTGCCCCACA | CGAAGAGCCGCTGCACCA | 15325 & 15326 |
| TYK2 | AGCTGGCCACACTCACCA | AAGTGACCCTCGCCCAGA | 15327 & 15328 |
| TYMS | GGACAGGGAGTTGACCAA | AAGGCACACCGAGGCCCA | 15329 & 15330 |
| TYR | AATGGAACGCCCGAGGGA | CATCAGCTGAAGAGGGGA | 15331 & 15332 |
| TYRO3 | GCATGCTGGCAGAGGACA | CCAGCCACTTGACAGGCA | 15333 & 15334 |
| TYROBP | GGCCCAGGCCCAGAGCGA | AAGTACACGGCCAGGGCA | 15335 & 15336 |
| TYRP1 | GCACCGAGGATGGGCCAA | CTTCCAAGCACTGAGCGA | 15337 & 15338 |
| TYSND1 | CCCACCTGAACTTCAGCA | ACCCTGACTGGCTCAGCA | 15339 & 15340 |
| U2AF1 | TAATGGACAGCCGATCCA | CTCATACTGACGGCAGCA | 15341 & 15342 |
| U2AF2 | ACGTCACGGATCAGGCCA | GGCACTTGCAGGGTCACA | 15343 & 15344 |
| UAP1 | GAGCAGACTGTGGAGCAA | TCCCCGCATTGAACAGCA | 15345 & 15346 |
| UBA2 | CAGCCGGCTTCAAGCAGA | GTGGAGGTGGAGGGCTGA | 15347 & 15348 |
| UBA7 | CCCTGAGCAGCAGAAGGA | CTAGCTGCCGCTACCACA | 15349 & 15350 |
| UBAC1 | CAGCGCCACCGATGAGGA | AGCCACTCGCACGCGGCA | 15351 & 15352 |
| UBAC2 | CGGCTCATGGAGATGGGA | GCAGGAAGTTGGTGGCGA | 15353 & 15354 |
| UBAP2 | CACACCTCCCTTCCAGCA | AGGCCCAGAACCTGCAGA | 15355 & 15356 |
| UBASH3A | AGCAGATGCAGCGGGGAA | TTGGCAGACTGCAGGGGA | 15357 & 15358 |
| UBASH3B | CCGCTACATACGCACCA | AGGGACGGGGAGCAA | 15359 & 15360 |
| UBB | TCCAGGATAAGGAAGGCA | GACCAGGTGCAGGGTCGA | 15361 & 15362 |
| UBD | CCGTTCCGAGGAATGGGA | AGATCTTGGAGCCCAGCA | 15363 & 15364 |
| UBE2A | CAAGAGGTTGCAGGAGGA | TGACCGCGTTCCACACCA | 15365 & 15366 |
| UBE2C | GCCCTGCTATCACCCCAA | CTGACATCATACAGGGCA | 15367 & 15368 |
| UBE2D1 | AGCGCATATCAAGGTGGA | AGTCAGAGCTGGTGACCA | 15369 & 15370 |
| UBE2E1 | GGAGTCCAGCACTAACCA | GGCAATACTTCCCACCAA | 15371 & 15372 |
| UBE2G2 | CTACGAGAGCAGCGCGGA | CTGCCAGCATGCTCACCA | 15373 & 15374 |
| UBE2I | GGGACTCCGTGGGAAGGA | CTAAGATGGACAGGCACA | 15375 & 15376 |
| UBE2J1 | CAGCAGCAGAGTCAGAGA | ATCAGTACAGCTGACCCA | 15377 & 15378 |
| UBE2L3 | GCAACCAAAACCGACCAA | TCAGCTAGGTCAGCCCGA | 15379 & 15380 |
| UBE2L6 | TGGACGAGAACGGACAGA | GCACATTGAGGGCCTCCA | 15381 & 15382 |
| UBE2N | CGAACCAGATGAGAGCAA | ATAGCAGAACTGTGCGGA | 15383 & 15384 |
| UBE2O | TCACCTTCACCAGCGCCA | CCATGATGCCCTCAGGCA | 15385 & 15386 |
| UBE2S | CCTCCAGGTCACCATCGA | CGCCCACGTTCGGGTGGA | 15387 & 15388 |
| UBE2T | ATGTTAGCCACAGAGCCA | GAGCTCGCAGGTCATCCA | 15389 & 15390 |
| UBQLN1 | ATCCATGGGCTCCACAGA | CTCTGCCCAGAAGTGCCA | 15391 & 15392 |
| UBQLNL | CCCAGATCACAGGAGGCA | GCTGCAGGAATGTGGGCA | 15393 & 15394 |
| UBR1 | GCTGCTTGCCAGGAAGCA | TCCAGGAACCAAGACGCA | 15395 & 15396 |
| UBR3 | GGAGATCACCACGGCAGA | TCTTCAGAGGAGGGGCCA | 15397 & 15398 |
| UBR5 | GGCAGGCACTTGGAGAGA | AAGCAGCTGAGCTGGGGA | 15399 & 15400 |
| UBR7 | GAGCAGAACAGTGAACCA | ACGCCAGTTCAGGGGCCA | 15401 & 15402 |
| UCHL5 | CCAGGAGAAGAACCAGCA | GCTTGAGTAGCACAAGCA | 15403 & 15404 |
| UCK1 | GGAGGGCAAAACGGTGGA | AGACAGCCTGACGTCGGA | 15405 & 15406 |
| UCK2 | CAGCGAGAGAGGCAGGGA | AGGGCCCTCCATTCAGGA | 15407 & 15408 |
| UCMA | CGGCAAGCGGTCCCCCAA | CGCAGCTCATCAACCCGA | 15409 & 15410 |
| UCN | TTGGGACTCGGGACGGCA | AGGGTCCGCAGCAGGTGA | 15411 & 15412 |
| UCN2 | CAGTGACCCCTATCCCAA | CCATGTGGGAGCAGCTGA | 15413 & 15414 |
| UCN3 | CGCCTCTTCGGGAGAGGA | GCTCCACCCCTGGCCCCA | 15415 & 15416 |
| UCP1 | AGAGCCATCTCCACGGAA | TCCAGCGATAAGAGCCGA | 15417 & 15418 |
| UCP2 | TGCCCTCCTGAAAGCCAA | CTGTACTGGCCCAGGGCA | 15419 & 15420 |
| UGCG | TGGATGGGCAGCCCACCA | CGCGGATGAACCAGGCGA | 15421 & 15422 |
| UGDH | AAGAGGTAGCAACAGCGA | ACCTGCTGCCAATAACGA | 15423 & 15424 |
| UGGT1 | CTGAAAGCCAACCCAGGA | ATCAGCATCAGGGGGAGA | 15425 & 15426 |
| UGGT2 | TGATGAGCCACCACCAGA | CGGCATAGAGAATCACCA | 15427 & 15428 |
| UGP2 | CTGCCTGTCAAAACCACA | ACCAAGGGCACTGTAGGA | 15429 & 15430 |
| UGT1A1 | GCCATTCCAAAGGGAGGA | GAGACAGGTACTGGGCCA | 15431 & 15432 |
| UGT1A10 | CGTGCACTTGGAGGACCA | GTCCGTTCGCAACAACCA | 15433 & 15434 |
| UGT1A4 | CGACCAATTCAGACCACA | TGCCCCCAATGAAGACCA | 15435 & 15436 |
| UGT1A8 | CGCATGGAGACTAAGGGA | CTGTCAGCACGACGGCCA | 15437 & 15438 |
| UGT2A1 | CCACAAAGGAGCCAAGCA | CCGTTGTCACACAGACCA | 15439 & 15440 |
| UGT2B11 | AAGCCCCTGGATCGAGCA | AGAGTGGTACTGGAACCA | 15441 & 15442 |
| UGT2B17 | CCTTGCCCAGATCCCACA | ACAAGGGAATGCCCACCA | 15443 & 15444 |
| UGT2B28 | AAGCCCCTGCATCGAGCA | GTGAGGTCACGGGCTGCA | 15445 & 15446 |
| UGT2B4 | AAGCCCCTTGATCGAGCA | CGTGGGCTGCAACCCGAA | 15447 & 15448 |
| UGT2B7 | ATGGGGAAAGCTGACGTA | CTGACCATTGACCCCAGA | 15449 & 15450 |

FIG. 1 Cont.

| | | | |
|---|---|---|---|
| UGT3A1 | GACTGGGGGAGCGACGCA | ACCCAGCAGCTTCCCACA | 15451 & 15452 |
| UGT3A2 | GACGCACCTCAAGCCCTA | CCCCACGCAGCCACCAGA | 15453 & 15454 |
| UGT8 | GAGTACAGGCAAAAGGCA | CGATTGACAGGGTGACCA | 15455 & 15456 |
| UHRF2 | GCGGATGAAGTCGACCGA | TCAGCTGAAGGTGCACCA | 15457 & 15458 |
| ULBP1 | AGTGGGAGAAGAACAGGGA | GTGCCTGGGGCCAGAGA | 15459 & 15460 |
| ULBP2 | CCCTCACCCTGCAGGCAA | TGGAAGGACATGGCCACA | 15461 & 15462 |
| ULBP3 | CAGGCTTAGCTCAACCCA | GCCAGGGAGGATGAAGCA | 15463 & 15464 |
| UMOD | CCAGGACAGATGCCCACA | CCGGAACATCTGGACGGA | 15465 & 15466 |
| UMPS | GGGGACTACACTAGAGCA | GCTTACTCGGGAGCCAGA | 15467 & 15468 |
| UNC119 | GCACTACTTCCGCAACCA | ATCAGCTCCTCGGAGAGA | 15469 & 15470 |
| UNC119B | GTGGACATCAGCGCAGGA | ACTCCACCGTAGCCCCGA | 15471 & 15472 |
| UNC13B | CCCTGAAGCTCGAGGAGA | ACTGCTGGCACACCAGGA | 15473 & 15474 |
| UNC13C | CCCAGCTAACAGACCCGA | AGGACAGGTGTGTAGGCA | 15475 & 15476 |
| UNC5C | CTGCACCGTGTCAGAGGA | GCCGGATAGGGAGAGGGA | 15477 & 15478 |
| UNC5D | ACACGGTGCCATCCCAGA | AGGAGCACCTCAGAGCCA | 15479 & 15480 |
| UNC80 | CCAGGGTTCTCCAGGGCA | TGGCCAGACGGAAGGTGA | 15481 & 15482 |
| UNG | TATCCACCCCCACACCAA | GGACAGCGTTGAGAAGGA | 15483 & 15484 |
| UPB1 | CGAGCACTTCCCGAACGA | AGCAGTCCATCCCGGCTA | 15485 & 15486 |
| UPF1 | GCCCGCTTCATGACCACA | GCATGGGTGGCATGACCA | 15487 & 15488 |
| UPF3B | GAGAGGCTGAAGCGGCAA | AGCTGCATCGCTGGACGA | 15489 & 15490 |
| UPK3A | AGACCCCATCCGCACCAA | CTGAGGGCAATGGCGCCA | 15491 & 15492 |
| UPK3B | CCCACAGCTGCTGACCGA | CGATAGGGTCCAGGGCCA | 15493 & 15494 |
| UPP1 | CAAGAAGCTGGTGCAGGA | TAGGAGCAGAGAGCCCCA | 15495 & 15496 |
| UQCR10 | CCCGCCTGAGGGGTGACA | CAAAGCAACCAATGTAGAAGCA | 15497 & 15498 |
| UQCR11 | GTCCCGACGGCCTACACA | AAGGTACCCAGTCCAGGA | 15499 & 15500 |
| UQCRB | GCCTAAAGAGCAGTGGACCA | AACAGCTGCATCCACAGA | 15501 & 15502 |
| UQCRC1 | CCCCTGGCTGAATGGGAA | AGCTGCTCAATGGGGCCA | 15503 & 15504 |
| UQCRC2 | ACTATCTCCCAGGCCACA | AGCAACTAGAGCCTGGGA | 15505 & 15506 |
| UQCRFS1 | ATTGAGCAGGAAGCTGCA | GCAATGGGTACACAGCCA | 15507 & 15508 |
| UQCRH | TGAGGAGGAGGAAGAGGA | CGAGAGGATACACGCTCA | 15509 & 15510 |
| UQCRQ | CGCGGATGCGGCATGTGA | AACTGCGGCACCACGCGA | 15511 & 15512 |
| URB2 | CACGCTCTTGGAAGCCGA | ACACCCTGGTAGAGGGCA | 15513 & 15514 |
| UROD | CCGTGATGTGGCCAAGCA | CCAACCACCTCATAGCCA | 15515 & 15516 |
| USH1C | GGAGCAGGGAGAGCAGGA | CCACCATGCCGCTCAGCA | 15517 & 15518 |
| USH2A | GTGTGACACCTGCAGAGA | TGCAAGGCAGACAGAGGA | 15519 & 15520 |
| USP1 | CAAGGAATCCAGTGACCA | AGCAACCACTTCCCCTCA | 15521 & 15522 |
| USP11 | CAACAAGGACAGCGGCCA | CTCAGAGCTGGGTGGGGA | 15523 & 15524 |
| USP12 | AGGAAGCACACAAACGGA | GGACCACTTCCACAGTGA | 15525 & 15526 |
| USP14 | AATGATGGGGTCAGCAGA | GCTCTCAAGGCACCTGCA | 15527 & 15528 |
| USP15 | GGGGACACCTGGTACCTA | AGTGACTGGGCATCACCA | 15529 & 15530 |
| USP16 | CCAAGGCAAGAACCGCAA | GTAGGCACAGCTTGCACA | 15531 & 15532 |
| USP18 | GCACGTGGGAATGGCAGA | GTCTTCCCAGGACACCAA | 15533 & 15534 |
| USP21 | GCCAGTGACAAAGCCGGA | ACCAGTCTGGCACCGGCA | 15535 & 15536 |
| USP25 | GGCATTGGGAAGACCAGA | CGTTTGGGACCGGAACCA | 15537 & 15538 |
| USP26 | TGGCAATGCACAGAACGA | AACCCACTGGTGTCAGGA | 15539 & 15540 |
| USP28 | GAAGGTGGCTCAAGCGAA | CCCTTCATCAGCAGGGCA | 15541 & 15542 |
| USP29 | TGCAAGCCAAGAGCAGCA | CCATCAGTGAGTCAGCCA | 15543 & 15544 |
| USP3 | GTCCACACCTGAGCTCCA | GGACCGGCACACGCTGCA | 15545 & 15546 |
| USP40 | CCCTCCATGAGCAGAGCA | TCCCCACGTGGATGGAGA | 15547 & 15548 |
| USP6 | GCACTGTGCATACCCGGA | CTGTGGGCACCAAGCACA | 15549 & 15550 |
| USP9Y | CCAGAGGAACAAGGGCAA | GCAAAACAGGAACCACCCA | 15551 & 15552 |
| UTP20 | AGTAGCCCCAGCACCAGA | CTCAGATGCAGCAGCCGA | 15553 & 15554 |
| UTY | CCCAGTATCACCAGGCAA | GAGAGGTGACTGTCAGCA | 15555 & 15556 |
| UVRAG | AAACGGAGGCCACGCGAA | ACTCGCCTGGAAGCTGGA | 15557 & 15558 |
| UXS1 | GAAGTGCGAGTGGCCAGA | CCTGGAGCGCCTGCAGGA | 15559 & 15560 |
| UXT | GGAAGCTAAGCACTCGGA | AGGAGAGAGCTCTTACGA | 15561 & 15562 |
| VAMP1 | AGCAGTGCTGCCAAGCTA | ACTACCACGATGATGGCA | 15563 & 15564 |
| VAMP2 | AGCCAAGCTCAAGCGCAA | GATGAGGATGATGGCGCA | 15565 & 15566 |
| VAMP3 | GGTTCTGGAAAGAGACCA | GAGAAGCGCCTGCCTGCA | 15567 & 15568 |
| VAMP4 | ATTGAGAGAGGGGAGAGA | TGCATCCACGCCACCACA | 15569 & 15570 |
| VAMP5 | CAGCAGCGTTCAGACCAA | TCAGGATGATGAGCAGGA | 15571 & 15572 |
| VAMP7 | GGTTCAAGAGCACAGACA | AGCTGTGCAGCTAAGACA | 15573 & 15574 |
| VAMP8 | GCGGAACCTGCAAAGTGA | GGGCCAGGATCCGCTCCA | 15575 & 15576 |
| VANGL1 | CAACGGCATGACCCCCAA | GAGGCTGAAGTCCAAGCA | 15577 & 15578 |
| VAPA | CTGTGTGGAAAGAGGCAA | GAAGTGACAGTCGGAGCA | 15579 & 15580 |
| VASH1 | AGAAGGTGGCGCAACGGA | ACAGCTTCCAGGCGCTCA | 15581 & 15582 |
| VASP | GACCACTTCCGAGACCCA | CCTCAGCTCCTGGACGAA | 15583 & 15584 |
| VAV1 | ATCGCAGGGCTCAGGACA | TGAGGAGGGCCATGGACA | 15585 & 15586 |
| VAV2 | GGCACCTTCTACCAGGGA | ACCCTCCCACCACGGAGA | 15587 & 15588 |
| VAV3 | GTCCAAAAGTGCTGGGCA | AACCAGCCCACCCTGCCA | 15589 & 15590 |
| VBP1 | GCTGGATGAACAGTACCA | TACATTAGCCCCCAACCA | 15591 & 15592 |
| VCAM1 | CAGGCTGGAAGAAGCAGA | CGGATGGTATAGGCGCCA | 15593 & 15594 |
| VCAN | GGCACAGACCACTGAGCA | GGCAGCAGCTTCTCCAGA | 15595 & 15596 |
| VCL | CCACAGTGAAGGCCACCA | GGGCATTGTGAACCAGCA | 15597 & 15598 |
| VCPIP1 | TGCCACCACAGGCAGGAA | GCTGCAGCAGACTGACCA | 15599 & 15600 |
| VDAC1 | GGTACAAGCGGGAGCACA | GGCCAGCCAGCCCTCGTA | 15601 & 15602 |
| VDAC2 | CATCAGGTACCAACTGCA | AACTCCAGGGCGAGCCCA | 15603 & 15604 |
| VDAC3 | CCTTCACCCAGAAATGGA | CTGATAGCCAGCAAGCCA | 15605 & 15606 |
| VDR | CGTGACCAAAGCCGGACA | TCCTGCACCCCAGGACGA | 15607 & 15608 |
| VEGFA | TCAGCGCAGCTACTGCCA | CAGTGGGCACACACTCCA | 15609 & 15610 |
| VEGFB | CCTGGAAGAACACAGCCA | ACAGAACGGGGCTGGGGA | 15611 & 15612 |
| VEGFC | ACAAGACCTGCCCCACCA | CCACAGCTGGCAGGCCGA | 15613 & 15614 |

FIG. 1 Cont.

| | | | |
|---|---|---|---|
| VEPH1 | GACATACCTGGTGAGCCA | AGGGCCCAAGATTGAGGA | 15615 & 15616 |
| VEZF1 | CCATCGCTGGGGACAGCA | CAGACTGGGTCACTGGCA | 15617 & 15618 |
| VGF | CCCTTCCCGAAACCCACA | CCTTGGACAGGGGTGCCA | 15619 & 15620 |
| VHL | CCACAGCTACCGAGGTCA | GGCTCCGGACAACCTGGA | 15621 & 15622 |
| VILL | TGGACACCTGGCAGGAGA | CCTGCTTGACCAGCACGA | 15623 & 15624 |
| VIM | CAATGACGCCCTGCGCCA | CACGAAGGTGACGAGCCA | 15625 & 15626 |
| VIP | GGGAGCAAATGAACCTGA | CCATCAGCATGCCTGGCA | 15627 & 15628 |
| VIPR1 | GAACCCCAAATACCGGCA | GGCTTGGAAGCTGGAGGA | 15629 & 15630 |
| VIPR2 | GTACAAGAGGCTGGCCAA | AGTAGAGGACGGCCACCA | 15631 & 15632 |
| VIT | CAACTTCGCCCTGGAGCA | CCTTCAGATGGGCAGCCA | 15633 & 15634 |
| VKORC1 | CGCTCTGCGACGTGGGCA | AGCGAGAGACACCAGGGA | 15635 & 15636 |
| VKORC1L1 | GCGGGAGAAGGAGCGGGA | GTAGGCCAGGTACAGGGA | 15637 & 15638 |
| VLDLR | GCCTGCCAGCACCACAGA | AGAATGGCCCATGCGGCA | 15639 & 15640 |
| VMO1 | CGTCCTAGGCAATACGCA | GTGGGTGCCTCCACGCGA | 15641 & 15642 |
| VN1R4 | GCACAGACACTGCGTGCA | GGGAGGCTCTGGGGGAGA | 15643 & 15644 |
| VNN1 | GTACCCAAGGAGCCTGAGA | CCTCATGCCCATAGCCCA | 15645 & 15646 |
| VNN2 | ACAACTTGTGGACGGCCA | ATAGGCCCAGATGATCCA | 15647 & 15648 |
| VNN3 | GCACACAGTAGAAGGCCA | GGGGCAAGCTGACTCCCA | 15649 & 15650 |
| VOPP1 | CGGCCCAGGAGCCCAGCA | GCCATGGAATTCCCGACA | 15651 & 15652 |
| VPREB1 | TGAGGAACGACCATGACA | CTCAGGCTGCAGCTCAGA | 15653 & 15654 |
| VPREB3 | ACCAGCAGCGGGCAGGCA | CCGAGAATCGATCGGGGA | 15655 & 15656 |
| VPS28 | CATGCACCGCATGAGCCA | ACGCCGACATGCCGCTCA | 15657 & 15658 |
| VPS37B | CTCCCCACTCAGCAAGGA | CCGGCTGGTGTGGAGGGA | 15659 & 15660 |
| VPS37D | GCATCGCTGGAGTCCCCA | AACGCTCCCGACGCCGCA | 15661 & 15662 |
| VPS45 | CTCTCATCAGAGGCAGCA | AGCAATGGGGTGATGGCA | 15663 & 15664 |
| VPS4B | CAGTCTCACGGAAGCAGA | TCAATGGCACCAGGGTCA | 15665 & 15666 |
| VRK1 | GCTGCAAAACCAGAGCAA | ATGTAGACCAGACCCCCA | 15667 & 15668 |
| VRTN | GGCTGAGGAGAAGCAGGA | TGGCTCAGCAAGGGCCCA | 15669 & 15670 |
| VSIG1 | TCAGGAGCCTGCCCCAGA | GCTCCAGCTCCAGCTCGA | 15671 & 15672 |
| VSIG10 | CCAGCTGTCGGATGGCAA | AGCGTCACATTGCCCCCA | 15673 & 15674 |
| VSIG4 | TGCCCCAGGGAATGAGGA | GGCCCTTGGCAGTGCAGA | 15675 & 15676 |
| VSTM1 | GAGCTCGGCAGAAAACGA | TGCAGCTGAAGATGGCGA | 15677 & 15678 |
| VSTM2A | AGGGGCAGAATGTGGAGA | TGTCGGGCAAGAGCTCCA | 15679 & 15680 |
| VSTM2B | CCGTAGCTACACCACAGA | CCAAGAGCAGGCGCAGGA | 15681 & 15682 |
| VSTM2L | CGACTTCAGCGACGGCAA | CGGGAGGGGCTTCGGGCA | 15683 & 15684 |
| VTCN1 | TGCCAAAGCAACAGGGGA | GCATCAGGTAAGGGCTGA | 15685 & 15686 |
| VTI1A | CGTGAAAGACTTCGGGAA | TCCCTAGGATGACGAGCA | 15687 & 15688 |
| VTN | CTGCCACCTGTGAACCCA | CCAGCCAGTACTGAGCGA | 15689 & 15690 |
| VWA1 | CCAGCAGCTGCCAGGGAA | GCACGTTGGACTCAGGCA | 15691 & 15692 |
| VWA2 | CTGCCCAGAAGCTGAGGA | CCCACTCACCTCCACACA | 15693 & 15694 |
| VWA3B | GAGAGAAGCCCAGGAGGA | GCTGATGCCGTGGGAGGA | 15695 & 15696 |
| VWA5A | ATGCCCAGCTGACCGGGA | AGCAAGGACTTGGCAGCA | 15697 & 15698 |
| VWA5B1 | TCCAGGCTACTGACGCGA | CCGGAGGTCGACTCCACA | 15699 & 15700 |
| VWC2 | CCACGTCGACACGAGCCA | ACACACTCCGTCTGGGGA | 15701 & 15702 |
| VWCE | GGGAAGGAAGGTGGCGAA | AGCAGTCCCCAGGAAGCA | 15703 & 15704 |
| VWDE | GAAAACAACCAGCCCCCA | TGCCCCTTCAGGACCAGA | 15705 & 15706 |
| VWF | ACTGCAGCTCAGCCCCAA | GACACTGCTCCTCCAGGA | 15707 & 15708 |
| WARS | CGACGACAAGCTCGAGCA | CTGCGATCAAGGGCTGCA | 15709 & 15710 |
| WAS | CAGGGCAGGAATCAGCGA | ACAGGGGGCAGTGGACCA | 15711 & 15712 |
| WASF1 | GAGCAGCGTGAACAGGAA | AACAGCAATACGGCGAGA | 15713 & 15714 |
| WASF2 | CAGCCAACAGGAGGAGCA | AGCAGGTCGCTACGGGCA | 15715 & 15716 |
| WASF3 | AGCCTGCACAGCCACCAA | CGCTGTACTCCACGGCAA | 15717 & 15718 |
| WASL | ACAGCTGCACCTCCACCA | CCACTGGCCCTACCCCCA | 15719 & 15720 |
| WBP11 | CCTGGCATGATGCGCCCA | CCAGGGTTTGGCAAGGGA | 15721 & 15722 |
| WDR24 | GCACGTCAACTGCAGCCA | TGCAGCCCTGGCACCACA | 15723 & 15724 |
| WDR25 | AGAGGTTCACCTGCCCCA | CCACTGAGTAGCCCTCCA | 15725 & 15726 |
| WDR33 | CCCACGAGGAGGAAGGAA | TGACCGTCGTGAGGGGGA | 15727 & 15728 |
| WDR37 | CCCCCATGACAACCGACA | ACTCCATGCCGAGCAGCA | 15729 & 15730 |
| WDR43 | GGAAGACCTCCAGACGAA | AGGCAACGTGGACAGGTA | 15731 & 15732 |
| WDR48 | TCCCTTGGCCAGCAGAGA | AGGAGGAGGATCAGCTGA | 15733 & 15734 |
| WDR49 | AACCTCATGAGGACCGAA | ACAGGAGCATTGCAGACA | 15735 & 15736 |
| WDR59 | CGCCCATGAAGATCCGCA | GTGAACAGGCAGGAGGCA | 15737 & 15738 |
| WDR72 | CGGTCAAGCATGACAGCA | AGGCACATCTGTCAGGCA | 15739 & 15740 |
| WDR74 | TGAAGGGGCTGGCAGGCA | CCCTGCCTGACAAGAGGA | 15741 & 15742 |
| WDR75 | ACACAGGCAACAGCAGGA | AAGCAGCAGATGGCAGGA | 15743 & 15744 |
| WDR90 | CGTCGGTTACAGCGGGAA | AGTGCAGGTCCTCCACCA | 15745 & 15746 |
| WDR91 | CCCTGGATCCAGAACCCA | AACAGCCGGATGACGCCA | 15747 & 15748 |
| WEE1 | TGCCTCTGAAGAAGGAGA | ACTGTGAGGGCAAGCGCA | 15749 & 15750 |
| WFDC1 | CCTGGATGGCCCTGAGGA | GTGGCACTCATAGCCCGA | 15751 & 15752 |
| WFDC10A | CAAAGTCTGCCAGCAGCA | CATGCAAACATTCCCACA | 15753 & 15754 |
| WFDC10B | GTGAGAAGCGACCCAGCA | ACAGAAGGCTGAACAGCA | 15755 & 15756 |
| WFDC11 | GGGGAAAGCCAAATGTCA | TCCACAATAGGTCCAGCA | 15757 & 15758 |
| WFDC12 | CAAGTCCGATCCTCCCCA | ACTTGAAGCCACAGTGCA | 15759 & 15760 |
| WFDC13 | CCACCCTGCATATCAGCA | TATCCCACAGAAGGAGGA | 15761 & 15762 |
| WFDC2 | TGCGTCTCGGACAGCGAA | CAGAGGCCGAGCTGGGGA | 15763 & 15764 |
| WFDC3 | GCACCTGCCTCGGAGACA | GGGACACAGAAGCGGCCA | 15765 & 15766 |
| WFDC5 | ACTCAGACTGCTCGGGCA | TCTGGCAGGATCCCGGCA | 15767 & 15768 |
| WFIKKN1 | CACGGAGGTGCTGGAGGA | CATGTTGGGGCAGGGGCA | 15769 & 15770 |
| WFIKKN2 | CTCTGAGCTGACCGAGGA | CCCAGTCCACGTGAAGCA | 15771 & 15772 |
| WFS1 | CATCGACAACAGCGCCGA | GCCAGCAGCTTAAGGCGA | 15773 & 15774 |
| WHSC1 | CCACGAAGCAGGAAGGGA | ACAGGGGCCACCAGGGCA | 15775 & 15776 |
| WHSC1L1 | GTGCGGCCAAAGTCGGCA | TCGCACTGATGCCACGGA | 15777 & 15778 |

FIG. 1 Cont.

| | | | |
|---|---|---|---|
| WIF1 | CAGGATGGGGTGGCAGCA | CCCATCAGGACACTCGCA | 15779 & 15780 |
| WIPF1 | GTCCCAGGAGTGGACCCA | GGAGAGTCTTGGAAGCCA | 15781 & 15782 |
| WIPF2 | CACCCTGGTCGAGAGGGA | GGTCCATTGGGGACCCCA | 15783 & 15784 |
| WIPI1 | CTACCCAGGTGTCAGACA | CAACTAGCAGCCGTGGCA | 15785 & 15786 |
| WISP1 | GCGGGCTGCATCAGCACA | CCATAGGACCTGGCGGGA | 15787 & 15788 |
| WISP2 | TGGGTGTGCGGCCAAGGA | AGGGAAGAGACAAGGCCA | 15789 & 15790 |
| WISP3 | AGTGAGCCTGGTGAGAGA | GGTTGAACTCGCACCCAA | 15791 & 15792 |
| WIZ | CAGCAGAGGTCAAGGCCA | GTCTCGATGGGCGAGCCA | 15793 & 15794 |
| WLS | AGTCCAGCCTGCCAGCTA | TCATGGCAGCGCAGGCCA | 15795 & 15796 |
| WNK1 | CCAGAGGGTGATCAGGGA | GGCATGGAAGACGCAGGA | 15797 & 15798 |
| WNK4 | GGCTGGAGTTGAGGAGGA | ACTCTGCAGCTCAGCCCA | 15799 & 15800 |
| WNT1 | GCGCGTCCTGTACGGCAA | CGTGCAGAAGTTGGGCGA | 15801 & 15802 |
| WNT10B | GGGCCTGCAACAAGACCA | GCACCAGTGGAAGCGGCA | 15803 & 15804 |
| WNT11 | CGGGACACAAGACAGGCA | GCAGGTGACGTAGCAGCA | 15805 & 15806 |
| WNT16 | CCAGGGACACAAGGCAGA | TCCACGTGCCTGACCACA | 15807 & 15808 |
| WNT2 | GGCTCCCTGGGTACAGCA | CATCCGGGTGACATGGGA | 15809 & 15810 |
| WNT3 | ATGTCACCTCCCACGGCA | CGTAGCAGCACCAGTGGA | 15811 & 15812 |
| WNT3A | GATGGTGGTGGAGAAGCA | AGGCCTCGTAGTAGACCA | 15813 & 15814 |
| WNT4 | TGCGGCTGTGACAGGACA | CTCTCCCGCACATCCACA | 15815 & 15816 |
| WNT5A | ACAAGACGTCGGAGGGCA | GCACTTGACGTAGCAGCA | 15817 & 15818 |
| WNT5B | ACAAGACCTCGGAGGGCA | CGAAGCAGCACCAGTGGA | 15819 & 15820 |
| WNT6 | CGTCATGGGCACCAACGA | GCACCAGTGGAAGCGGCA | 15821 & 15822 |
| WNT7A | ACAACGAGGCAGGCCGAA | CCTTGAGCACGTAGCCCA | 15823 & 15824 |
| WNT7B | CCGACGTGCGTTACGGCA | GGGCAGCGTGGTCCAGCA | 15825 & 15826 |
| WNT8A | CCTAGCGCAGAGGCGGAA | ACAGCTACGTCGCTCCCA | 15827 & 15828 |
| WNT8B | AGGCGGTGAAGGGCACCA | TGCCAGCACCCTGCAGCA | 15829 & 15830 |
| WNT9A | CCATGAGGTGGGCAAGCA | GGGAGAAGCGGCCAGCCA | 15831 & 15832 |
| WNT9B | ACATGGAGGACTCACCCA | CGTAGCAGCACCACTGCA | 15833 & 15834 |
| WRAP53 | GTCGAGAGGTGACCACCA | CCGTCCGTGTCCCACACA | 15835 & 15836 |
| WRN | CGGCACAAGAGCAGGAGA | AGAGGGGCCAACATGGCA | 15837 & 15838 |
| WSB1 | GTCGGAGCCAGTAAAGCA | GATCGTACCCACCGGTCA | 15839 & 15840 |
| WSCD1 | GAGCAAAGAGTGGCCGGA | CGTTGAGGAAGGCCACCA | 15841 & 15842 |
| WSCD2 | GGGCAAAGAGTGGCCAGA | TGACAGCCACGCCCAGCA | 15843 & 15844 |
| WT1 | CGACCACCTGAAGACCCA | TGACAACTTGGCCACCGA | 15845 & 15846 |
| WWC1 | GAGGCTTCCGTGCAGAGA | GAATTCGGGTCGCACCCA | 15847 & 15848 |
| WWP1 | AATGTGTCCCGGCAGACA | AAGCGCCTCCTCAAGTCA | 15849 & 15850 |
| WWTR1 | CTGTCAACCCACCCACGA | GGACACTGTAGCACCCTA | 15851 & 15852 |
| XAF1 | AGCCCAAGCCCAGGACCA | TTAGGATCGGCAGGGGAA | 15853 & 15854 |
| XAGE1B | ACACCTGGGCAGCAGACA | CCTTGACGCCGGAACCCA | 15855 & 15856 |
| XAGE1E | TCCTACACCTGGGCAGCA | CTTGACGCCGGAACCCAA | 15857 & 15858 |
| XBP1 | CCTGGAGGAGCTCCCAGA | ATGACGTCCCCACTGACA | 15859 & 15860 |
| XCL1 | GTGAGCCTCACTACCCA | GACCACGTCTCTCACCCA | 15861 & 15862 |
| XCR1 | CCGGAGCTGCGAGGCCAA | TGCGGAACTTGACCCCCA | 15863 & 15864 |
| XDH | GGCGGCTGTGCAAAACCA | CTCTGCAGGCATCCCACA | 15865 & 15866 |
| XIRP1 | GGCAACAGCTGAAGCCCA | GGATCACTTCCACCCCCA | 15867 & 15868 |
| XIRP2 | CAACAGAAGCTGCCCGCA | GCACCTCCACTCTGGGAA | 15869 & 15870 |
| XK | CCCTGACCTCATCAGCAA | CAATGAGCAGCTGCAGGA | 15871 & 15872 |
| XPC | GCCGAGACCTTGAGACCA | AGATGCCGCTTCAGGGCA | 15873 & 15874 |
| XPNPEP1 | CTTGCACGGGACTGGACA | CCGGGCTCATCAGTGACA | 15875 & 15876 |
| XPNPEP2 | GCGCCAGCTACTAGAGGA | GGATGGCAAGGGTGGAGA | 15877 & 15878 |
| XPO1 | GCACAAGAAGAAGCTGCA | TAGGTGAGGGAAGGCCGA | 15879 & 15880 |
| XPO7 | AGCTGCTACAGAGCGCCA | CGACAGACAAGCTCACCA | 15881 & 15882 |
| XPOT | GCAAGCCTCTCTAGCAGA | GCAGATGGAATGAACGGA | 15883 & 15884 |
| XRCC1 | GGTGGCAGAGCAGAAGGA | GGGACTGGCAGATCAGGA | 15885 & 15886 |
| XRCC2 | TGAGCACAGACTATCCCA | AAGCTGACAGGCTATCCA | 15887 & 15888 |
| XRCC3 | ATGGAGGAGCAGGGCGCA | GGGCAGAGAGCACCCGCA | 15889 & 15890 |
| XRCC5 | GCAAGAGATGATGAGGCA | GCCACGCCGACTTGAGGA | 15891 & 15892 |
| XRCC6 | GCAGCAGCACTTCAGGAA | CATCCACCAAGGAGCCCA | 15893 & 15894 |
| XRN1 | TCAGACTAGCCAGCCAGA | AGGTTGAGCAATCGGAGA | 15895 & 15896 |
| XYLT1 | TCGCAGCCACCTACGACA | GAGAAGGTCAGAGGCGCA | 15897 & 15898 |
| XYLT2 | CAACCTGCGGGTCACCAA | AGACTTGCTGCAGCCGGA | 15899 & 15900 |
| YAP1 | GCTGCGGCTGAAACAGCA | ACTGGCTACGCAGGGCTA | 15901 & 15902 |
| YBX1 | TACCGACGCAGACGCCCA | GGAGCGGACGAATTCTCA | 15903 & 15904 |
| YBX2 | CAGCAGGGAGATGAGCGA | CGGGAACCATCAGCGGGA | 15905 & 15906 |
| YBX3 | TGCCCCAGCAGTTGGAGA | TAGGGACGCCGGTATCCA | 15907 & 15908 |
| YEATS4 | CTTGAAGAAGATGACCAAGCA | CCTCTAAGAAACATCACAGCA | 15909 & 15910 |
| YES1 | CACAGCAAGACAAGGTGCA | AGCCCTGAGGGCACGGCA | 15911 & 15912 |
| YIF1A | GAAAAGGTTCTCCCCGGA | ACAGCAGCCCCGTGAGCA | 15913 & 15914 |
| YIPF6 | CGGGGACAGCATCGCCCA | CCCGGATGCGAGATCTCA | 15915 & 15916 |
| YKT6 | AGATCCAGCGTTCAGGAA | GCAATGACCACACCTGCA | 15917 & 15918 |
| YPEL1 | CCTGGCCAATCATGACGA | CCGCATGCAGCCCGGTGA | 15919 & 15920 |
| YPEL5 | CCGCCACATGGTTCGAGA | CTAGAGCACGTTCCAGGA | 15921 & 15922 |
| YRDC | TGCCAACCTCAGCTCCCA | ACAGTTGAGCCAAGGCGA | 15923 & 15924 |
| YTHDC1 | GGACGTGATGGACAGGAA | GGTCGACGCCTTCCCACA | 15925 & 15926 |
| YTHDF2 | TGTCAACGGCAGTGGACA | TGGGACCACACACCTGCA | 15927 & 15928 |
| YWHAB | AGCCTGGCAAAAACGGCA | CCGATGTCCACAGAGTGA | 15929 & 15930 |
| YWHAE | GCTGCGGAGAACAGCCTA | AACCTGCAGGCACGGTCA | 15931 & 15932 |
| YWHAG | CGAGAAGGCCTACAGCGA | AGTTAAGAGCCAGGCCTA | 15933 & 15934 |
| YWHAH | GCTGGACACACTAAACGA | CGCTCGTCCAGAGGGTGA | 15935 & 15936 |
| YWHAQ | TCGAGCAGAAGACCGACA | CTTCAGCAAGGTACCGGA | 15937 & 15938 |
| ZACN | AGGGGAACAGCGAGAGCA | GTCAGCAGTCTCAGGCCA | 15939 & 15940 |
| ZAN | GGCTATACCAGCGGAGGA | GTCTGGTGACAGGCAGCA | 15941 & 15942 |

FIG. 1 Cont.

| | | | |
|---|---|---|---|
| ZAP70 | CTTCATCGAGCAGGGCAA | CTGCTCCACGGTCAGGA | 15943 & 15944 |
| ZAR1 | CCCGGAGCTGGGCAAGGA | CCCTGTACACACCACACA | 15945 & 15946 |
| ZBP1 | CCACCATCGGCAACAGCA | GTGTCTGCGGGACGACGA | 15947 & 15948 |
| ZBTB10 | GGGCCAGATGGTGATAGGA | GGACCAGGCATCAAACCA | 15949 & 15950 |
| ZBTB16 | GCATCAGCTGGAGACGCA | GGTGCACTGGTAGGGCGA | 15951 & 15952 |
| ZBTB17 | GTGCAGCGTGTGCAGCAA | CGGTTGAAGCCACGCCCA | 15953 & 15954 |
| ZBTB32 | GATGGAGACGCACTACCGA | CTCGAGGAGGAGTAGAGGA | 15955 & 15956 |
| ZBTB7B | CATTCCCGGACCACAGCA | GCTACAGGCAGCTAGCACA | 15957 & 15958 |
| ZC3H11A | CCCCCAGCCAAAAAGGCA | TGGGATGAGGAAGGGCCA | 15959 & 15960 |
| ZC3H12A | GAGCCCCAAGCAAGGACA | CCTGGGAGACGTACGGGA | 15961 & 15962 |
| ZC3H14 | CCTGCAAAGCCTTCCCCA | AGCAGGGAAGTAACGGCA | 15963 & 15964 |
| ZCWPW1 | GCCTCCTACATCCCAGGA | GACTGATAGCTCCAGGGA | 15965 & 15966 |
| ZCWPW2 | CAAGTGAGGATTCAGCCA | CCTGGCCAACTTGGCCAA | 15967 & 15968 |
| ZDBF2 | GGCAGACCTTCAGAAGGA | CACTATCACCGGGCACCA | 15969 & 15970 |
| ZEB1 | CACCAAGTGCCAACCCCA | ACTGCAGGGCTGACCGTA | 15971 & 15972 |
| ZEB2 | GTCCCCAACAAAGCCGGA | TGAGGAAGGCCCACAGCA | 15973 & 15974 |
| ZFHX3 | GCCACAGCACCAGAACCA | CAACCCCAAGCTCGCAGA | 15975 & 15976 |
| ZFHX4 | GCAGCGAAACGTCCAGCA | ACGCGTTTGGGCAGACCA | 15977 & 15978 |
| ZFP112 | GGCTTCAGTCAGAGAGCA | TCAAGGCGCGAACTCTGA | 15979 & 15980 |
| ZFP36 | CGAAGAGACCCCACCCCA | TCCCAGGGACTGTACAGA | 15981 & 15982 |
| ZFP36L1 | CCTGCCCGATGGCACCAA | CATGTGAGGGGACTCGGA | 15983 & 15984 |
| ZFP36L2 | GACCGCGACAGCTACCTA | AGATGGAGAGGCGGCTGA | 15985 & 15986 |
| ZFP64 | GGCCAAGATCGTGACGCA | CTGAGCTGTCCCGAGGCA | 15987 & 15988 |
| ZFPM2 | GACGACCACGTCTCCCAA | ATGTGCAGTAACCGGGCA | 15989 & 15990 |
| ZFYVE20 | GCTTACCCCAGAGCAGCA | ACCCCTGCAGCAGGAGGA | 15991 & 15992 |
| ZFYVE21 | GACGGAGGGTGTGACCCA | TGGCCACTAGCCACGCCA | 15993 & 15994 |
| ZFYVE26 | GAATCCCTGACCCCACCA | TCACGGTGTCGGACAGCA | 15995 & 15996 |
| ZFYVE9 | CCCAGAGAGCAGAGGCGA | GGTCGTGTGACACAGCCA | 15997 & 15998 |
| ZG16B | GGTCATGTACACCAGCAA | GCTGGGGTAGGCAGAGGA | 15999 & 16000 |
| ZHX2 | GGCGGAAGCTTCGAGACA | CTCCTGGGGAGTAGGCCA | 16001 & 16002 |
| ZIC1 | GCCAGCTCTGGCTACGAA | GTGGACTGCGGAGGAGGA | 16003 & 16004 |
| ZIC3 | AGTCCTACACGCACCCGA | TAGCCTGAACTGGCAGCA | 16005 & 16006 |
| ZIC4 | AGCATTCGCACGTGCACA | GGCAGACGGTGTAGCCGA | 16007 & 16008 |
| ZIM2 | GGGGCAGAAGCAGAGACA | CCTCAGCGAGGTCCACCA | 16009 & 16010 |
| ZMAT3 | GAGCCTGCAGCTACTCCA | GATAGTGAGCCTGAGCCA | 16011 & 16012 |
| ZMIZ1 | CAGCCATCCACACAGCGA | GGGAAGGAGATCCAGCGA | 16013 & 16014 |
| ZMYM2 | ATGACAGGTTCAGCACCA | ACAGGAACTGGCACAGGA | 16015 & 16016 |
| ZMYM3 | GCTGCAGACAGCTGAGGA | ACTTGACAGGGCAGCGGA | 16017 & 16018 |
| ZMYM4 | GCCGGAGGAGGTAGCACA | ACATGCTGGGACTGGGCA | 16019 & 16020 |
| ZMYND10 | GCTGCTCACGATGCCAGA | CTGGGCTGCCAGGACACA | 16021 & 16022 |
| ZMYND11 | CCACGATGCCTCAGCCCA | GGGTGCTCCGATGCAGCA | 16023 & 16024 |
| ZNF135 | GAGGACCCACACAGGAGA | CCGGAAGGCCTTCCCACA | 16025 & 16026 |
| ZNF160 | GCAAGGTCTTCAGGCACA | AGTGAAGAGCTTGCCACA | 16027 & 16028 |
| ZNF165 | GAGAGGAGGCAGTGACCA | CTGGTCCAGGAGGTGACA | 16029 & 16030 |
| ZNF177 | TCCCAGGAGGAGTGGGCA | GATACCCTACTGAGGCCA | 16031 & 16032 |
| ZNF185 | GCTCCAGAGAGCTCCAGA | GTGGCTCCGGATCCCACA | 16033 & 16034 |
| ZNF205 | TAGTCACCCACCAGCGCA | CTTGCCGCAGTCGAGGCA | 16035 & 16036 |
| ZNF207 | CCCATCGGTAATCCACCA | TGACCACCATACTGACCA | 16037 & 16038 |
| ZNF217 | GCACCAGAGACTGGAGCA | AACTAGAGAGGGGAGGCA | 16039 & 16040 |
| ZNF222 | GGACCCTGCCCAGAGGAA | GATGCCCCACTGAGAGCA | 16041 & 16042 |
| ZNF226 | GAGAGTCCACAGTGGAGA | CTTACCACACTCCCCACA | 16043 & 16044 |
| ZNF26 | AAGAGCCTTCAGTGCCAA | CCACATTCACTGCAGCCA | 16045 & 16046 |
| ZNF268 | CCCTAGGGTACCAACACA | GAACTTGGGCCTGCACCA | 16047 & 16048 |
| ZNF277 | GATGGGAGCTGCAGCACA | ACAAGGCACAGATGGAGA | 16049 & 16050 |
| ZNF280C | CGTTGCCCAAAATGCAGA | AGAAGTGCCTGGAGCGCA | 16051 & 16052 |
| ZNF285 | AGGGAGTACACACAGGGAA | AGTGGACTTGAAGAACGGA | 16053 & 16054 |
| ZNF286A | CACGGCCAGATCCCAGGA | GGTTTGGAAACTGGAAGCCA | 16055 & 16056 |
| ZNF292 | AACCCACCGAAAGGAGCA | GGGCTTCAGGAGGCAGCA | 16057 & 16058 |
| ZNF319 | TGGTGCACCACAAGCGCA | CTGCAGCAGCTCCGACGA | 16059 & 16060 |
| ZNF324 | CTCCAACCTCAGCCAGCA | CAGGTGCGAGTTGCGGCA | 16061 & 16062 |
| ZNF331 | GGGGAGAAGCCCTACGAA | AGCTCATCACCACGCCGA | 16063 & 16064 |
| ZNF34 | CCAGCTCTTGGGACCAGA | GGCTCAGATCCCTGGGGA | 16065 & 16066 |
| ZNF365 | GAACTCCTGAAACCGGGA | GGGCAGTCCAGGACCCGA | 16067 & 16068 |
| ZNF384 | CTTCAGCAGCACACCCGA | GGGACTGCAGATTGGAGA | 16069 & 16070 |
| ZNF391 | TCAGCATCAGCGAACTCA | GCGATGAGATCCAACTGA | 16071 & 16072 |
| ZNF395 | CTTCAGCGAGCCCCAGCA | GCCATACACCTTGCGGCA | 16073 & 16074 |
| ZNF407 | CAAGGACGGTGTCACCCA | GCACCATGGCCTGGACCA | 16075 & 16076 |
| ZNF414 | CACAGTCCCTGGAAGGCA | GGTGCGTGCGGAAGCGCA | 16077 & 16078 |
| ZNF419 | TACAGACCATGAGGAGCA | AACAACCCAGAGAGGCCA | 16079 & 16080 |
| ZNF423 | AGCACAGCTTCGAGGGCA | CTGAGGGCACTGTGAGCA | 16081 & 16082 |
| ZNF433 | CACACGGGGGAGAAGCCA | CTGCGAACAGAACTGGGA | 16083 & 16084 |
| ZNF442 | CTCACACTGGAGAGAAGCCA | GCAGAAGGCAAGTGAGCCA | 16085 & 16086 |
| ZNF449 | GGAGAGAAACCTCACCGA | ATAAGATGTGACCGCCGA | 16087 & 16088 |
| ZNF488 | GTGGCTGGAGCATACCCA | CTCCTGGCACACAGGGCA | 16089 & 16090 |
| ZNF497 | TCCTGCAGCACCAGCGCA | CTTGCCGCAGTCGGCGCA | 16091 & 16092 |
| ZNF511 | CATCCTGGAGTGGCACGA | GCAGCCTTCTACCAAGCA | 16093 & 16094 |
| ZNF521 | CAGTCACCAGCAACCGGA | AGTCGTACTGGACACGGA | 16095 & 16096 |
| ZNF536 | GGAGACTCTGGGAGAGCA | GGGATCAGGATGGGGACA | 16097 & 16098 |
| ZNF560 | TTCAGCACTGCAGCAGGA | GGGTGAACTCCACAGCCA | 16099 & 16100 |
| ZNF569 | GCCAGAAGCAAAGCCTCA | GCAAGGGATGCAATTCGA | 16101 & 16102 |
| ZNF570 | GGAAAGCATTCAGCCAGA | TTGGGCAAGGGATCCACA | 16103 & 16104 |
| ZNF572 | GTGGGAAGAGATTCAGCA | CTTCCCACAATCAGGGCA | 16105 & 16106 |

FIG. 1 Cont.

| | | | |
|---|---|---|---|
| ZNF638 | GCAAGAGCGGATCCCACA | AAGGGAGACCGAATGGGA | 16107 & 16108 |
| ZNF646 | TGCGGGAGCATGAGGAGA | GGTACTGGCTCAGCACCA | 16109 & 16110 |
| ZNF668 | GCCGAGAGTGCAAGGAGA | CTTGGGACAATGGGGGCA | 16111 & 16112 |
| ZNF687 | GAGCCTGACAGCACGACA | CAAGCCACAGTCGAGGCA | 16113 & 16114 |
| ZNF69 | CAGGCTGAACTTCCAGGA | CCAACTTCTCCACACACA | 16115 & 16116 |
| ZNF691 | TGTGCATCACCGGACCCA | TCGCTGAAGGTCCGCCCA | 16117 & 16118 |
| ZNF707 | GACACCAGCTGGTGCACA | CTTGGGCCACCGGAAGGA | 16119 & 16120 |
| ZNF750 | CTCTACCCGCCAGAGCAA | GCGGCCTCCGAGACGAGA | 16121 & 16122 |
| ZNF773 | TCCCAGGAGGAATGGAGA | GTCACAACTTCCCAAGCA | 16123 & 16124 |
| ZNF786 | GTGCAAGCTCCGTGAGCA | CTTGCCACACTCCCCGCA | 16125 & 16126 |
| ZNF799 | GGACTCACACAGGAGAGA | AGCAAGTGAGCCAAGAGA | 16127 & 16128 |
| ZNF804A | GTCCTGGGAACCAGCCAA | GACAGTAGGGTGTGGGGA | 16129 & 16130 |
| ZNF804B | CCTACAGCTACAAGCCCA | TACGGTTGAGGCCGGAGA | 16131 & 16132 |
| ZNF814 | GGGAGAAGTCAAACAGCA | TCCCACATTCACAGCACA | 16133 & 16134 |
| ZNF823 | GGACTCACACTGGAGAGA | CTTCGAAGGGAACCGGCA | 16135 & 16136 |
| ZNF830 | GCGGAAGCGTTACCGGAA | CCCCAATCTGGCGGTCCA | 16137 & 16138 |
| ZNF831 | TGGAACTGGGGTGGCAGA | GGACAGTCTGGGCCCACA | 16139 & 16140 |
| ZNF98 | AGTGGCAATGCCTGGACA | CTGGCTTAGAGGCAGCAA | 16141 & 16142 |
| ZNFX1 | TCTGAGCCCTGCAACCGA | CATGTGGCAGATCCGGCA | 16143 & 16144 |
| ZNRD1 | GGGCTCAGGATACGGTCA | CCTCCACCGACATAGGCA | 16145 & 16146 |
| ZNRF4 | AGAAGGCCCAGGTCCGCA | AGGTGTGGGAGCAGGGCA | 16147 & 16148 |
| ZPBP | CAAGCGATGTACAGACCA | ATGATCCAGGGCTGCAGA | 16149 & 16150 |
| ZPBP2 | TCCAGGCAAGAGATCGAA | TCCATAGGTAAGGACGGA | 16151 & 16152 |
| ZRSR2 | GACTATGACCCTGACGCA | TTGAACTCGGGCAACACA | 16153 & 16154 |
| ZSWIM3 | CTACTCCACCCTGCGCAA | CAGCTGTAGCAGGAGGGA | 16155 & 16156 |
| ZW10 | GATGGATGAAGGACCCCA | TCACTGGAAGAGAACGCA | 16157 & 16158 |
| ZWILCH | AGTTGGGAAGGCAAGGCA | AAGCTCAGCTCCTAGCCA | 16159 & 16160 |
| ZWINT | CGAGCCGACAGAAGGCAA | AGGGCCTTGGTGAGGCCA | 16161 & 16162 |
| ZYX | CAAGGCCTATCACCCGCA | GTGGTAGTCGGGGACACA | 16163 & 16164 |
| ZZEF1 | GAGCCAGTACTCCCAGCA | CTTTCAGGGCCAGGGACA | 16165 & 16166 |

FIG. 2

```
                                            SeqDNA-FwdAnc6                          SeqIND-FwdAnc7
FP7-Ind-A                                  AGCAGCAGCACCGACCAGCAGACA  F          TCTGTGCTGGTCGGTGCTCGTCGT
AGCAGAAGACGGCATACGAGATGCATACGACAGCAGCAGCACCGACCAGCAGACA-GSP-DNA-GSP-TCTGTGCTGGTCGGTGCTCGTCGTGTCGTATGCGTGTAGATCTCGGTGGTCGCCGT
TCGTCTTCTGCCGTATGCTCTACGTATGCTGTCGTCGTCGTGGCTGGTCGTCTGT-GSP-DNA-GSP-AGACACGACCAGCCACGAGCAGCACAGCATACGCACATCTAGAGCCACCAGCGGCA
                                   TCGTCGTCGTGGCTGGTCGTCTGT          R  AGACACGACCAGCCACGAGCACGA                    RP5-Ind-A
                                     SeqIND-RevAnc6                         SeqDNA-RevAnc7
```

EXPERIMENTALLY VALIDATED SETS OF GENE SPECIFIC PRIMERS FOR USE IN MULTIPLEX APPLICATIONS

CROSS-REFERENCE TO RELATED APPLICATIONS

Pursuant to 35 U.S.C. §119(e), this application claims priority to U.S. Provisional Application Ser. No. 62/150,166 filed on Apr. 20, 2015, the disclosure of which is herein incorporated by reference.

INTRODUCTION

Multiplex polymerase chains reactions (multiplex PCR) is the simultaneous amplification of many DNA sequences in one reaction. Applications of multiplex PCR include but are not limited to the identification of mutations, gene deletions, and polymorphisms and the production or quantitation of amplicons for high throughput sequencing and genotyping. Multiplex reactions may include two or more target sequences with primer pairs or one template selectively amplified with primers designed to target specific regions. Additionally, such reactions may include multiple templates with regions multiplied by multiple primer pairs.

During multiplex PCR, proper amplification requires optimal conditions. It is important to maintain controlled cycling and annealing temperatures and fine-tuned relative concentrations of primers, buffers, dNTP's, Taq DNA polymerase, template and other PCR reagents. Common problems associated with multiplex PCR include: i) mispriming due to nonspecific primer binding to non-target templates; and ii) the formation of unwanted side products due to the presence of multiple primer pairs. In conjunction with several other sensitive procedural variables, these issues may lead to cross hybridization, and uneven or no amplification of some target sequences. Unwanted multiplex PCR side products form in the presence of multiple primer pairs. These side products may include homodimers, formed by inter-molecular base pairing between two similar primers, and heterodimers, formed from inter-molecular interactions between sense and antisense primers. Another undesirable occurrence is the formation of hairpins from intra-molecular interactions.

SUMMARY

Sets of experimentally validated gene specific primer pairs are provided. Embodiments of the sets include 10 or more gene specific primer pairs of forward and reverse primers. The forward and reverse primers of each primer pair include gene specific primers that are experimentally validated as suitable for use in a multiplex amplification assay. In some instances, each of the forward and reverse primers includes an anchor domain that includes a universal primer binding site. The sets find use in a variety of different applications, including high-throughput sequencing applications.

BRIEF DESCRIPTION OF THE FIGURES

FIG. 1 provides the listing of genes and gene specific primer domains found in a set of gene specific primers, according to any embodiments of the invention. Each of the sequences listed in the column named "Forward Primer" provides a sequence of a gene specific domain of a forward primer that amplifies the gene listed in the corresponding row. Each of the sequences listed in the column named "Reverse Primer" provides a sequence of a gene specific domain of a reverse primer that amplifies the gene listed in the corresponding row.

FIG. 2 provides a representation of an amplicon ready for next generation sequencing that is produced using a set of gene specific primers, in accordance with an embodiment of the invention.

DETAILED DESCRIPTION

Figure 3:
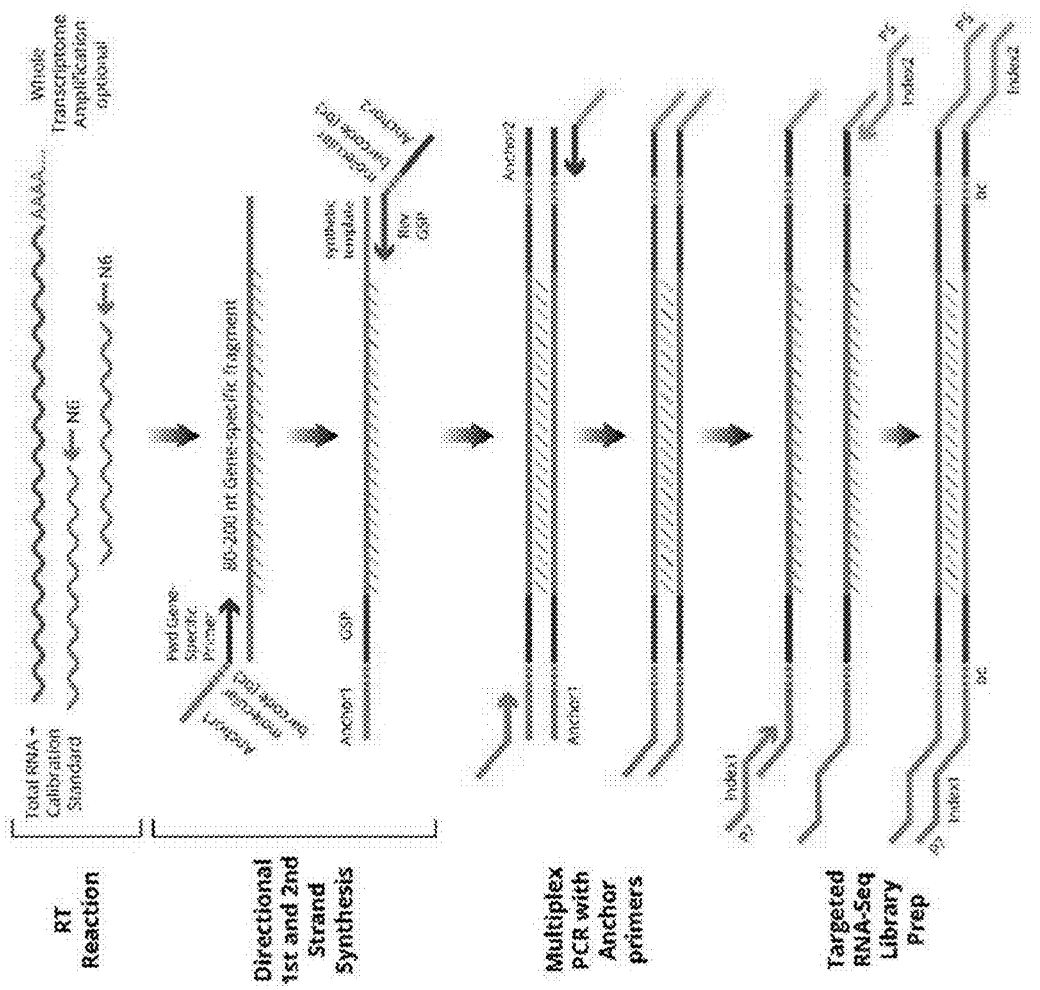
FIG. 3 provides schematic illustration of a protocol for preparing sequencing ready amplicons using a set of gene specific primers, as reported in the Experimental Section, below.

Sets of experimentally validated gene specific primer pairs are provided. Embodiments of the sets include 10 or more gene specific primer pairs of forward and reverse primers. The forward and reverse primers of each primer pair include gene specific primers that are experimentally validated as suitable for use in a multiplex amplification assay. In some instances, each of the forward and reverse primers includes an anchor domain that includes a universal primer binding site. The sets find use in a variety of different applications, including high-throughput sequencing applications.

Before the present invention is described in greater detail, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges and are also encompassed within the invention, subject to any specifically excluded limit in the stated range. Where the stated range includes one or both of the limits, ranges excluding either or both of those included limits are also included in the invention.

Certain ranges may be presented herein with numerical values being preceded by the term "about." The term "about" is used herein to provide literal support for the exact number that it precedes, as well as a number that is near to or approximately the number that the term precedes. In determining whether a number is near to or approximately a specifically recited number, the near or approximating unrecited number may be a number which, in the context in which it is presented, provides the substantial equivalent of the specifically recited number.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, representative illustrative methods and materials are now described.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present invention is not entitled to antedate such publication by virtue of prior invention. Further, the dates of publication provided may be different from the actual publication dates which may need to be independently confirmed.

It is noted that, as used herein and in the appended claims, the singular forms “a”, “an”, and “the” include plural referents unless the context clearly dictates otherwise. It is further noted that the claims may be drafted to exclude any optional element. As such, this statement is intended to serve as antecedent basis for use of such exclusive terminology as “solely,” “only” and the like in connection with the recitation of claim elements, or use of a “negative” limitation.

Additionally, certain embodiments of the disclosed devices and/or associated methods can be represented by drawings which may be included in this application. Embodiments of the devices and their specific spatial characteristics and/or abilities include those shown or substantially shown in the drawings or which are reasonably inferable from the drawings. Such characteristics include, for example, one or more (e.g., one, two, three, four, five, six, seven, eight, nine, or ten, etc.) of: symmetries about a plane (e.g., a cross-sectional plane) or axis (e.g., an axis of symmetry), edges, peripheries, surfaces, specific orientations (e.g., proximal; distal), and/or numbers (e.g., three surfaces; four surfaces), or any combinations thereof. Such spatial characteristics also include, for example, the lack (e.g., specific absence of) one or more (e.g., one, two, three, four, five, six, seven, eight, nine, or ten, etc.) of: symmetries about a plane (e.g., a cross-sectional plane) or axis (e.g., an axis of symmetry), edges, peripheries, surfaces, specific orientations (e.g., proximal), and/or numbers (e.g., three surfaces), or any combinations thereof.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

In further describing various aspects of the invention, embodiments of various methods will be discussed first in greater detail, followed by a review of various applications in which the methods find use as well as kits that find use in various embodiments of the invention.

Methods

As summarized above, methods are provided for producing primer extension product compositions by a multiplex protocol from a target nucleic acid template composition and a set of gene specific primer pairs. By “primer extension product composition” is meant a nucleic acid composition that includes nucleic acids which are primer extension products. Primer extension products are deoxyribonucleic acids that include a primer domain at the 5' end covalently bonded to a synthesized domain at the 3' end, which synthesized domain is a domain of base residues added by a polymerase mediated reaction to the 3' end of the primer domain in a sequence that is dictated by a template nucleic acid to which the primer domain is hybridized during production of the primer extension product. Primer extension product compositions may include double stranded nucleic acids that include a template nucleic acid strand hybridized to a primer extension product strand, e.g., as described above, where in some instances these double stranded nucleic acids double deoxyribonucleic acid (dsDNA) molecules. The length of the primer extension products and/or double stranded nucleic acids that incorporate the same in the primer extension product compositions may vary, wherein in some instances the nucleic acids have a length ranging from 50 to 1000 nt, such as 60 to 400 nt and including 70 to 250 nt. The number of distinct nucleic acids that differ from each other by sequence in the primer extension product compositions produced via methods of the invention may also vary, ranging in some instances from 10 to 25,000, such as 100 to 20,000 and including 1,000 to 10,000.

As summarized above, aspects of the invention include producing primer extension product compositions by contacting a target nucleic acid template composition with a set of gene specific primers, e.g., as described in greater detail below, under primer extension reaction conditions.

Sets of Gene Specific Primer Sets

As summarized above, in methods of the invention a target nucleic acid template composition is contacted with a set of gene specific primers, i.e., a collection of gene specific primer pairs of known sequence, under primer extension reaction conditions. While the number of primer pairs in a given set may vary, as desired, in some instances the number of primer pairs in a given set is 10 or more, such as 20 or more, 30 or more, 40 or more, 50 or more, 60 or more, 70 or more, 80 or more, 90 or more, 100 or more, 125 or more, 250 or more, 500 or more, including 1000 or more. In some instances, the number of gene specific primer pairs that is present in the set is 25,000 or less, such as 20,000 or less. As such, in some embodiments the number of gene specific primer pairs in the set that is contacted with the target nucleic acid template composition ranges from 10 to 25,000, such as 50 to 20,000, including 1,000 to 10,000, e.g., 2,500 to 8,500.

Gene specific primer pairs present in a given set of the invention are made up of a forward primer and a reverse primer, wherein the forward and reverse primers of each primer pair include gene specific domains that are experimentally validated as suitable for use in a multiplex amplification assay. By “experimentally validated as suitable for use in a multiplex amplification assay” is meant that the set of primers for each target gene in a given set has been experimentally tested in a multiplex amplification assay, such as described in the Experimental section below, and the best performing primer set is selected based on parameters one or more functional parameters, e.g., as described in greater detail below. While the multiplex amplification assay employed to experimental validate a set of primers may vary, in some instances the protocol employed includes a first step of, for each target gene selected from the genome-wide set of human or mouse genes, selecting a region that is conservative for different mRNA isoforms, following which a set of forward and reverse PCR primers which are complementary and specific for the selected gene region are designed. The primers may be designed using any convenient algorithm and/or software tool, e.g., such as the Primer3 algorithm, Primer Design Tool from NCI, etc. The melting temperature of the selected primers may vary, ranging in some instances from 60° C. to 80° C., such as 65° C. to 80° C. Furthermore, the primers may be selected that lack significant secondary structures, or self-complementarity (e.g., primers may be selected with less than 4-bp complementary regions) and cross-complementarity to each other of less than 10 nt complementarity region. The length of the selected PCR primers may vary, and in some instances ranges from 15 to 25 nt, such as 16 to 24 nt, with GC-content of between 45% to 85%, such as 50% to 75%. In order to avoid primer/dimer formation in a multiplex RT-PCR assay, the selected primers in some embodiments are designed with the nucleotide A at the 3'-end and biased GCA-rich composition with reduced percentage of T nucleotides, where in some instances the percentage of T is 20% or less, such as 15% or less, including 10% or less, down to 0%. Following primer design, homology searching for similar PCR primer binding domain(s) in other RNA species (such as available in GeneBank), e.g., via BLAST or Thermo-Blast algorithm, is performed in order to select primers specific only to the target region of interest. Next, the resultant primer set is ranked based on the distance between primers with the preferred size of amplicons, e.g., which ranges in some instances between 60 to 250 bp. Following this ranking, a set of at least 1 primer pair, such as 3 or more, e.g., 5 or more, up to 12 or more, but in some instances not exceeding 12 primer pairs, is synthesized and functionally validated in a multiplex RT-PCR-NGS (next generation sequencing) assay, e.g., using the protocol disclosed in the Experimental section, below. In some embodiments, e.g., those specific for mutation profiling in clinically actionable or driver cancer genes, a complete set of PCR primers is designed and validated which allows one to amplify a set of overlapping amplicons that cover the complete mRNA sequence from the 5'- to the 3'-end. Primers present in sets of gene specific primers of the invention may be experimentally validated using any convenient protocol. In some instances, the experimentally validated gene specific domains are validated in a multiplex amplification assay with a synthetic control template mix which mimics the natural target template sequences and includes binding sites for the whole set of gene-specific primer pairs and/or a universal natural template mix derived from multiple different mammalian tissues or cell types. Specifically, as a template for multiplex RT-PCR assay, a set (usually between 3 to 6) of natural total universal RNAs, e.g., including a mix of several RNAs isolated from human or mouse cell lines or tissue samples (e.g., available from Takara-Clontech, Agilent, QiagenOrigene, etc.) may be employed as a natural nucleic acid control. In addition (or alternatively) to the set of the natural control template nucleic acids, a mix of the synthetic control template nucleic acids, e.g., one that has been synthesized on the surface of custom microarrays (e.g., Custom Array) and designed for the each target amplicon, may be employed. In such synthetic control templates, the templates include the sequence of the both PCR primer-binding site domains and the full-length or truncated in the middle cDNA region between PCR primers which correspond to the primer extension domain. In some functional validation assays, two synthetic template concentrations (e.g., 10-fold difference) may be employed in order to measure expression level (number of specific reads) in a manner that does not dependent on the amount of starting universal RNA template. The length of synthetic control templates may vary, ranging in some instances from 100 to 160, such as 110 to 160, including 120 to 160 nt. The amplification products generated in the multiplex RT-PCR assays may be quantitatively analyzed by sequence analysis using conventional NGS instruments (e.g., available from Illumina and other commercial vendors). The NGS data generated for different templates and experimental conditions may be scaled to the same number of total reads (usually total 10,000,000 reads), aligned with the sequences of PCR primer domain and downstream extended domain sequences for the each target amplicon. The number of specific reads corresponding to the each target amplicon may be measured as the number of correctly aligned sequences for the each PCR primer pair and downstream extended domain sequences. In addition, for each primer pair, the number of non-specific (off-target) reads for the amplicons may be calculated which has correct the PCR primer domain but different, non-target extended domain sequences. The set of PCR primer pairs designed for the each target gene may then be ranked using the set of criteria described below. The highest rank PCR primer pair for the each target gene is first selected based on highest number of specific reads (e.g., 100 or more, such as 500 or more and including 1,000 specific reads) and minimum number of non-specific reads (e.g., 2-fold less than number of specific reads, but not exceeding 5,000, or such as 2,000 reads) measured across all universal RNAs and control synthetic template. Next, the highest activity PCR primer set may be selected from among other primers which demonstrate a common pattern of expression among different natural universal RNAs used in the assay. Common pattern of expression between different primers sets indicates that they target the same conservative cDNA region, rather than a unique target region specific for particular mRNA isoform(s). In some embodiments, the human PCR primers are selected which effectively amplified target regions from human but not from the mouse universal RNAs. In other embodiments, e.g., those specific for detection of clinically actionable mutations, not one but a complete set of PCR primers are selected which amplify amplicons overlapping the whole mRNA/cDNA sequence. In some embodiments, screening for the highest specific activity primers using both 60° C. and 65° C. extension temperature are identified. Using these two different conditions enables the identification of set of primer pairs which demonstrates similar (e.g., less than 2-fold difference) specific activity across several control templates and universal RNAs. In some instances, if a PCR primer set which has high specific activity in both control synthetic template (e.g., less than 500 reads) and in all universal RNAs (e.g., less than 100 reads) for any target gene is not identified, a new candidate set PCR primer sets for the failed gene(s) is designed and validation protocol repeated until a suitable set is found. As a result of functional validation experiments, one can select at least one PCR primer set for the each target gene of interest that has high sensitivity and selectivity, e.g., for at least 90%, such as 95% or more target genes of interest.

The gene specific primers are configured to hybridize to a target nucleic acid sequence for which they are specific at locations that are separated by a known or predetermined distance, i.e., a template distance. The length of the template distance may vary, ranging in some instances from 50 to 750 bp, such as 60 to 500 bp, including 60 to 300 bp, e.g., 70 to 250 bp. As such, the product nucleic acid which is produced from the gene specific primers may have a central domain, i.e., extension domain, corresponding to the template nucleic acid from which it is produced (i.e., will have a sequence complementary to as sequence of the template nucleic acid from which it is produced) that varies in length, ranging in some instances from 50 to 750 nt, such as 60 to 500 nt, including 60 to 400 nt, e.g., 60 to 300 nt, including 80 to 200 nt.

A given gene specific primer at least includes a multiplex experimentally validated gene specific domain, e.g., as described above. The length of the gene specific domain may vary, so long as the domain serves to specifically hybridize to a target nucleic acid under hybridization conditions of interest. An example of such hybridization conditions is hybridization at 50° C. or higher and 0.1×SSC (15 mM sodium chloride/1.5 mM sodium citrate). In some embodiments, these hybridization conditions may be defined by length and nucleotide sequence of the gene-specific domains of the PCR primers, composition of PCR buffer, properties of DNA polymerase and conditions used in the primer extension step. Primer extensions temperatures may vary, ranging in some instances from 50 to 75, such as 60 to 72° C. As disclosed in Experimental section below, in one of the embodiment a primer extension step is employed in which extension occurs between 60 and 65° C. using Phusion II DNA polymerase, HF or GC buffer reagents available from Thermo-Fisher. Both length and specific nucleotide sequence of PCR primer define the hybridization condition at the primer extension step. In some embodiments, the length and specific sequence of the gene specific domains of the PCR primers is selected in order to provide efficient binding and extension at 60 and 65° C. under the PCR conditions used in the primer extension step. Such conditions may provide or high efficiency and specificity of the primer extension in PCR reaction conditions. In some embodiments, the primer length and sequence may be adjusted to perform an extension step at 68° C. or even 72° C.

In order to control efficiency and specificity of primer extension step, the length of the gene specific domain of the forward and reverse primers may vary, in some instances the length ranges from 10 to 50 nt, such as 10 to 30 nt, including 14 to 22 nt or 16 to 24 nt. Each primer of the gene specific primer set may include only a gene specific domain, or may include one or more additional domains as desired, e.g., anchor domains, NGS adaptor domains, labels or label domains, etc., e.g., as described below. In some embodiments where additional domains are present, each primer pair may include primers ranging in length from 10 to 75 nt, such as from 15 to 60 nt, including from 24 to 45 nt.

Where desired, the gene-specific primer domain of the each primer is GCA- and/or GCT-rich. By GCA- and/or GCT-rich is meant that the gene-specific primer domain has a substantial portion of G, C, A- and/or G, C, T nucleotides. While the number of such nucleotides in a gene specific primer domain may vary, in some instance the number of such sequences ranges from 75% to 100%, such as 85% to 100%. As the gene specific primer domains of such embodiments are GCA- and/or GCT-rich, the GC content of the gene specific primer domains is also high. While the GC content may vary, in some instances the GC content ranges from 40 to 90%, such as 45 to 85%, including 50 to 85%, e.g., 50 to 80%.

Depending on the particular application, the set of gene specific primers could be designed to target a wide range of mammalian genes, and pathogenic genes from a wide range of pathogenic organisms, like viruses, bacteria, fungi, etc. which could be present in the human or mammalian bodies. Of interest in certain applications are human and mammalian species (mouse, rat, monkey) which are commonly used as a model organisms to study human diseases and pathogenic organisms which are associated or induce human diseases. In order to be analyzed in accordance with embodiments of the invention, genes may be present in the mammalian cells of fluids. In some embodiments, the genes are selected only from a group of protein coding genes or/and selected from the group of genes which code non-coding RNAs, micro RNAs, mitochondrial RNAs, regulatory RNAs, etc. In some instances, the set of the selected genes is genome-wide, such that it covers all genes present in the genome of an organism. In other embodiments, the genes are selected from a group of the genes which could transcribed or expressed in the organism and present in the biological samples in the form of RNA or expressed DNA. The genome-wide set of genes specific for human, model and pathogenic organisms is a specific interest in some instances, and may be used to develop a set of genome-wide targeted RNA expression Assays based on the disclosed multiplex PCR assay. Genome-wide sets of PCR primers may vary in number, and in some instances are configured to assay 18,000 or more, such as 20,000 or more and 25,000 or more, such as 30,000 or more genes. Additional sets of PCR primers may be configured based on a genome-wide set of genes from a wide range of viral, bacterial and eukaryotic pathogenic organisms. In another embodiment, the set of gene specific primers may be configured to produce primer extension products from a subset of specific genes selected from the genome-wide set of genes. One of these subsets is the subset of cancer associated genes. By "cancer associated genes" is meant genes that have been shown to be associated with initiation, development, diagnostic, treatment of cancer. Such genes could be involved in, i.e., implicated in, or be diagnostic of, or otherwise of interest in, the study and/or treatment of cancer, i.e., any of various malignant neoplasms characterized by the proliferation of anaplastic cells that tend to invade surrounding tissue and metastasize to new body sites. As such, cancer associate genes that may be represented in a given set of gene specific primers include, but are not limited to: cancer hallmark genes, pan cancer driver genes, pathway and signaling network genes, drug metabolism genes, extracellular proteome genes, drug target genes (including those of FDA approved and/or clinical trial targets), cell lineage genes, Immunity Mechanisms & Immunotherapy Markers, immunotherapy drug target genes, known biomarkers, epigenetics genes, etc.

In another embodiment, the subset of the cancer associated genes is employed in developing of Cancer Clinically Actionable 26 assay for profiling all clinically actionable mutations in the set of 26 human genes (ABL1, AKT1, ALK, BRAF, CDK4, CDK6, CDKN2A, EGFR, ERBB2, FGFR1, FGFR2, FLT3, KDR, KIT, KRA, MET, NRAS, PDGFRA, PIK3CA, PIK3R1, PTCH1, PTEN, PTPN11, RET, ROS1, SMO). This assay includes the additional set of multiplex PCR primers designed and validated to amplify the set of overlapping amplicons which cover the whole mRNA sequence of the target genes.

In some instances, the set of gene specific primer pairs includes primers configured to produce primer extension products for 10 or more genes listed in Table 1. As such, the set of gene specific primers employed in a given method may represent at least some of the genes listed in Table 1 (See FIG. 1), i.e., will include primer pairs that correspond to at least some of the genes listed in Table 1. A primer pair is considered to correspond to a given gene if the primers of the pair specifically hybridize to sequences of the gene. It is understood based on the current prior-art knowledge, the selected primer pair sequences could include all or only portion of the primer sequences disclosed in the Table 1, so long as they provide for the desired gene specificity. Modification in the specific sequences of the PCR primers, such as mutations, deletion, extensions, using nucleotide analogs, etc., may be present so long as the functionality of the primers in the primer extension step is maintained. The number of genes from Table 1 represented in the set of gene specific primers may vary, ranging from 10 to 8,000, such as 25 to 7,500, including 50 to 5,000, where in some instances the number is 25 or more, including 50 or more, such as 100 or more, 250 or more, 500 or more, 1,000 or more, 1,500 or more, 2,500 or more, 5,000 or more, and 7,500 or more, up to and including all of the genes listed in Table 1. In some instances, the set of gene specific primers includes primer pairs having gene specific sequences listed in Table 1. The number of gene specific primer pairs have gene specific sequences listed in Table 1 that be present in a given set of gene specific primers may vary, where in some instances the number ranges from 10 to 8,000, such as 25 to 7,500, including 50 to 5,000, where in some instances the number of primer pairs present in the set is 25 or more, including 50 or more, such as 100 or more, 250 or more, 500 or more, 1,000 or more, 1,500 or more, 2,500 or more, 5,000 or more, and 7,500 or more, up to and including all of the primer pairs listed in Table 1. Subsets of the genes listed in Table 1 that may be employed in a given assay may vary. Specific subsets of interest that may be employed in a given assay include, but are not limited to: Cancer Core 125 subset, PanCancer 540 subset, Cancer Immunotherapy 1,740 subset, Tumor Microenvironment 2,500 subset, or any specific set of genes selected based on specific functions, expression, or association with human diseases, and the like.

In some instances the methods include selecting the set of gene specific primers from a provided master library of gene specific primers, e.g., choosing a subset of primer pairs from an initial collection of primer pairs. For example, the methods may include selecting a subset of primer pairs (and thereby identify the primer pairs of a set of gene specific primers to be employed in methods of the invention, such as described above) that correspond to genes from Table 1, where the number of primer pairs in the selected subset may vary, ranging in some instances from 10 to 8,000, such as 25 to 7,500, including 50 to 5,000, where in some instances the number is 25 or more, including 50 or more, such as 100 or more, 250 or more, 500 or more, 1,000 or more, 1,500 or more, 2,500 or more, 5,000 or more, and 7,500 or more. An example of such a subset is provided in FIG. 2.

The disparate primer pairs of a given set are present in substantially the same, if not the same amount. As such, in some instances, the copy number of any given primer pair in a set does not vary from the copy number of any other primer pair of the set by a value of 100% or less, such as 50% or less. A given primer pair may be present in a set in any desired amount, where in some instances the amount ranges from 10% to 1000%, such as 20% to 500%. The final concentration of the each primer in the primer extension step may vary, and in some instances ranges from 1 to 50 nM, such as 2 to 40 nM, where examples of specific concentrations of interest include 1 nM, 2 nM, 5 nM, 10 nM, 20 nM and 50 nM.

The sets of gene specific primers, e.g., as described above, are non-naturally occurring compositions. In some instances, the sets of gene specific primers include domains or regions that are not naturally occurring sequences and/or are not naturally joined to the gene specific primer domains in naturally occurring nucleic acids. For example, as described in greater detail below, the gene specific domains may be joined to one or more synthetic domains, e.g., universal primer binding site domains, indexing domains, barcode domains, adaptor domains, etc. In some instance the gene specific primers may include one or more moieties that are not present in naturally occurring nucleic acids, e.g., label moieties (e.g., directly detectable labels, such as fluorescent labels, indirectly detectable labels, e.g., components of a signal producing system, etc.), non-naturally occurring nucleotides, etc. In some instances the sets of gene specific primers are present in a vehicle that does not include one or more constituents found in naturally occurring nucleic acid compositions. For example, the vehicle may lack one or more cellular constituents, e.g., proteins, organelles, cell walls, etc. In some instances, the set of gene specific primers are the only nucleic acids present in the composition. In some instances, the composition is an aqueous composition, where the aqueous composition lacks non-nucleic acid cellular constituents and/or may include one or more components that are not present in biological samples, e.g., synthetic buffering agents, etc.

Target Nucleic Acid Template Compositions

The target nucleic acid template compositions employed in methods of the invention are nucleic acid compositions made of nucleic acids of various length. In some instances, nucleic acids having a length of 10 bases or longer, 20 bases or longer, 50 bases or longer, 100 bases or longer, 500 bases or longer, 1000 bases or longer, 2000 bases or longer, 3000 bases or longer, 4000 bases or longer, 5000 bases or longer may be present in the target nucleic acid compositions. In some instances, the nucleic acids present in the target template nucleic acid compositions have a length that is 2500 bases or less, such as 20,000 bases or less, including 15,000 bases or less.

In the broadest sense, the nucleic acids of the target nucleic acid template compositions may be deoxyribonucleic acids or ribonucleic acids. In certain aspects, the nucleic acids making up the template nucleic acid composition are deoxyribonucleic acids, such that the target nucleic acid template composition is a template deoxyribonucleic acid composition (template DNA composition). Template DNA compositions may include, but are not limited to, genomic DNA or fragments thereof, complementary DNA (or "cDNA", e.g., synthesized from any RNA or DNA of interest), recombinant DNA (e.g., plasmid DNA), or the like. In some instances, the target nucleic acid composition that is contacted with the set of gene specific primers may be made up of ribonucleic acids, such as messenger RNA (mRNA), etc.

The template nucleic acid may be present in any nucleic acid sample of interest, including but not limited to, a nucleic acid sample isolated from a single cell, a plurality of cells (e.g., cultured cells), a tissue, an organ, or an organism (e.g., bacteria, yeast, or the like). In certain aspects, the nucleic acid sample is isolated from a cell(s), tissue, organ, and/or the like of a mammal (e.g., a human, a rodent (e.g., a mouse), or any other mammal of interest). Samples that may be employed in certain embodiments include samples obtained from biopsies, xenografts, blood or components thereof, e.g., PBMCs, FFPE, fine needle aspirates (FNAs), etc. In other aspects, the nucleic acid sample is isolated from a source other than a mammal, such as bacteria, yeast, insects (e.g., *drosophila*), amphibians (e.g., frogs (e.g., *Xenopus*)), viruses, plants, or any other non-mammalian nucleic acid sample source. As mentioned above, in some embodiments, the nucleic acid sample that includes the template nucleic acid is isolated from a single cell. In other aspects, the nucleic acid sample that includes the template nucleic acid is isolated from 2, 3, 4, 5, 6, 7, 8, 9, 10 or more, 20 or more, 50 or more, 100 or more, or 500 or more cells. According to certain embodiments, the nucleic acid sample that includes the template nucleic acid is isolated from 500 or less, 100 or less, 50 or less, 20 or less, 10 or less, 9, 8, 7, 6, 5, 4, 3, or 2 cells.

Approaches, reagents and kits for isolating nucleic acids from such sources are known in the art. For example, kits for isolating nucleic acids from a source of interest—such as the NucleoSpin®, NucleoMag® and NucleoBond® genomic DNA or RNA isolation kits by Clontech Laboratories, Inc. (Mountain View, Calif.)—are commercially available. In certain aspects, the nucleic acid is isolated from a fixed biological sample, e.g., formalin-fixed, paraffin-embedded (FFPE) tissue. Nucleic acids from FFPE tissue may be isolated using commercially available kits—such as the NucleoSpin® FFPE DNA or RNA isolation kits by Clontech Laboratories, Inc. (Mountain View, Calif.).

In certain aspects, the subject methods include producing the target nucleic acid template composition from a precursor nucleic acid. For example, where the target template nucleic acid composition is a cDNA composition, the methods may include producing the cDNA composition from an initial nucleic acid sample, such as an mRNA sample. Such methods may include, but are not limited to, generating double stranded cDNA from random primers, oligo dT primers, oligo dT primers with molecular barcodes, gene-specific primers, etc., via reverse transcriptase mediated protocol, which may or may not include the use of a template switch oligonucleotide, as desired.

When it is desirable to control the size of the template nucleic acid that is combined into the reaction mixture, a nucleic acid sample isolated from a source of interest may be subjected to shearing/fragmentation, e.g., to generate a template nucleic acid that is shorter in length as compared to a precursor non-sheared nucleic acid (e.g., genomic DNA, full-length mRNA, and/or the like) in the original sample. The template nucleic acid may be generated by a shearing/fragmentation strategy including, but not limited to, passing the sample one or more times through a micropipette tip or fine-gauge needle, nebulizing the sample, sonicating the sample (e.g., using a focused-ultrasonicator by Covaris, Inc. (Woburn, Mass.)), bead-mediated shearing, enzymatic shearing (e.g., using one or more DNA- or RNA-shearing enzymes), chemical based fragmentation, e.g., using divalent cations (e.g., $Mg^{2+}$, $Mn^{2+}$, and/or $Zn^{2+}$), fragmentation buffer (e.g., a high pH buffer), and/or heat, or any other suitable approach for shearing/fragmenting a precursor nucleic acid to generate a shorter template nucleic acid. In certain aspects, the template nucleic acid generated by shearing/fragmentation of a starting nucleic acid sample has a length of from 50 to 10,000 nucleotides, from 100 to 5000 nucleotides, from 150 to 2500 nucleotides, from 200 to 1000 nucleotides, e.g., from 250 to 500 nucleotides in length, for example.

In some instances, preparation of the target nucleic acid template composition includes combining an initial nucleic acid composition with a control template mix, e.g., to produce a target nucleic acid template composition that is spiked with a control template mix, which mix may be made up of synthetic nucleic acids, naturally occurring nucleic acids or a combination thereof. In some instances, the control template mix is a synthetic control template mix that includes control template nucleic acids having sequences that mimic but are different from the sequences of target template nucleic acids. Where desired, the control template nucleic acids comprise binding sites for the whole set of gene-specific primer pairs employed in a given assay in amount ranging from 0.1 to 50%. Further details regarding control template mixes of interest are provided above.

Primer Extension Product Production

As reviewed above, aspects of the methods include contacting a set of gene specific primers, e.g., as described above, with a target nucleic acid template composition under primer extension reaction conditions. By “primer extension reaction conditions” is meant reaction conditions that permit polymerase-mediated extension of a 3' end of a nucleic acid strand, i.e., primer, hybridized to a template nucleic acid. Achieving suitable reaction conditions may include selecting reaction mixture components, concentrations thereof, and a reaction temperature to create an environment in which the polymerase is active and the relevant nucleic acids in the reaction interact (e.g., hybridize) with one another in the desired manner.

The concentration of gene specific primers in the primer extension reaction mixture produced upon combination of the template nucleic acid and the set of gene specific primers may vary, as desired. In some instances, each primer of the gene specific primer pairs is employed at a concentration ranging from 1 to 50 nM, such as 2 to 25 nM, including 5 to 10 nM. The amount of target template nucleic acid that is combined with the set of gene specific primers and other reagents, e.g., as described below, to produce a primer extension reaction mixture may also vary. In some instances, the target nucleic acid template composition is combined into the reaction mixture such that the final concentration of nucleic acid in the reaction mixture ranges from 1 fg/μL to 10 μg/μL, such as from 1 pg/μL to 5 μg/μL, such as from 0.1 ng/μL to 50 ng/μL, such as from 0.5 ng/μL to 20 ng/μL, including from 1 ng/μL to 10 ng/μL.

In producing the primer extension reaction mixture, the set of gene specific primers and target template nucleic acid composition are combined with a number of additional reagents, which may vary as desired. A variety of polymerases may be employed when practicing the subject methods. Reference to a particular polymerase, such as those exemplified below, will be understood to include functional variants thereof unless indicated otherwise. Examples of useful polymerases include DNA polymerases, e.g., where the template nucleic acid is DNA. In some instances, DNA polymerases of interest include, but are not limited to: thermostable DNA polymerases, such as may be obtained from a variety of bacterial species, including *Thermus aquaticus* (Taq), *Thermus thermophilus* (Tth), *Thermus filiformis, Thermus flavus, Thermococcus literalis*, and *Pyrococcus furiosus* (Pfu). Alternatively, where the target template nucleic acid composition is made up of RNA, the polymer may be a reverse transcriptase (RT), where examples of reverse transcriptases include Moloney Murine Leukemia Virus reverse transcriptase (MMLV RT), SuprScript II, SuperScript III, MaxiScript reverse transcriptase (Thermo-Fsher), *Bombyx mori* reverse transcriptase (e.g., *Bombyx mori* R2 non-LTR element reverse transcriptase), SMARTScribe™ reverse transcriptase and PrimeScript™ reverse transcriptase.

Primer extension reaction mixtures also include dNTPs. In certain aspects, each of the four naturally-occurring dNTPs (dATP, dGTP, dCTP and dTTP) are added to the reaction mixture. For example, dATP, dGTP, dCTP and dTTP may be added to the reaction mixture such that the final concentration of each dNTP is from 0.01 to 100 mM, such as from 0.1 to 10 mM, including 0.5 to 5 mM (e.g., 1 mM). According to one embodiment, at least one type of nucleotide added to the reaction mixture is a non-naturally occurring nucleotide, e.g., a modified nucleotide having a binding or other moiety (e.g., a fluorescent moiety) attached thereto, a nucleotide analog, or any other type of non-naturally occurring nucleotide that finds use in the subject methods or a downstream application of interest.

In addition to the template nucleic acid, primers, the polymerase, and dNTPs, the reaction mixture may include buffer components that establish an appropriate pH, salt concentration (e.g., KCl concentration), metal cofactor concentration (e.g., $Mg^{2+}$ or $Mn^{2+}$ concentration), and the like, for the extension reaction and template switching to occur. Other components may be included, such as one or more nuclease inhibitors (e.g., an RNase inhibitor and/or a DNase inhibitor), one or more additives for facilitating amplification/replication of GC rich sequences (e.g., GC-Melt™ reagent (Clontech Laboratories, Inc. (Mountain View, Calif.)), betaine, single-stranded binding proteins (e.g., T4 Gene 32, cold shock protein A (CspA), and/or the like) DMSO, ethylene glycol, 1,2-propanediol, or combinations thereof), one or more molecular crowding agents (e.g., polyethylene glycol, or the like), one or more enzyme-stabilizing components (e.g., DTT present at a final concentration ranging from 1 to 10 mM (e.g., 5 mM)), and/or any other reaction mixture components useful for facilitating polymerase-mediated extension reactions and template-switching.

The primer extension reaction mixture can have a pH suitable for the primer extension reaction and template-switching. In certain embodiments, the pH of the reaction mixture ranges from 5 to 9, such as from 7 to 9, including from 8 to 9, e.g., 8 to 8.5. In some instances, the reaction mixture includes a pH adjusting agent. pH adjusting agents of interest include, but are not limited to, sodium hydroxide, hydrochloric acid, phosphoric acid buffer solution, citric acid buffer solution, and the like. For example, the pH of the reaction mixture can be adjusted to the desired range by adding an appropriate amount of the pH adjusting agent.

The temperature range suitable for production of the product nucleic acid may vary according to factors such as the particular polymerase employed, the melting temperatures of any optional primers employed, etc. According to one embodiment, the primer extension reaction conditions include bringing the reaction mixture to a temperature ranging from 4 to 72° C., such as from 16 to 70° C., e.g., 37 to 65° C., such as 60° C. to 65° C. The temperature of the reaction mixture may be maintained for a sufficient period of time for polymerase mediated, template directed primer extension to occur. While the period of time may vary, in some instances the period of time ranges from 5 to 60 minutes, such as 15 to 45 minutes, e.g., 30 minutes.

Where desired, the primer extension reaction conditions may include one or more temperature cycling steps. For example, in some instances, the primer extension product composition is produced by a method that includes first contacting the target nucleic acid template composition with a first primer subset that includes the forward primers of the set of primer pairs under primer extension reaction conditions to produce a forward primer extension product composition; increasing the temperature to denature the resultant product and template strands and inactivate any additional enzymatic activity (e.g., exonuclease I activity added after extension step to degrade PCR primers) present in the forward primer extension product composition (where the elevated temperature may vary, ranging in some instances from 90 to 100° C., such as 95° C.) and then contacting the resultant denatured forward primer extension product composition with a second primer subset that includes the reverse primers of the set of primer pairs under primer extension reaction conditions to produce the desired primer extension product composition. Where desired, the primer extensions products and template nucleic acids may be separated from any free forward primers prior to contact with the set of reverse primers. The extended DNA products after the first and second extension steps may be purified from the excess of the primers using any convenient protocol, including primer digestion with exonucleases (exonucleclease I) or purification, such as Magnetic beads or spin columns, etc.

Contact of the target nucleic acid template composition and the set of gene specific primers, e.g., as described above, results in the production of a primer extension product composition, e.g., as described above. The resultant primer extension product composition may be employed as is, or further processed as desired, depending on the particular application being performed.

Amplicon Production

In some instances, the primer extension product composition is employed as an intermediate composition in methods of producing multiple amplicons from the initial target nucleic acid template composition. The term "amplicon" is employed in its conventional sense to refer to a piece of DNA that is the product of artificial amplification or replication events, e.g., as produced using various methods including polymerase chain reactions (PCR), ligase chain reactions (LCR), etc.

In embodiments of such methods, the gene specific primers of the primer sets, e.g., as described above, may include additional domains that are employed in subsequent amplification steps to produce the desired amplicon composition. For example, each of the forward and reverse primers of a given primer pair in the set of gene specific primers may include an anchor domain comprising a universal priming site. The length of the anchor domain may vary, as desired. In some instances, the anchor domains of each primer pair range in length from 10 to 50 nt, such as 10 to 30 nt, e.g., 10 to 24, including 10 to 23 nt. Where desired, the anchor domains may include PCR suppression sequences. PCR suppression sequences are sequences configured to suppress the formation of non-target DNA during PCR amplification reactions, e.g., via the production of pan-like structures. Such sequences, when present, may vary in length, ranging in some instances from 5 to 25 nt, such as 7 to 21, including 7 to 20 nt. PCR suppression sequences of interest include, but are not limited to, those sequences described in U.S. Pat. No. 5,565,340; the disclosure of which is herein incorporated by references. An example of forward and reverse anchor domains that include PCR suppression sequences are: AGCACCGACCAGCAGACA (SEQ ID NO:01) and AGACACGACCAGCCACGA (SEQ ID NO:02). When present, these anchor domains are 5' of the gene specific domains of the primers.

Where anchor domains, e.g., as described above, are included in the gene specific primers, the anchor domains, i.e., forward and reverse anchor domains, may be common in all of the gene specific primers of the set, such that all of the forward gene specific primers of the set include anchor domains having the same sequence and all of the reverse gene specific primers of the set include anchor domains having the same sequence. In such instances, the primer extension product composition will include universal primer binding sites which may then be exploited during subsequent amplification.

As such, embodiments of the methods include combining the primer extension product composition and universal forward and reverse primers under amplification conditions sufficient to produce the desired product amplicon composition. The forward and reverse universal primers are configured to bind to the common forward and reverse anchor domains and thereby nucleic acids present in the primer extension product compositions. The universal forward and reverse primers may vary in length, ranging in some instances from 10 to 75 nt, such as 15 to 60 nt. In some instances, the universal forward and reverse primers include one or more additional domains, such as but not limited to: an indexing domain, a clustering domain, a Next Generation Sequencing (NGS) adaptor domain (i.e., high-throughput sequencing (HTS) adaptor domain), etc. Alternatively, these domains may be introduced during on more subsequent steps, such as one or more subsequent amplification reactions, e.g., as described in greater detail below. The amplification reaction mixture will include, in addition to the primer extension product composition and universal forward and reverse primers, other reagents, as desired, such polymerase, dNTPs, buffering agents, etc., e.g., as described above.

Amplification conditions may vary. In some instances the reaction mixture is subjected to polymerase chain reaction (PCR) conditions. PCR conditions include a plurality of reaction cycles, where each reaction cycle includes: (1) a denaturation step, (2) an annealing step, and (3) a polymerization step. The number of reaction cycles will vary depending on the application being performed, an may be 1 or more, including 2 or more, such as 3 or more, e.g., four or more, and in some instances may be 15 or more, such as 20 or more and including 60 or more, where the number of different cycles will typically range from about 20 to 40. The denaturation step includes heating the reaction mixture to an elevated temperature and maintaining the mixture at the elevated temperature for a period of time sufficient for any double stranded or hybridized nucleic acid present in the reaction mixture to dissociate. For denaturation, the temperature of the reaction mixture may be raised to, and maintained at, a temperature ranging from 85 to 100° C., such as from 90 to 98° C. and including 93 to 96° C. for a period of time ranging from 3 to 120 sec, such as 5 to 30 sec. Following denaturation, the reaction mixture will be subjected to conditions sufficient for primer annealing to template DNA present in the mixture. The temperature to which the reaction mixture is lowered to achieve these conditions may be chosen to provide optimal efficiency and specificity, and in some instances ranges from about 50 to 75° C., such as 55 to 70° C. and including 60 to 68° C. Annealing conditions may be maintained for a sufficient period of time, e.g., ranging from 15 sec to 30 min, such as from 30 sec to 5 min. Following annealing of primer to template DNA or during annealing of primer to template DNA, the reaction mixture may be subjected to conditions sufficient to provide for polymerization of nucleotides to the primer ends in manner such that the primer is extended in a 5' to 3' direction using the DNA to which it is hybridized as a template, i.e. conditions sufficient for enzymatic production of primer extension product. To achieve polymerization conditions, the temperature of the reaction mixture may be raised to or maintained at a temperature ranging from 65 to 75, such as from about 67 to 73° C. and maintained for a period of time ranging from 15 sec to 20 min, such as from 30 sec to 5 min. The above cycles of denaturation, annealing and polymerization may be performed using an automated device, typically known as a thermal cycler. Thermal cyclers that may be employed are described in U.S. Pat. Nos. 5,612,473; 5,602,756; 5,538,871; and 5,475,610, the disclosures of which are herein incorporated by reference.

The product amplicon composition of this first amplification reaction will include amplicons corresponding to the gene specific domains that are present in the initial target nucleic acid composition and are bounded by primer pairs present in the employed set of gene specific primers. In some instances, the number of distinct amplicons of differing sequence in this initial amplicon composition ranges from 10 to 8,000, such as 25 to 7,500, including 50 to 5,000, where in some instances the number of distinct amplicons present in this initial amplicon composition is 25 or more, including 50 or more, such as 100 or more, 250 or more, 500 or more, 1,000 or more, 1,500 or more, 2,500 or more, 5,000 or more, and 7,500 or more. In some instances, this initial amplicon composition includes sequences found in at least a subset of the genes listed in Table 1, e.g., a subset of 10 to 8,000, such as 25 to 7,500, including 50 to 5,000 of the genes listed in Table 1, or in some instances the amplicon composition includes sequences found in all of the genes listed in Table 1. The multiple product amplicons making up the amplicon composition may vary in length, ranging in length in some instances from 100 to 1000, such as 125 to 750, including 150 to 700 nt.

The initial product amplicon composition may be employed in a variety of different applications, including evaluation of the expression profile of the sample from which the template target nucleic acid was obtained. In such instances, the expression profile may be obtained from the amplicon composition using any convenient protocol, such as but not limited to differential gene expression analysis, array-based gene expression analysis, NGS sequencing, etc.

For example, the amplicon composition may be employed in hybridization assays in which a nucleic acid array that displays "probe" nucleic acids for each of the genes to be assayed/profiled in the profile to be generated is employed. In these assays, the amplicon composition is first prepared from the initial target nucleic acid sample being assayed as described above, where preparation may include labeling of the target nucleic acids with a label, e.g., a member of signal producing system. Following amplicon production, e.g., as described above, the sample is contacted with the array under hybridization conditions, whereby complexes are formed between target nucleic acids that are complementary to probe sequences attached to the array surface. The presence of hybridized complexes is then detected, either qualitatively or quantitatively. Specific hybridization technology which may be practiced to generate the expression profiles employed in the subject methods includes the technology described in U.S. Pat. Nos. 5,143,854; 5,288,644; 5,324,633; 5,432,049; 5,470,710; 5,492,806; 5,503,980; 5,510,270; 5,525,464; 5,547,839; 5,580,732; 5,661,028; 5,800,992; the disclosures of which are herein incorporated by reference; as well as WO 95/21265; WO 96/31622; WO 97/10365; WO 97/27317; EP 373 203; and EP 785 280. In these methods, an array of "probe" nucleic acids that includes a probe for each of the phenotype determinative genes whose expression is being assayed is contacted with target nucleic acids as described above. Contact is carried out under hybridization conditions, e.g., stringent hybridization conditions, and unbound nucleic acid is then removed. The resultant pattern of hybridized nucleic acid provides information regarding expression for each of the genes that have been probed, where the expression information is in terms of whether or not the gene is expressed and, typically, at what level, where the expression data, i.e., expression profile (e.g., in the form of a transcriptome), may be both qualitative and quantitative.

Alternatively, non-array based methods for quantitating the levels of one or more nucleic acids in a sample may be employed, including quantitative PCR, real-time quantitative PCR, and the like. (For general details concerning real-time PCR see Real-Time PCR: An Essential Guide, K. Edwards et al., eds., Horizon Bioscience, Norwich, U.K. (2004)).

In some instances, the method further includes sequencing the multiple product amplicons, e.g., by using a Next Generation Sequencing (NGS) protocol. In such instances, if not already present, the methods may include modifying the initial amplicon composition to include one or more components employed in a given NGS protocol, e.g., sequencing platform adaptor constructs, indexing domains, clustering domains, etc.

By "sequencing platform adapter construct" is meant a nucleic acid construct that includes at least a portion of a nucleic acid domain (e.g., a sequencing platform adapter nucleic acid sequence) or complement thereof utilized by a sequencing platform of interest, such as a sequencing platform provided by Illumina® (e.g., the HiSeg™, MiSeg™ and/or Genome Analyzer™ sequencing systems); Ion Torrent™ (e.g., the Ion PGM™ and/or Ion Proton™ sequencing systems); Pacific Biosciences (e.g., the PACBIO RS II sequencing system); Life Technologies™ (e.g., a SOLiD sequencing system); Roche (e.g., the 454 GS FLX+ and/or GS Junior sequencing systems); or any other sequencing platform of interest.

In certain aspects, the sequencing platform adapter construct includes a nucleic acid domain selected from: a domain (e.g., a "capture site" or "capture sequence") that specifically binds to a surface-attached sequencing platform oligonucleotide (e.g., the P5 or P7 oligonucleotides attached to the surface of a flow cell in an Illumina® sequencing system); where the construct may include one or more additional domains, such as but not limited to: a sequencing primer binding domain or clustering domain (e.g., a domain to which the Read 1 or Read 2 primers of the Illumina® platform may bind); a barcode or indexing domain (e.g., a domain that uniquely identifies the sample source of the nucleic acid being sequenced to enable sample multiplexing by marking every molecule from a given sample with a specific barcode or "tag"); a barcode sequencing primer binding domain (a domain to which a primer used for sequencing a barcode binds); a molecular identification domain (e.g., a molecular index tag, such as a randomized tag of 4, 6, or other number of nucleotides) for uniquely marking molecules of interest to determine expression levels based on the number of instances a unique tag is sequenced; a complement of any such domains; or any combination thereof. In certain aspects, a barcode domain (e.g., sample index tag) and a molecular identification domain (e.g., a molecular index tag) may be included in the same nucleic acid.

The sequencing platform adapter constructs may include nucleic acid domains (e.g., "sequencing adapters") of any length and sequence suitable for the sequencing platform of interest. In certain aspects, the nucleic acid domains are from 4 to 200 nucleotides in length. For example, the nucleic acid domains may be from 4 to 100 nucleotides in length, such as from 6 to 75, from 8 to 50, or from 10 to 40 nucleotides in length. According to certain embodiments, the sequencing platform adapter construct includes a nucleic acid domain that is from 2 to 8 nucleotides in length, such as from 9 to 15, from 16-22, from 23-29, or from 30-36 nucleotides in length.

The nucleic acid domains may have a length and sequence that enables a polynucleotide (e.g., an oligonucleotide) employed by the sequencing platform of interest to specifically bind to the nucleic acid domain, e.g., for solid phase amplification and/or sequencing by synthesis of the cDNA insert flanked by the nucleic acid domains. Example nucleic acid domains include the P5 (5'-AATGATACGGCGACCACCGA-3') (SE ID NO:03), P7 (5'-CAAGCAGAAGACGGCATACGAGAT-3')(SEQ ID NO:04), Read 1 primer (5'-ACACTCTTTCCCTACACGACGCTCTTCCGATCT-3') (SEQ ID NO:05) and Read 2 primer (5'-GTGACTGGAGTTCAGACGTGTGCTCTTCCGATCT-3') (SEQ ID NO:06) domains employed on the Illumina®-based sequencing platforms. Other example nucleic acid domains include the A adapter (5'-CCATCTCATCCCTGCGTGTCTCCGACTCAG-3')(SEQ ID NO:07) and P1 adapter (5'-CCTCTCTATGGGCAGTCGGTGAT-3')(SEQ ID NO:08) domains employed on the Ion Torrent™-based sequencing platforms.

The nucleotide sequences of nucleic acid domains useful for sequencing on a sequencing platform of interest may vary and/or change over time. Adapter sequences are typically provided by the manufacturer of the sequencing platform (e.g., in technical documents provided with the sequencing system and/or available on the manufacturer's website). Based on such information, the sequence of the sequencing platform adapter construct of the template switch oligonucleotide (and optionally, a first strand synthesis primer, amplification primers, and/or the like) may be designed to include all or a portion of one or more nucleic acid domains in a configuration that enables sequencing the nucleic acid insert (corresponding to the template nucleic acid) on the platform of interest.

The sequencing adaptors may be added to the amplicons of the initial amplicon composition using any convenient protocol, where suitable protocols that may be employed include, but are not limited to: amplification protocols, ligation protocols, etc. In some instances, amplification protocols are employed. In such instances, the initial amplicon composition may be combined with forward and reverse sequencing adaptor primers that include one or more sequencing adaptor domains, e.g., as described above, as well as domains that bind to universal primer sites found in all of the amplicons in the composition, e.g., the forward and reverse anchor domains, such as described above. As reviewed above, amplification conditions may include the addition of forward and reverse sequencing adaptor primers configured to bind to the common forward and reverse anchor domains and thereby amplify all or a desired portion of the product nucleic acid, dNTPs, and a polymerase suitable for effecting the amplification (e.g., a thermostable polymerase for polymerase chain reaction), where examples of such conditions are further described above. The forward and reverse sequencing adaptor primers employed in these embodiments may vary in length, ranging in length in some instances from 20 to 60 nt, such as 25 to 50 nt. Addition of NGS sequencing adaptors results in the production of a composition which is configured for sequencing by a NGS sequencing protocol, i.e., an NGS library.

In certain aspects, the methods of the present disclosure further include subjecting the NGS library to NGS protocol. Next Generation Sequencing (NGS) is a technique capable of sequencing millions of DNA molecules in parallel. The protocol may be carried out on any suitable NGS sequencing platform. NGS platforms of interest include, but are not limited to, a sequencing platform provided by Illumina® (e.g., the HiSeg™, MiSeg™ and/or NextSeq™ sequencing systems); Ion Torrent™ (e.g., the Ion PGM™ and/or Ion Proton™ sequencing systems); Pacific Biosciences (e.g., the PACBIO RS II Sequel sequencing system); Life Technologies™ (e.g., a SOLiD sequencing system); Roche (e.g., the 454 GS FLX+ and/or GS Junior sequencing systems); or any other sequencing platform of interest. The NGS protocol will vary depending on the particular NGS sequencing system employed. Detailed protocols for sequencing an NGS library, e.g., which may include further amplification (e.g., solid-phase amplification), sequencing the amplicons, and analyzing the sequencing data are available from the manufacturer of the NGS system employed. Protocols for performing next generation sequencing, including methods of processing the sequencing data, e.g., to count and tally sequences and assemble transcriptome data therefrom, are further described in published United States Patent Application 20150344938, the disclosure of which is herein incorporated by reference.

Utility

The subject methods find use in a variety of applications, including expression profiling or transcriptome determination applications where a sample is evaluated to obtain an expression profile of the sample. By "expression profile" is meant the expression level of a gene of interest in a sample, which may be a single cell or a combination of multiple cells (e.g., as determined by quantitating the level of an RNA or protein encoded by the gene of interest), or a set of expression levels of a plurality (e.g., 2 or more) of genes of interest. In certain aspects, the expression profile includes expression level data for 1, 2 or more, 5 or more, 10 or more, 20 or more, 50 or more, 100 or more, 200 or more, 300 or more, 400 or more, 500 or more, 1,000 or more, 5,000 or more, e.g., 10,000 or more genes of interest. According to one embodiment, the expression profile includes expression level data of from 50 to 8000 genes of interest, e.g., from 1000 to 5000 genes of interest. In certain aspects, the methods may be employed detecting and/or quantitating the expression of all or substantially all of the cancer associated genes transcribed in a target cell. The terms "expression" and "gene expression" include transcription and/or translation of nucleic acid material. For example, gene expression profiling may include detecting and/or quantitating one or more of any RNA species transcribed from the genomic DNA of the target cell, including pre-mRNAs, mRNAs, non-coding RNAs, microRNAs, small RNAs, regulatory RNAs, and any combination thereof.

Expression levels of an expressed sequence are optionally normalized by reference or comparison to the expression level(s) of one or more control expressed genes, including but not limited to, ACTB, GAPDH, HPRT-1, RPL25, RPS30, and combinations thereof. These "normalization genes" have expression levels that are relatively constant among target cells in the cellular sample.

According to certain embodiments, the expression profile includes "binary" or "qualitative" information regarding the expression of each gene of interest in a target cell. That is, in such embodiments, for each gene of interest, the expression profile only includes information that the gene is expressed or not expressed (e.g., above an established threshold level) in the sample being analyzed, e.g., tissue, cell, etc. In other embodiments, the expression profile includes quantitative information regarding the level of expression (e.g., based on rate of transcription, rate of splicing and/or RNA abundance) of one or more genes of interest. A qualitative and/or quantitative expression profile from the sample may be compared to, e.g., a comparable expression profile generated from other samples and/or one or more reference profiles from cells known to have a particular biological phenotype or condition (e.g., a disease condition, such as a tumor cell; or treatment condition, such as a cell treated with an agent, e.g., a drug). When the profiles being compared are quantitative expression profiles, the comparison may include determining a fold-difference between one or more genes in the expression profile of a target cell and the corresponding genes in the expression profile(s) of one or more different target cells in the cellular sample, or the corresponding genes in a reference cell or cellular sample. Alternatively, or additionally, the expression profile may include information regarding the relative expression levels of different genes in a single target cell. In certain aspects, the fold difference in intercellular expression levels or intracellular expression levels can be determined to be 0.1 or more, 0.5 fold or more, 1 fold or more, 1.5 fold or more, 2 fold or more, 2.5 fold or more, 3 fold or more, 4 fold or more, 5 fold or more, 6 fold or more, 7 fold or more, 8 fold or more, 9 fold or more, or more than 10 fold or more, for example.

In some instances, the methods may be employed to determine the transcriptome of a sample. The term "transcriptome" is employed in its conventional sense to refer to the set of all messenger RNA molecules in one cell or a population of cells. In some instances, a transcriptome includes the amount or concentration of each RNA molecule in addition to the molecular identities.

Expression profiles obtained using methods of the invention may be employed in a variety of applications. For example, an expression profile may be indicative of the biological condition of the sample or host from which the sample is obtained, including but not limited to a disease condition (e.g., a cancerous condition, metastatic potential, an epithelial mesenchymal transition (EMT) characteristic, and/or any other disease condition of interest), the condition of the cell in response to treatment with any physical action (e.g., heat shock, hypoxia, normoxia, hydrodynamic stress, radiation, and/or the like), the condition of the cell in response to treatment with chemical compounds (e.g., drugs, cytotoxic agents, nutrients, salts, and/or the like) or biological extracts or entities (e.g., viruses, bacteria, other cell types, growth factors, biologics, and/or the like), and/or any other biological condition of interest (e.g. immune response, senescence, inflammation, motility, and/or the like).

Embodiments of the invention find further application in tumor microenvironment analysis applications. Transcriptome data obtained, e.g., as described above, may be employed to determine the cellular constitution of a tumor sample, e.g., to provide an evaluation of the types of cells present in a tumor sample, such as infiltrating hematopoietic cells, tumor cells and bulk tissue cells. For example, transcriptome data may be employed to assess whether a tumor sample does not does not include infiltrating immune cells, including those of the adaptive and/or innate immune system, such as but not limited to: T, B, natural killer, nmonocyte, granulocytes, neutrophils, basophils, platelets, and their myeloid and lymphoid progenitor cells, hematopoietic stem cells, and the like. Such information may be used, e.g., in therapy determination applications, for example where the presence of infiltrating immune cells indicates that a patient will be responsive to immunotherapy while the absence of infiltrating immune cells indicates that a patient will not be responsive to immunotherapy. As such, aspects of the invention include methods of therapy determination, where a patient tumor sample is evaluated to assess the tumor microenvironment and a determination to employ an immunotherapy protocol is made if the tumor microenvironment includes infiltrating tumor cells and a determination is made to employ a non-immunotherapy treatment regimen if the tumor microenvironment lacks infiltrating immune cells. Transcriptome data, e.g., produced as described above, also finds use in other non-clinical applications. For example, such day finds use predictive and prognostic biomarker discovery applications, evaluation of cancer immunoediting mechanism applications, drug target discovery and the like.

Compositions

Aspects of the invention further include various compositions. Compositions of the invention may include, e.g., one or more of any of the reaction mixture components described above with respect to the subject methods. For example, the compositions may include one or more of a target nucleic acid template (e.g., genomic DNA sample, cDNA sample, RNA sample, etc.), a polymerase (e.g., a thermostable polymerase), a set of gene specific primers, dNTPs, a salt, a metal cofactor, one or more nuclease inhibitors (e.g., an RNase inhibitor), one or more enzyme-stabilizing components (e.g., DTT), or any other desired reaction mixture component(s). Also provided are compositions that include a primer extension product composition, e.g., as described above. Also provided are amplicon compositions and NGS libraries, such as described above.

The subject compositions may be present in any suitable environment. According to one embodiment, the composition is present in a reaction tube (e.g., a 0.2 mL tube, a 0.5 mL tube, a 1.5 mL tube, or the like) or a well. In certain aspects, the composition is present in two or more (e.g., a plurality of) reaction tubes or wells (e.g., a plate, such as a 96-well plate). The tubes and/or plates may be made of any suitable material, e.g., polypropylene, or the like. In certain aspects, the tubes and/or plates in which the composition is present provide for efficient heat transfer to the composition (e.g., when placed in a heat block, water bath, thermocycler, and/or the like), so that the temperature of the composition may be altered within a short period of time, e.g., as necessary for a particular enzymatic reaction to occur. According to certain embodiments, the composition is present in a thin-walled polypropylene tube, or a plate having thin-walled polypropylene wells. Other suitable environments for the subject compositions include, e.g., a microfluidic chip (e.g., a "lab-on-a-chip device"). The composition may be present in an instrument configured to bring the composition to a desired temperature, e.g., a temperature-controlled water bath, heat block, or the like. The instrument configured to bring the composition to a desired temperature may be configured to bring the composition to a series of different desired temperatures, each for a suitable period of time (e.g., the instrument may be a thermocycler).

Kits

Aspects of the present disclosure also include kits. The kits may include, e.g., one or more of any of the reaction mixture components described above with respect to the subject methods. For example, the kits may include one or more of: a set of gene specific primers, a polymerase (e.g., a thermostable polymerase, a reverse transcriptase, or the like), dNTPs, a salt, a metal cofactor, one or more nuclease inhibitors (e.g., an RNase inhibitor and/or a DNase inhibitor), one or more molecular crowding agents (e.g., polyethylene glycol, or the like), one or more enzyme-stabilizing components (e.g., DTT), or any other desired kit component(s), such as solid supports, e.g., tubes, beads, microfluidic chips, etc.

Components of the kits may be present in separate containers, or multiple components may be present in a single container. For example, the template switch oligonucleotide and the template switching polymerase may be provided in the same tube, or may be provided in different tubes. In certain embodiments, it may be convenient to provide the components in a lyophilized form, so that they are ready to use and can be stored conveniently at room temperature.

In addition to the above-mentioned components, a subject kit may further include instructions for using the components of the kit, e.g., to practice the subject method. The instructions are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, Hard Disk Drive (HDD), portable flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

The following examples are offered by way of illustration and not by way of limitation.

EXPERIMENTAL

I. Protocol for Producing Sets of Experimentally Validated Gene-Specific Primers A. Background All cancers share common characteristics, such as abnormal cell proliferation, with the potential to invade and spread to other parts of the body—'hallmarks of cancer.' While certain features are consistent across all cancers, each cancer is distinct due to its unique composition, molecular signature, and sensitivity to therapeutics. Recently, our molecular understanding of cancer causation and progression has been greatly enabled by next-generation genome sequencing and other large-scale genomics approaches/methodologies, leading to the discovery and development of molecularly targeted drugs and companion diagnostics for personalized treatment.

Molecular diagnostics is a rapidly growing area of translational research and medicine, with new technologies and applications rapidly emerging. Significantly, quantitative real-time PCR is a valuable technology/platform routinely used for molecular diagnostics of diseases such as cancer. However, in order to successfully introduce highly multiplexed PCR-based diagnostics into the clinical setting, new multiplex PCR technologies must be developed that can cost-effectively and reliably identify cancer-associated mutant genes, or gene expression patterns associated with neoplastic disease and progression. Unfortunately, PCR target specificity is a major concern due to the underlying variability in the physicochemical characteristics of the amplified sequences (e.g. GC content, flanking regions and secondary structures), resulting in the imbalance/skewing of the PCR reaction and the subsequent outcomes. Furthermore, false positives associated with cross-reacting targets and primer-primer interactions; reduce assay robustness, specificity, and sensitivity.

B. Goal

Primer design is a complex and unsolved problem. To this end, we describe the development of a novel in silico multiplex primer design pipeline to unambiguously access primer quality—defined here as the ability to efficiently and specifically amplify the desired template fragments in a complex reaction—on the basis of the primer sequences, target template and the reference/background genome sequence. Subsequently, we used the aforementioned resource and experimentally validated all PCR primers, resulting in multiplex PCR primers with uniform properties. Herein, we describe a novel methodology, which integrates multiplex (suppression PCR) with massively parallel sequencing for high-throughput gene expression/genetic profiling of clinically relevant disease genes.

C. Methods & Design

Our primer design pipeline consists of four major steps: (1) identify all primer binding-site positions among all possible DNA/RNA template sequences; (2) evaluate the binding stability of the entire primer sequence using the NN model to calculate the duplex stability to formed by the subsequence and the primer sequence (only thermodynamically stable mismatches are allowed); (3) filter amplicons by size and target region position and (4) in silico designed primer pairs are experimentally validated using high-throughput array synthesis for primers/corresponding target regions and used under a common PCR thermal profile, facilitating the evaluation of target transcripts of a large number genes in parallel using NexGen Sequencing.

D. In Silico Multiplex Primer Design.

Standard methods for primer design (ad hoc) compute a variety of quality metrics in order to evaluate various aspects of primer quality and then combine these individual metrics into a final score using a weighted sum; however, the weight for each individual quality metric must be specified in order to obtain the final primer pair score. To circumvent these difficulties/limitations we use machine-learning algorithms and a high quality training set we experimentally generated (directly comparable data points), to develop a classifier algorithm that identifies multiplex PCR primers en masse. Briefly, we identify the shortest sequence at the 5'-end of each primer that could bind stably in the target genome/transcriptome. We employ a machine-learning algorithm to determine the optimum primer specificity that focuses on the 5'-end of the primer and identify the shortest primer that has sufficient stability such that, at equilibrium, a pre-specified fraction of molecules in the target database with exact complementarity to the primer would be bound. Importantly, the core features used for prediction were the individual nucleotides and adjacent nucleotides indexed by position in the PCR target site. In addition, general rules concerning optimal primer length, CG content, annealing and melting temperature, secondary structure issues were included. Since oligonucleotide primers are hypothesized to be specific and provide the optimal annealing and melting temperatures, primers of 15-18 bp were considered to be the best for target sequences in target regions and GC content of >50%<67%. Finally, in selecting apposite primer-probe candidates, the variability of the target genome and existence of common mutations were taken into account. A large number of potential primer-probe combinations were selected from either CODS or RefSeq and analyzed for melting temperature ($T_m$), self-complementarity, and secondary structure. BLAST (Basic Local Alignment Search Tool) searches were performed on all candidate primer and probe oligonucleotides to assess their potential for cross-reactivity with other multiplex target sequences or cross-reactivity with other species.

E. Description of Tree Boost Algorithm.

A decision tree is a flow chart-like tree structure, where each internal node denotes a test of an attribute, each branch represents an outcome of the test and leaf nodes represent classes or class distributions. Tree growing at a specific node is terminated when at least one class has equal or <cases than the minimal cases, preventing a tree from sub-dividing into overly specific nodes that have little supporting data. Importantly, unlike other machine-learning algorithms, decision trees are adaptable, easy to interpret, and produce highly accurate models using both categorical and continuous data variables. Accordingly, we used a modified tree classification algorithm (facilitates the ensemble of weak learners until an acceptable low training error was achieved) to develop a novel in silico multiplex primer design system (~2000 features). Initially, each training pattern (including primer thermodynamic properties, secondary structure prediction of target mRNA species and base positions at biologically relevant positions) received a weight that determined its probability of being selected for a training set for an individual component classifier. We first initialized the weights across the training set to be uniform. On each iteration k, we drew a random training set according to these weights and then trained the component classifier Ck on the patterns selected. Next, we increased weights of training patterns misclassified by Ck and decreased weights of the patterns correctly classified by Ck. Patterns chosen according to this distribution were used to train the next classifier, Ck+1, and the process iterated (Ckmax). Finally, K-fold cross-validation was performed k times (folds), and each of the k-sub samples was used once as the validation data. The k results obtained from the k-folds were then averaged to produce a single estimation of model performance.

F. High-Throughput Oligo Synthesis for Experimental Validation

Oligonucleotide libraries consisting of complex mixtures of oligonucleotides ranging in length from 150-200 base pairs were manufactured by Custom Array Technologies under contract. Oligonucleotides were synthesized in spatially distinct locations using standard phosphoramidite chemistry on a silylated 6.625×6 inch wafer using an automated tool designed by Agilent Technologies. The solid support used in synthesis was a flat, non-porous silane coated glass rather than a locally curved, porous surface traditionally used. The coupling steps used inkjet-printing technologies to deliver the appropriate amount of activator and phosphoramidite monomer to specific spatial locations on the solid support under anhydrous conditions. Oxidation and detritylation reactions were performed in dedicated flowcells using novel mechanical operations and fluid management steps to eliminate the depurination side reaction limiting synthesis of long oligonucleotides. After deprotection and release, oligonucleotides were recovered and concentrated by lyophilization in 2 mL tubes. Each Oligo Library yields 10 pmol of nucleic acid material equally divided among up to 55,000 user-defined, unique sequences. In another embodiment, the PCR primers were synthesized using conventional phosphoramidate chemistry and mixed together at approximately equal concentration by IDT and MWG-Operon companies.

Multiplex PCR primers with cognate target sequences were screened en masse. Uniformity of amplification, including primer efficiency, primer specificity and dynamic range (minimum 100 fold) were determined from multiplex reaction kinetic data. Finally, functionally validated primers were selected as experimentally validated primers for use in sets of experimental validated gene specific primers.

II. Multiplex PCR Assay

A. Design of Primers for Anchor Addition, First and Second PCR Steps

Design of Forward and Reverse PCR Gene-specific primers with anchor6 (Fwd-anchor6-GSP primers) and anchor7 (Rev-anchor7-GSP primers) with 3'-extended suppression portion and universal PCR primers (F-MP6GAC and R-MP7CAG) to amplify anchored cDNA/genDNA fragments by PCR.

Sequences that are underlined are the common PCR suppression portions, and those in italics and bold are unique sequences for Fwd or Rev primers, respectively, and GSP is the gene-specific primer domain.

(SEQ ID NOS: 09, 10, 11 and 12)

```
   F-MP6GAC  AGCAGCACCGACCAGCAGAC
Fwd-Anc6-GSP     AGCACCGACCAGCAGACA-GSP>
                                    cDNA/genDNA
                                             <GSP-AGACACGACCAGCCACGA     Rev-Anc7-GSP
                                                  GACACGACCAGCCACGAGCA   R-MP7CAG
```

Sequencing Primers for NextSeq500:

SeqDNA-RevAnc7

(SEQ ID NO: 013)

ACGACGAGCACCGACCAGCACAGA

SeqIND-FwdAnc7

(SEQ ID NO: 014)

TCTGTGCTGGTCGGTGCTCGTCGT

SeqIND-RevAnc6

(SEQ ID NO: 015)

TGTCTGCTGGTCGGTGCTGCTGCT

SeqDNA-FwdAnc6

(SEQ ID NO: 016)

AGCAGCAGCACCGACCAGCAGACA

The resultant structure of amplified cDNA/genomicDNA products after the anchor addition step using mix of Fwd-anchor6-GSPs and Rev-anchor7-GSPs shown above and a first PCR step using universal F-MP6GAC and R-MP7CAG primers as shown above is provide below:

(SEQ ID NO: 017 and 018)

AGCAGCACCGACCAGCAGACA-GSP-DNA (60-400n)-GSP-TCTGTGCTGGTCGGTGCTCGT

TCGTCGTGGCTGGTCGTCTGT-GSP-DNA(60-400n)-GSP-AGACACGACCAGCCACGAGCA

The structure of amplified cDNA/genDNA products were then subjected to a second round of PCR to add Illumina P7, P5 sequencing adaptors.

Protocol for HT sequencing in Next Seq500 machine:

Read 1: SeqDNA-RevAnc7>35 cycles

Ind 1: SeqIND-RevAnc6>6 cycles

Ind 2: SeqIND-FwdAnc7>6 cycles

Read 2: SeqDNA-FwdAnc6>35 cycles

PCR primers for the second PCR step>amplification of cDNA/DNA with anchor6 and anchor7 tailed cDNA/genDNA products generated by extension of cDNA/genDNA with multiplex primers Fwd—:

Set of Forward Indexing Primers for 2nd PCR step:

FP7-A6Ind-A (SEQ ID NOS: 019-024)

AGCAGAAGACGGCATACGAGATATACGACAGCAGCAGCACCGACCAGCAGACA

FP7-A6Ind-B

AGCAGAAGACGGCATACGAGATACTGATCAGCAGCAGCACCGACCAGCAGACA

-continued

FP7-A6Ind-C

AGCAGAAGACGGCATACGAGATAGCATCAAGCAGCAGCACCGACCAGCAGACA

FP7-A6Ind-D

AGCAGAAGACGGCATACGAGATAAGTCGTAGCAGCAGCACCGACCAGCAGACA

FP7-A6Ind-E

AGCAGAAGACGGCATACGAGATATCGCATAGCAGCAGCACCGACCAGCAGACA

FP7-A6Ind-F

AGCAGAAGACGGCATACGAGATACATAGCAGCAGCAGCACCGACCAGCAGACA

Set of Reverse Indexing Primers for $2^{nd}$ PCR step:

RP5-A7Ind-A (SEQ ID NOS: 25-30)

ACGGCGACCACCGAGATCTACACATACGACACGACGAGCACCGACCAGCACAGA

RP5-A7Ind-B

ACGGCGACCACCGAGATCTACACACTGATGACGACGAGCACCGACCAGCACAGA

RP5-A7Ind-C

ACGGCGACCACCGAGATCTACACAGCATCAACGACGAGCACCGACCAGCACAGA

RP5-A7Ind-D

ACGGCGACCACCGAGATCTACACAAGTCGTACGACGAGCACCGACCAGCACAGA

RP5-A7Ind-E

ACGGCGACCACCGAGATCTACACATCGCATACGACGAGCACCGACCAGCACAGA

RP5-A7Ind-F

ACGGCGACCACCGAGATCTACACACATAGCACGACGAGCACCGACCAGCACAGA

After a second PCR step with Fwd and Rev indexed primers and sequences of primers for sequencing cDNA/genDNA inserts and indexes is provided in FIG. 2. (SEQ ID NOS: 31-36)

B. Protocol for Multiplex RT-PCR amplification of target genes for expression profiling or mutation analysis starting from total RNA (1 ng-1 μg) or genomic DNA (10 ng-1 μg) mixed with normalization standards control RNA/DNA templates.

Step 1. Total RNAs (mixed with synthetic control RNA templates) was converted to cDNA in 20-μl of reaction mix using random primer (N6-5 uM) using Maxima RT (Thermo-Fisher) at 50° C. using reagents and supplier protocol.

Step 2. cDNA or genomic DNA (10 ng-1 μg) was primed (add universal anchors 6 and 7) using mix of Forward-anchor6-GSPs and Reverse-anchor7-GSPs primers (10 nM final concentration for the each primer) in 50-ul reaction mix comprising 1×HF Buffer, dNTP (200 uM) and Phusion II (1/100 dilution)(Thermo-Fisher) for 2 cycles at (98° C., 10 sec, 60° C., 1 min, 72° C. for 30 sec) and treated with exoI (40μ) at 37° C. for 30-min.

Step 3. $1^{st}$ PCR>whole volume (50-μl) of anchored DNA fragments (from Step 2) were amplified in 100-μl reaction mix for 12 cycles comprising 1×HF Buffer, dNTP (200 uM), universal PCR primers F-MP6GAC and R-MP7CAG and Phusion II (1/100 dilution)(Thermo-Fisher) for 12 cycles at (98° C. for 10 sec, 60° C. for 10 sec, 72° C. for 20 sec).

Step 4. $2^{nd}$ PCR>5-μl aliquot of 1st PCR was amplified in 100-μl of PCR mix comprising 1×HF Buffer, dNTP (200 μM), indexed Fwd and Rev PCR primers (specific for the each sample) and Phusion II (1/100 dilution)(Thermo-Fisher) for 12-20 cycles at (98° C. for 10 sec, 60° C. for 10 sec, 72° C. for 20 sec). The amplified PCR products were analyzed in 3.5% agarose-1×TAE gel to optimize the cycle number and finally digested with exoI (20 u) and Shrimp alkaline phosphatase (10 u) (New England Biolabs), incubated and 37° C. for 30 min, inactivated at 65° C. for 15 min and purified in Qia PCR column. Purified PCR products were quantitated and different samples were mixed together (at equal amount) and sequenced directly (after dilution to 10 nM) in NextSeq500 using Illumina protocol and reagents for 75 or 300 cycles.

III. Next Generation Sequencing Applications

Recently developed targeted approaches reduce NGS data complexity and generate qualitative sequencing information by measurement of a subset of targets per technical replicate with minimal sample usage. Nonetheless, targeted approaches reported thus far have limited clinical utility due to several scientific challenges, such as a prior determining which genetic markers have the most clinical significance and identifying key genetic variants that are correlated with a specific drug response. Furthermore, technical limitations due to skewing/inaccurate quantitative representation of clinical targets and inter-library variation confound their utility in the clinical setting.

Cancer is a complex multigenic disease characterized by diverse genetic and epigenetic alterations. A comprehensive catalog of all types of variants in cancer opens novel and inimitable opportunities for understanding the mechanism of cancer onset or progression and facilitates a more personalized approach to clinical care, including improved risk stratification and treatment selection. Next-generation sequencing (NGS) is now a major driver in translational/genetic research, providing a powerful way to study DNA or RNA from clinical specimens. For example, transcriptome profiling can unambiguously define a unique gene expression signature for each tumor that may prove useful for both disease to classification and prognosis. Unfortunately, the cost and complexity of whole genome DNA sequencing or transcriptome RNA-sequencing data sets represent barriers to use of these methodologies in routine molecular diagnostic testing.

A. Cancer Core 125 Panel for Quantitative Expression and Mutation Profiling

1. Abstract

We have developed the Cancer Core 125 (CC125) assay to simultaneously quantitatively profile expression, copy number, and mutation level of 125 key cancer genes using multiplex PCR amplification from both total RNA and genomic DNA followed by Next-Gen Sequencing (NGS). The built-in internal calibration standards allow calibration and adjusting of digital NGS data depending on the level of intrinsic noise and quality of samples. The CC125 assay provides quantitative digital expression data for 125 key cancer genes with a 1,000-fold dynamic range and sensitivity down to the 100-cell level as well as the mutation profile of 750 driver mutations with sensitivity down to 1%. The CC125 panel includes the top 50 most mutated genes, 73 targets for FDA-approved anti-cancer drugs, and a comprehensive set of hereditary and prognostic genes used in clinical diagnostics. The CC125 assay provides a cost-effective strategy for the discovery of novel diagnostic and prognostic biomarkers in xenograft, biopsy, blood, and CTC clinical samples.

Cancer Core 125 quantitative multiplex PCR-HT sequencing panel provides first in the class assay that allows one to perform comprehensive molecular profiling at both RNA and DNA level. Moreover, the unique concept of using internal normalization and noise-correction calibration standards allows to generate high quality, reproducible digital profiling data in a wide range of clinical samples even at the single-cell level. The CC125 panel is developed specifically for the set of the biomarkers critical for prediction efficacy of anti-cancer drugs.

2. Summary

The CC125 assay employs computationally-predicted genome-wide set of PCR primers for multiplex PCR which are functionally (i.e., experimentally) validated, e.g., as described above. The unique multiplex primer design minimizes primer dimerization and cross-reactivity while enhancing specificity and efficacy. A single-test tube PCR-Next Gen Sequencing protocols for profiling of up to 2,000 genes is provided. The assay is a fully customizable assay pipeline for simultaneous gene expression, mutation hotspot, and copy-number variation (CNV) analysis in both RNA and DNA obtained from the same sample 3. Conclusion A novel functionally validated assay, Cancer Core 125, includes analysis of 125 key cancer genes that include 50 most mutated genes, 73 targets of FDA-approved anti-cancer drugs and comprehensive set of hereditary and prognostic genes. The assay employs internal calibration allows for absolute quantitation of target product. The assay may be employed with various cell lines and a broad range of clinical specimens (e.g., xenograft, biopsy, FFPE, blood and FNA). This quantitative, multiplexed, high throughput approach leverages the power of NGS and PCR technologies and allows one to obtain simultaneous gene expression, and DNA hotspots in a limited amount of biological sample. The platform is applicable for novel biomarker discovery, for prognostic and diagnostic applications. Currently, a portfolio of such assays are in development to address specific disease areas.

B. Cancer Immunotherapy Diagnostic Panel

1. Introduction

There is ample evidence that development of novel prognostic and predictive biomarkers is a critical step for selecting patients predisposed to respond to existing and novel immunotherapy treatments and their combinations. The Cancer Immunotherapy 2500 (CI2500) assay allows one to dissect cancer immunosurveillance mechanisms and discover novel prognostic and predictive immune response gene signatures.

2. Material and Method

The CI 2,500 assay was developed to quantitatively profile expression of 500 key cancer genes using multiplex PCR amplification from both total RNA and genomic DNA followed by HT sequencing. The built-in internal calibration standards allow calibration and adjusting of digital HT sequencing data depending on the level of intrinsic noise and quality of samples. The CI500 assay also provides quantitative expression data of 2000 key cancer immune-related genes with 1,000-fold dynamic range and sensitivity down to 100 cells in whole lysate and isolated cell fractions from frozen xenograft clinical samples.

3. Results and Discussion

The CI 2500 panel includes 15 experimentally validated core gene signatures which predict efficacy of immunotherapy in several cancer types, including melanoma, colorectal, breast, and lung cancers. Furthermore, the core signatures were expanded by developing an immunotherapy computational functional interaction network model used for predicting key nodes in pathways specific for antigen presentation and recognition, inhibition, activation and motility of immune cells, adhesion, and apoptosis of cancer cells. The CI 2500 panel also includes a set of genes specific primers for detection in the tumor microenvironment of activated immune cells of adaptive and innate immunity and a set of housekeeping genes with constant expression between different cancer types. The CI 2,500 assay may be employed in profiling of key mechanisms of breast cancer tumors used to escape from immunosurveillance.

4. Conclusion

Immunoprofiling of the tumor microenvironment with the CI 2,500 gene panel enables researchers to discover prognostic and predictive immune response biomarker signatures. The predictive signatures have the potential to stratify cancer patients for responses to the growing number of immunotherapeutic treatments.

D. ImmunoCancer Assay for Predictive Diagnostics in Cancer Therapy

Immunoprofiling of tumor microenvironment with the ImmunoCancer assay arms investigators with a contemporary instrument for building therapy predictive gene expression signatures. Predictive signatures allow individual cancer patients and their physicians to optimize therapeutic choices from the growing repertoire of immunotherapeutic options or chemotherapy Cancer immunotherapy is getting broad recognition nowadays due to a substantially higher number of responders than in the past. The immunotherapeutic modality is not just getting competitive, but sometimes even superior over traditional chemo- and radiotherapy modalities. Encouraging results including unprecedented numbers of complete responses are seen in pre-clinical animal experiments and human clinical trials. Nevertheless, numbers of immunotherapy non-responders are still high.

The situation when patients with one and the same tumor type are challenged to choose a therapy from the option of several different modalities is already real for some tumor types and could be foreseen as critical in the future. To provide help to physicians and their patients in making an informed decision, an urgent development of predictive diagnostics is needed to pre-identify individual patients with higher chances of response to the immunotherapeutic modality in general, and to some particular immunotherapeutic approaches in particular. Such approaches include active immunomodulating therapies with cytokines, like IL2, or INFalpha, monoclonal antibodies, specifically those that block cancer counterattack upon host immunity, such as anti-PD-1/PD-L1 antibodies, therapeutic vaccination, adoptive therapy with activated and/or genetically-modified T cells or multiplied tumor infiltrating lymphocytes.

In identifying immune gene signatures to predict responders, ImmunoCancer assay fits most of existing immunotherapeutic approaches that are used to treat various cancer types.

Recent work has suggested the existence among cancer patients of two broad categories, each characterized with a specific type of tumor escape from immunosurveillance (Gajewski et al., "Innate and adaptive immune cells in the tumor microenvironment," Nat. Immunol (2013) 14:1014-22). Within one of them, the tumor microenvironment is almost void of infiltrating immune cells. The absence of cellular substrate to perform immunosurveillance corresponds to poor response of patients of this category to current immunotherapeutic approaches. Tumors within the second category, demonstrate an inflamed phenotype that is characterized by the presence in the microenvironment of activated cells of adaptive and/or innate immunity. Since no tumor destruction has occurred in spite of the presence of immune cells, these tumors appear to resist immune attack by inducing an immunosuppression of infiltrating immune cells. Tumors of this category seem to be responsive to various immunotherapeutic schedules. Major success should be expected from the schedules that are directed to specifically de-repress a dominating immunosuppressive mechanism of a given tumor.

The ImmunoCancer assay is created as a prototype predictive diagnostic assay to ultimately identify potential responders to the immunotherapeutic modality in general and to a specific immunotherapeutic approach in particular for every chosen cancer type, whether it is breast, prostate, lung, colon, or any other solid cancer.

This assay is based on expression immunoprofiling of the two mentioned major gene groups in the tumor tissue. The first one allows one to differentiate tumor microenvironments of inflamed phenotype from microenvironment void of immune cell infiltration. The other one is comprised of genes that are related to the functioning of a whole spectrum of various immune mechanisms, such as antigen presentation, motility of immune cells within tumor interstitium, recognition of targets on the surface of tumor cells, efficient adhesion and killing of cancer cells. The peculiarities of expression of genes from the first group in tumor microenvironment allows to judge on the spectrum of tumor infiltrating leukocytes, if any. The expression profiling for the second group of genes provides gene signatures to conclude on a particular suppressive mechanism or mechanisms that are used by the tumor of a given cancer patient to evade immunosurveillance. Genes from signature sets that have already been proven to have diagnostic value in oncotherapy in several cancer types, including melanoma, colorectal cancer, breast cancer, lung cancer and some others are included in ImmunoCancer assay along with the potentially relevant but yet not proven genes. The major groups, their subgroups and corresponding genes are all present in Table 1.

Within each of the two major gene groups, for those genes that are known as harboring functional polymorphisms, in addition to their expression testing, genotyping of their polymorphic variants will be done. It is important to do, since the "efficient" expression level of a gene is lower than real expression level in carriers of polymorphic gene variant that encode protein variant with lower functional activity than in wild type variant carriers. The genotyping will allows one to perform important expression adjustments for variant carriers in order to define the “efficient” expression level for each of such genes in the microenvironment of their tumors.

Additionally, for genes that encode proteins with two isoforms, membrane and soluble ones, the expression ratio of RNAs encoding each of the isoform will be determined, since the ratio of the two is critical for proper functioning of several major immune mechanisms of the inflammatory immune response.

Together with the above explained principles beyond the gene selection, the profiling of functional genetic polymorphisms and membrane/soluble isoform ratios make the ImmunoCancer assay unique in its potential to reveal predictive diagnostic signatures for cancer immunotherapy responders/non-responders.

Interestingly, unexpected recent data show the potential of the immune profile of a tumor microenvironment to predict an outcome for chemotherapy, as well. These important observations comply with the idea that the successful outcome in chemotherapy occurs in cases when at least some level of internal anti-tumor immunity is preserved. Thus, chemotherapeutic assault seems to be efficient only when working in parallel with elements of host anti-tumor immunity. Conclusions upon the presence and working status of these elements that are made from the data on tumor immunoprofiling with ImmunoCancer assay could be potentially predictive for chemotherapeutic modality, as well.

IV. CancerNet 8K

A. Materials and Methods

1. Step 1-cDNA Synthesis.

10-100 ng of RNA was converted to cDNA using random primer (5 uM) using Maxima RT at 50° C. in 10 ul reaction mix. RT was inactivated at 95° C. for 5 min.

2. Step 2—Stranded Anchor addition.

cDNA (in 25-ul of 1×Phusion II reaction mix) was primed and extended for 1 cycle at 60° C. extension temperature (30 min) using mix of CancerNet 8K forward primer mix (final concentration of 10 nM of the each primer, gene specific primer domains listed listed in Table 1 and anchor domains as reported above), treated with ExoI (1-ul, 20 units/up for 20 min at 37° C., inactivated at 95° C. for 5 min, subjected to the second round of extension with CancerNet 8K Reverse primer mix (10 nM each) using the same conditions as for Fwd extension step and treated with exol at 37° C. for 20 min, 50° C. for 10 min and 95° C. for 5 min.

3. Step 3-1st PCR.

1st PCR>anchored DNA fragments (25-ul) were directly amplified in 50-ul of 1×Phusion II reaction mix with universal anchor PCR primers (Fwd and Rev, 0.5 uM each, sequences reported above) for 16 cycles using program (98° C. for 20 sec, 65° C. for 10 sec, 72° C. for 10 sec).

4. Step 4-2nd Nested PCR (P5-index and P7-index addition). 2nd PCR>5-ul aliquot of 1st PCR reaction was amplified in 100-ul using combination of P7-Ind-Fwd and P5-Ind-Rev PCR primers with indexes (0.5 uM each, sequences as reported above) for 5 cycles and analyzed in 3% agarose-EtBr gel for presence of 200-400 bp amplicons. cDNA samples with less yield of PCR products were amplified for extra 1-3 cycles in order to adjust the yield of PCR products. The exol (1.5-ul) was added to PCR mix, incubated and 37° C. for 30 min, samples were mix at approximately equal ratio (based on 200-400 bp amplicon band intensity) and purified in Qiagen PCR columns. Purified PCR products were quantitated by measuring OD at 260 nm, and adjusted to 10 nM (2.5 ng/ul).

5. Step 5—HT Sequencing.

cDNA products amplified in CancerNet 8K assay were analyzed in Illumnina NextSeq machine using 75-n paired-end reagent kit using the following program:

Read 1: SeqDNA-Rev>32 cycles; Ind 1:SeqIND-Rev>6 cycles; Ind 2:SeqIND-Fwth6 cycles; Read 2:SeqDNA-Fwd>32 cycles.

Representation of gene-specific amplicons in amplified cDNA products were analyzed using custom gene enumeration software developed at Cellecta, Mountain View, Calif.

FIG. 3 provides a schematic represent of the above steps.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

---

SEQUENCE LISTING (16166 sequences)

SEQ ID NO: 1 - DNA, 18 bp, Artificial sequence
  synthetic polynucleotide sequence
agcaccgaccagcagaca

SEQ ID NO: 2 - DNA, 18 bp, Artificial sequence
  synthetic polynucleotide sequence
agacacgaccagccacga

SEQ ID NO: 3 - DNA, 20 bp, Artificial sequence
  synthetic polynucleotide sequence
aatgatacggcgaccaccga

SEQ ID NO: 4 - DNA, 24 bp, Artificial sequence
  synthetic polynucleotide sequence
caagcagaagacggcatacgagat

SEQ ID NO: 5 - DNA, 33 bp, Artificial sequence
  synthetic polynucleotide sequence
acactctttccctacacgacgctcttccgatct

SEQ ID NO: 6 - DNA, 34 bp, Artificial sequence
  synthetic polynucleotide sequence
gtgactggagttcagacgtgtgctcttccgatct

SEQ ID NO: 7 - DNA, 30 bp, Artificial sequence
  synthetic polynucleotide sequence
ccatctcatccctgcgtgtctccgactcag

SEQ ID NO: 8 - DNA, 23 bp, Artificial sequence
  synthetic polynucleotide sequence
cctctctatgggcagtcggtgat

SEQ ID NO: 9 - DNA, 20 bp, Artificial sequence
  synthetic polynucleotide sequence
agcagcaccgaccagcagac

SEQ ID NO: 10 - DNA, 18 bp, Artificial sequence
  synthetic polynucleotide sequence
agcaccgaccagcagaca

SEQ ID NO: 11 - DNA, 18 bp, Artificial sequence
  synthetic polynucleotide sequence
agcaccgaccagcacaga

SEQ ID NO: 12 - DNA, 20 bp, Artificial sequence
  synthetic polynucleotide sequence
acgagcaccgaccagcacag

SEQ ID NO: 13 - DNA, 24 bp, Artificial sequence
  synthetic polynucleotide sequence
acgacgagcaccgaccagcacaga

SEQ ID NO: 14 - DNA, 24 bp, Artificial sequence
  synthetic polynucleotide sequence
tctgtgctggtcggtgctcgtcgt

SEQ ID NO: 15 - DNA, 24 bp, Artificial sequence
  synthetic polynucleotide sequence
tgtctgctggtcggtgctgctgct

SEQ ID NO: 16 - DNA, 24 bp, Artificial sequence
  synthetic polynucleotide sequence
agcagcagcaccgaccagcagaca

SEQ ID NO: 17 - DNA, 43 bp, Artificial sequence
  synthetic polynucleotide sequence
  misc_feature (22)..(22): n can be any sequence of nucleotides
agcagcaccgaccagcagacantctgtgctggtcggtgctcgt

SEQ ID NO: 18 - DNA, 43 bp, Artificial sequence
  synthetic polynucleotide sequence
  misc_feature (22)..(22): n can be any sequence of nucleotides
acgagcaccgaccagcacagantgtctgctggtcggtgctgct

SEQ ID NO: 19 - DNA, 53 bp, Artificial sequence
  synthetic polynucleotide sequence
agcagaagacggcatacgagatatacgacagcagcagcaccgaccagcagaca

SEQ ID NO: 20 - DNA, 53 bp, Artificial sequence
  synthetic polynucleotide sequence
agcagaagacggcatacgagatactgatgagcagcagcaccgaccagcagaca

SEQ ID NO: 21 - DNA, 53 bp, Artificial sequence
  synthetic polynucleotide sequence
agcagaagacggcatacgagatagcatcaagcagcagcaccgaccagcagaca

SEQ ID NO: 22 - DNA, 53 bp, Artificial sequence
  synthetic polynucleotide sequence
agcagaagacggcatacgagataagtcgtagcagcagcaccgaccagcagaca

SEQ ID NO: 23 - DNA, 53 bp, Artificial sequence
  synthetic polynucleotide sequence
agcagaagacggcatacgagatatcgcatagcagcagcaccgaccagcagaca

SEQ ID NO: 24 - DNA, 53 bp, Artificial sequence
  synthetic polynucleotide sequence
agcagaagacggcatacgagatacatagcagcagcagcaccgaccagcagaca

SEQ ID NO: 25 - DNA, 54 bp, Artificial sequence
  synthetic polynucleotide sequence
acggcgaccaccgagatctacacatacgacacgacgagcaccgaccagcacaga

SEQ ID NO: 26 - DNA, 54 bp, Artificial sequence
  synthetic polynucleotide sequence
acggcgaccaccgagatctacacactgatgacgacgagcaccgaccagcacaga

SEQ ID NO: 27 - DNA, 54 bp, Artificial sequence
  synthetic polynucleotide sequence
acggcgaccaccgagatctacacagcatcaacgacgagcaccgaccagcacaga

SEQ ID NO: 28 - DNA, 54 bp, Artificial sequence
  synthetic polynucleotide sequence
acggcgaccaccgagatctacacaagtcgtacgacgagcaccgaccagcacaga

SEQ ID NO: 29 - DNA, 54 bp, Artificial sequence
  synthetic polynucleotide sequence
acggcgaccaccgagatctacacatcgcatacgacgagcaccgaccagcacaga

SEQ ID NO: 30 - DNA, 54 bp, Artificial sequence
  synthetic polynucleotide sequence
acggcgaccaccgagatctacacacatagcacgacgagcaccgaccagcacaga

SEQ ID NO: 31 - DNA, 24 bp, Artificial sequence
  synthetic polynucleotide sequence
agcagcagcaccgaccagcagaca

SEQ ID NO: 32 - DNA, 24 bp, Artificial sequence
  synthetic polynucleotide sequence
tctgtgctggtcggtgctcgtcgt

SEQ ID NO: 33 - DNA, 112 bp, Artificial sequence
  synthetic polynucleotide sequence
  misc_feature (56)..(56): n can be any sequence of nucleotides
agcagaagacggcatacgagatgcatacgacagcagcagcaccgaccagcagacantctgtgctggtcggtgctcgtcgtgtcgtatgcgtgtagatctcggtggtcgccgt

SEQ ID NO: 34 - DNA, 112 bp, Artificial sequence
  synthetic polynucleotide sequence
  misc_feature (57)..(57): n can be any sequence of nucleotides
acggcgaccaccgagatctacacgcatacgacacgacgagcaccgaccagcacagantgtctgctggtcggtgctgctgctgtcgtatgcatctcgtatgccgtcttctgct

SEQ ID NO: 35 - DNA, 24 bp, Artificial sequence
  synthetic polynucleotide sequence
tgtctgctggtcggtgctgctgct

SEQ ID NO: 36 - DNA, 24 bp, Artificial sequence
  synthetic polynucleotide sequence
agcacgagcaccgaccagcacaga

SEQ ID NO: 37 - DNA, 18 bp, Artificial sequence
  synthetic polynucleotide sequence
gggcagcagccaagagga

SEQ ID NO: 38 - DNA, 18 bp, Artificial sequence
  synthetic polynucleotide sequence
gaagtggcagagttcaca

SEQ ID NO: 39 - DNA, 18 bp, Artificial sequence
  synthetic polynucleotide sequence
aagcagcaggaccgggaa

SEQ ID NO: 40 - DNA, 18 bp, Artificial sequence
  synthetic polynucleotide sequence
agcttcacgaagtcgcaa

SEQ ID NO: 41 - DNA, 18 bp, Artificial sequence
  synthetic polynucleotide sequence
gcagcccctgaggaagga

SEQ ID NO: 42 - DNA, 18 bp, Artificial sequence
  synthetic polynucleotide sequence
acgtcgcatccctgacca

SEQ ID NO: 43 - DNA, 18 bp, Artificial sequence
  synthetic polynucleotide sequence
ccagcgctactgtgacca

SEQ ID NO: 44 - DNA, 18 bp, Artificial sequence
  synthetic polynucleotide sequence
gtgcaggacctgggagga

SEQ ID NO: 45 - DNA, 18 bp, Artificial sequence
  synthetic polynucleotide sequence
agccccaacctcggagga

SEQ ID NO: 46 - DNA, 18 bp, Artificial sequence
  synthetic polynucleotide sequence
gagcatggagagccacca

SEQ ID NO: 47 - DNA, 18 bp, Artificial sequence
  synthetic polynucleotide sequence
attcggccacctccacga

SEQ ID NO: 48 - DNA, 18 bp, Artificial sequence
  synthetic polynucleotide sequence
agccgcaggctcagacca

SEQ ID NO: 49 - DNA, 18 bp, Artificial sequence
  synthetic polynucleotide sequence
gctccacatcagctcgga

SEQ ID NO: 50 - DNA, 18 bp, Artificial sequence
  synthetic polynucleotide sequence
tggtgggggaggaaccca

SEQ ID NO: 51 - DNA, 18 bp, Artificial sequence
  synthetic polynucleotide sequence
ccatggtctgggacccca

SEQ ID NO: 52 - DNA, 18 bp, Artificial sequence
  synthetic polynucleotide sequence
cctgtggaccagcccaca

SEQ ID NO: 53 - DNA, 18 bp, Artificial sequence
  synthetic polynucleotide sequence
cccttgccagcccacaca

SEQ ID NO: 54 - DNA, 18 bp, Artificial sequence
  synthetic polynucleotide sequence
tccggccaagcatgacga

SEQ ID NO: 55 - DNA, 18 bp, Artificial sequence
  synthetic polynucleotide sequence
ggcaacaaccctactgga

SEQ ID NO: 56 - DNA, 18 bp, Artificial sequence
  synthetic polynucleotide sequence
cacgtccatcaacatcca

SEQ ID NO: 57 - DNA, 18 bp, Artificial sequence
  synthetic polynucleotide sequence
cgcgctcatgtgcgagga

SEQ ID NO: 58 - DNA, 18 bp, Artificial sequence
  synthetic polynucleotide sequence
gggagcagtggagctcca

SEQ ID NO: 59 - DNA, 18 bp, Artificial sequence
  synthetic polynucleotide sequence
ggccgtctatacccagga

SEQ ID NO: 60 - DNA, 18 bp, Artificial sequence
  synthetic polynucleotide sequence
caggtgcgttcccccaca

SEQ ID NO: 61 - DNA, 18 bp, Artificial sequence
  synthetic polynucleotide sequence
gggtgagaggacgaggca

SEQ ID NO: 62 - DNA, 18 bp, Artificial sequence
  synthetic polynucleotide sequence
agaccagcgtgggacgga

SEQ ID NO: 63 - DNA, 18 bp, Artificial sequence
  synthetic polynucleotide sequence
gagcgggtcagcaaagca

SEQ ID NO: 64 - DNA, 18 bp, Artificial sequence
  synthetic polynucleotide sequence
gaagggctagcacaggca

SEQ ID NO: 65 - DNA, 18 bp, Artificial sequence
  synthetic polynucleotide sequence
gactccctgctccacaca

SEQ ID NO: 66 - DNA, 18 bp, Artificial sequence
  synthetic polynucleotide sequence
cggctccattgaagccca

SEQ ID NO: 67 - DNA, 18 bp, Artificial sequence
  synthetic polynucleotide sequence
tcagtggagtgagcccca

SEQ ID NO: 68 - DNA, 18 bp, Artificial sequence
  synthetic polynucleotide sequence
catgggaatgaccgccca

SEQ ID NO: 69 - DNA, 18 bp, Artificial sequence
  synthetic polynucleotide sequence
agcacatgtggcgagcaa

SEQ ID NO: 70 - DNA, 18 bp, Artificial sequence
  synthetic polynucleotide sequence
ttaactgcccagacacca

SEQ ID NO: 71 - DNA, 18 bp, Artificial sequence
  synthetic polynucleotide sequence
tggcaggcaatccaggca

SEQ ID NO: 72 - DNA, 18 bp, Artificial sequence
  synthetic polynucleotide sequence
tggccacacggtcacaca

SEQ ID NO: 73 - DNA, 18 bp, Artificial sequence
  synthetic polynucleotide sequence
gcccacagcatcaccaca

SEQ ID NO: 74 - DNA, 18 bp, Artificial sequence
  synthetic polynucleotide sequence
agtagagggtgggggaca

SEQ ID NO: 75 - DNA, 18 bp, Artificial sequence
  synthetic polynucleotide sequence
agggctgaggaaagggga

SEQ ID NO: 76 - DNA, 18 bp, Artificial sequence
  synthetic polynucleotide sequence
gtcgacggctcatccaga

SEQ ID NO: 77 - DNA, 18 bp, Artificial sequence
  synthetic polynucleotide sequence
gggacgcaatgatcgcca

SEQ ID NO: 78 - DNA, 18 bp, Artificial sequence
  synthetic polynucleotide sequence
ctgacgggttccccagga

SEQ ID NO: 79 - DNA, 18 bp, Artificial sequence
  synthetic polynucleotide sequence
tccgagcacacctgggca

SEQ ID NO: 80 - DNA, 18 bp, Artificial sequence
  synthetic polynucleotide sequence
agggcacgagctatggca

SEQ ID NO: 81 - DNA, 18 bp, Artificial sequence
  synthetic polynucleotide sequence
agggcttccatccggcaa

SEQ ID NO: 82 - DNA, 18 bp, Artificial sequence
  synthetic polynucleotide sequence
ccacagaccctaccagca

SEQ ID NO: 83 - DNA, 18 bp, Artificial sequence
  synthetic polynucleotide sequence
gcaaggaagccacagcga

SEQ ID NO: 84 - DNA, 18 bp, Artificial sequence
  synthetic polynucleotide sequence
aggcgagatttccagcca

SEQ ID NO: 85 - DNA, 18 bp, Artificial sequence
  synthetic polynucleotide sequence
gcggctgtgggaaaagca

SEQ ID NO: 86 - DNA, 18 bp, Artificial sequence
  synthetic polynucleotide sequence
agcacaggctcttgagga

SEQ ID NO: 87 - DNA, 18 bp, Artificial sequence
  synthetic polynucleotide sequence
gtggatccgggtgcagca

SEQ ID NO: 88 - DNA, 18 bp, Artificial sequence
  synthetic polynucleotide sequence
acactggatgtgccccga

SEQ ID NO: 89 - DNA, 18 bp, Artificial sequence
  synthetic polynucleotide sequence
tggcccaaagacaggcca

SEQ ID NO: 90 - DNA, 18 bp, Artificial sequence
  synthetic polynucleotide sequence
ggcctttgcaccacccaa

SEQ ID NO: 91 - DNA, 18 bp, Artificial sequence
  synthetic polynucleotide sequence
cgagcgggttgtacagga

SEQ ID NO: 92 - DNA, 18 bp, Artificial sequence
  synthetic polynucleotide sequence
ccatcggccatgacgaca

SEQ ID NO: 93 - DNA, 18 bp, Artificial sequence
  synthetic polynucleotide sequence
cgagttcatcgaccggca

SEQ ID NO: 94 - DNA, 18 bp, Artificial sequence
  synthetic polynucleotide sequence
gggacaggctgaaggaga

SEQ ID NO: 95 - DNA, 18 bp, Artificial sequence
  synthetic polynucleotide sequence
acgggactcaggagcaca

SEQ ID NO: 96 - DNA, 18 bp, Artificial sequence
  synthetic polynucleotide sequence
agctcatgggtgaccgca

SEQ ID NO: 97 - DNA, 18 bp, Artificial sequence
  synthetic polynucleotide sequence
ctgtcaccaggtccccaa

SEQ ID NO: 98 - DNA, 18 bp, Artificial sequence
  synthetic polynucleotide sequence
cagtcaggttcccaacca

SEQ ID NO: 99 - DNA, 18 bp, Artificial sequence
  synthetic polynucleotide sequence
accaggcactgctgcaca

SEQ ID NO: 100 - DNA, 18 bp, Artificial sequence
  synthetic polynucleotide sequence
aggatgacaggggccaga

SEQ ID NO: 101 - DNA, 18 bp, Artificial sequence
  synthetic polynucleotide sequence
tcggggaattggccccaa

SEQ ID NO: 102 - DNA, 18 bp, Artificial sequence
  synthetic polynucleotide sequence
agttcccgagaacaccca

SEQ ID NO: 103 - DNA, 18 bp, Artificial sequence
  synthetic polynucleotide sequence
gggggagctctcaatgga

SEQ ID NO: 104 - DNA, 18 bp, Artificial sequence
  synthetic polynucleotide sequence
gcgtgatcatcaggcaca

SEQ ID NO: 105 - DNA, 18 bp, Artificial sequence
  synthetic polynucleotide sequence
gcagcctgctaaaccgga

SEQ ID NO: 106 - DNA, 18 bp, Artificial sequence
  synthetic polynucleotide sequence
gggctgagacacagagca

SEQ ID NO: 107 - DNA, 18 bp, Artificial sequence
  synthetic polynucleotide sequence
tggctggccacatggaca

SEQ ID NO: 108 - DNA, 18 bp, Artificial sequence
  synthetic polynucleotide sequence
tggcagctgtgagaccca

SEQ ID NO: 109 - DNA, 18 bp, Artificial sequence
  synthetic polynucleotide sequence
ggtggcgagaagcagaga

SEQ ID NO: 110 - DNA, 18 bp, Artificial sequence
  synthetic polynucleotide sequence
gtgatggagagcagggca

SEQ ID NO: 111 - DNA, 18 bp, Artificial sequence
  synthetic polynucleotide sequence
gcctggagtgaatgcaga

SEQ ID NO: 112 - DNA, 18 bp, Artificial sequence
  synthetic polynucleotide sequence
aggtagcagggatggcaa

SEQ ID NO: 113 - DNA, 18 bp, Artificial sequence
  synthetic polynucleotide sequence
gaggggaaaaaggagcga

SEQ ID NO: 114 - DNA, 18 bp, Artificial sequence
  synthetic polynucleotide sequence
atgttcgagacaccagca

SEQ ID NO: 115 - DNA, 18 bp, Artificial sequence
  synthetic polynucleotide sequence
agactgatggcagctcga

SEQ ID NO: 116 - DNA, 18 bp, Artificial sequence
  synthetic polynucleotide sequence
cgatgacgcgatccgcta

SEQ ID NO: 117 - DNA, 17 bp, Artificial sequence
  synthetic polynucleotide sequence
ggagagtcacgcccaca

SEQ ID NO: 118 - DNA, 19 bp, Artificial sequence
  synthetic polynucleotide sequence
gctgacaacgatcacagca

SEQ ID NO: 119 - DNA, 18 bp, Artificial sequence
  synthetic polynucleotide sequence
agagagggtcgtgagcga

SEQ ID NO: 120 - DNA, 18 bp, Artificial sequence
  synthetic polynucleotide sequence
ccattgggccctaccaga

SEQ ID NO: 121 - DNA, 18 bp, Artificial sequence
  synthetic polynucleotide sequence
ggaggagtaccgtcacca

SEQ ID NO: 122 - DNA, 18 bp, Artificial sequence
  synthetic polynucleotide sequence
agaagttggggcagggca

SEQ ID NO: 123 - DNA, 18 bp, Artificial sequence
  synthetic polynucleotide sequence
gacctccctggtggcaca

SEQ ID NO: 124 - DNA, 18 bp, Artificial sequence
  synthetic polynucleotide sequence
gctgacgaagaaccccga

SEQ ID NO: 125 - DNA, 18 bp, Artificial sequence
  synthetic polynucleotide sequence
gcactggccatagcagca

SEQ ID NO: 126 - DNA, 18 bp, Artificial sequence
  synthetic polynucleotide sequence
ctgaagccatgacagcca

SEQ ID NO: 127 - DNA, 18 bp, Artificial sequence
  synthetic polynucleotide sequence
agcgctggatgtggagga

SEQ ID NO: 128 - DNA, 18 bp, Artificial sequence
  synthetic polynucleotide sequence
gcagcacaaggtaggcca

SEQ ID NO: 129 - DNA, 18 bp, Artificial sequence
  synthetic polynucleotide sequence
cgaccaggagagtcagga

SEQ ID NO: 130 - DNA, 18 bp, Artificial sequence
  synthetic polynucleotide sequence
ggggccaagagagcagca

SEQ ID NO: 131 - DNA, 18 bp, Artificial sequence
  synthetic polynucleotide sequence
catcgcggtctcaggaga

SEQ ID NO: 132 - DNA, 18 bp, Artificial sequence
  synthetic polynucleotide sequence
aagccaccgctgaggcca

SEQ ID NO: 133 - DNA, 18 bp, Artificial sequence
  synthetic polynucleotide sequence
aggaactgcggacccaca

SEQ ID NO: 134 - DNA, 18 bp, Artificial sequence
  synthetic polynucleotide sequence
gagtcagtgctgccacca

SEQ ID NO: 135 - DNA, 18 bp, Artificial sequence
  synthetic polynucleotide sequence
tagctgatgggccacaga

SEQ ID NO: 136 - DNA, 18 bp, Artificial sequence
  synthetic polynucleotide sequence
gcagctgtagctacacca

SEQ ID NO: 137 - DNA, 18 bp, Artificial sequence
  synthetic polynucleotide sequence
gaactacacccaggagca

SEQ ID NO: 138 - DNA, 18 bp, Artificial sequence
  synthetic polynucleotide sequence
gcagtgactctcgagcca

SEQ ID NO: 139 - DNA, 18 bp, Artificial sequence
  synthetic polynucleotide sequence
cgggatgtcgatgaggca

SEQ ID NO: 140 - DNA, 18 bp, Artificial sequence
  synthetic polynucleotide sequence
ctccgtggcgactgagca

SEQ ID NO: 141 - DNA, 18 bp, Artificial sequence
  synthetic polynucleotide sequence
gacatatcccctgaccca

SEQ ID NO: 142 - DNA, 18 bp, Artificial sequence
  synthetic polynucleotide sequence
cactgtacccctggcaca

SEQ ID NO: 143 - DNA, 18 bp, Artificial sequence
  synthetic polynucleotide sequence
taagggtgcctcccacca

SEQ ID NO: 144 - DNA, 18 bp, Artificial sequence
  synthetic polynucleotide sequence
cgcagatctcctccacca

SEQ ID NO: 145 - DNA, 18 bp, Artificial sequence
  synthetic polynucleotide sequence
caggacatgagggcacca

SEQ ID NO: 146 - DNA, 18 bp, Artificial sequence
  synthetic polynucleotide sequence
gagtactgcaggccagca

SEQ ID NO: 147 - DNA, 18 bp, Artificial sequence
  synthetic polynucleotide sequence
agtccaggcaggacagca

SEQ ID NO: 148 - DNA, 18 bp, Artificial sequence
  synthetic polynucleotide sequence
gtgccatactgggaacca

SEQ ID NO: 149 - DNA, 18 bp, Artificial sequence
  synthetic polynucleotide sequence
cccagctccttggaccca

SEQ ID NO: 150 - DNA, 18 bp, Artificial sequence
  synthetic polynucleotide sequence
ctgggctcatcaggccca

SEQ ID NO: 151 - DNA, 18 bp, Artificial sequence
  synthetic polynucleotide sequence
agatggacgcactgggca

SEQ ID NO: 152 - DNA, 18 bp, Artificial sequence
  synthetic polynucleotide sequence
ggacaggttcctggcgaa

SEQ ID NO: 153 - DNA, 18 bp, Artificial sequence
  synthetic polynucleotide sequence
acccagccaagtccccaa

SEQ ID NO: 154 - DNA, 18 bp, Artificial sequence
  synthetic polynucleotide sequence
aacgcaggaggcggagca

SEQ ID NO: 155 - DNA, 18 bp, Artificial sequence
  synthetic polynucleotide sequence
acctgtgcccaacagcca

SEQ ID NO: 156 - DNA, 18 bp, Artificial sequence
  synthetic polynucleotide sequence
acagcctctcggaaggca

SEQ ID NO: 157 - DNA, 18 bp, Artificial sequence
  synthetic polynucleotide sequence
ctgcggcctaccaggaca

SEQ ID NO: 158 - DNA, 18 bp, Artificial sequence
  synthetic polynucleotide sequence
tgacctggtgagccagga

SEQ ID NO: 159 - DNA, 18 bp, Artificial sequence
  synthetic polynucleotide sequence
caagacctaccaccccga

SEQ ID NO: 160 - DNA, 18 bp, Artificial sequence
  synthetic polynucleotide sequence
ttcggaggccctgggaca

SEQ ID NO: 161 - DNA, 18 bp, Artificial sequence
  synthetic polynucleotide sequence
ccgacgagatgctggaga

SEQ ID NO: 162 - DNA, 18 bp, Artificial sequence
  synthetic polynucleotide sequence
ggtgaggtgagcgggaga

SEQ ID NO: 163 - DNA, 18 bp, Artificial sequence
  synthetic polynucleotide sequence
cacagccacacctgggaa

SEQ ID NO: 164 - DNA, 18 bp, Artificial sequence
  synthetic polynucleotide sequence
cgttgtcccgaggccaca

SEQ ID NO: 165 - DNA, 18 bp, Artificial sequence
  synthetic polynucleotide sequence
ttgccgagaaggagccca

SEQ ID NO: 166 - DNA, 18 bp, Artificial sequence
  synthetic polynucleotide sequence
catgacgtcatgggacca

SEQ ID NO: 167 - DNA, 18 bp, Artificial sequence
  synthetic polynucleotide sequence
ctgcactggggcacgaca

SEQ ID NO: 168 - DNA, 18 bp, Artificial sequence
  synthetic polynucleotide sequence
tcccgatgcacatggaca

SEQ ID NO: 169 - DNA, 18 bp, Artificial sequence
  synthetic polynucleotide sequence
accgaaagcatgagccaa

SEQ ID NO: 170 - DNA, 18 bp, Artificial sequence
  synthetic polynucleotide sequence
gccatggggagctggaca

SEQ ID NO: 171 - DNA, 18 bp, Artificial sequence
  synthetic polynucleotide sequence
cgtcctcacccaacccaa

SEQ ID NO: 172 - DNA, 18 bp, Artificial sequence
  synthetic polynucleotide sequence
gcctggctctaccaacca

SEQ ID NO: 173 - DNA, 18 bp, Artificial sequence
  synthetic polynucleotide sequence
tcacacccactgacccca

SEQ ID NO: 174 - DNA, 18 bp, Artificial sequence
  synthetic polynucleotide sequence
gaggccttcctgcaagca

SEQ ID NO: 175 - DNA, 18 bp, Artificial sequence
  synthetic polynucleotide sequence
catcctcacccgagacca

SEQ ID NO: 176 - DNA, 18 bp, Artificial sequence
  synthetic polynucleotide sequence
gagcttggccatggagca

SEQ ID NO: 177 - DNA, 18 bp, Artificial sequence
  synthetic polynucleotide sequence
gggccagcgatgttcaga

SEQ ID NO: 178 - DNA, 18 bp, Artificial sequence
  synthetic polynucleotide sequence
gctaatccaacagcacca

SEQ ID NO: 179 - DNA, 18 bp, Artificial sequence
  synthetic polynucleotide sequence
cctcagcgaaccagggaa

SEQ ID NO: 180 - DNA, 18 bp, Artificial sequence
  synthetic polynucleotide sequence
aagaccacggcagccgaa

SEQ ID NO: 181 - DNA, 18 bp, Artificial sequence
  synthetic polynucleotide sequence
agcagtgctgagcacgca

SEQ ID NO: 182 - DNA, 18 bp, Artificial sequence
  synthetic polynucleotide sequence
gttaacgggcaggtggaa

SEQ ID NO: 183 - DNA, 18 bp, Artificial sequence
  synthetic polynucleotide sequence
agtacgggctctggagca

SEQ ID NO: 184 - DNA, 18 bp, Artificial sequence
  synthetic polynucleotide sequence
cttgaggccctcgagaga

SEQ ID NO: 185 - DNA, 18 bp, Artificial sequence
  synthetic polynucleotide sequence
ccctgctacgactggcaa

SEQ ID NO: 186 - DNA, 18 bp, Artificial sequence
  synthetic polynucleotide sequence
gtctgacgccatgaggga

SEQ ID NO: 187 - DNA, 18 bp, Artificial sequence
  synthetic polynucleotide sequence
gacggcagatgcagcgaa

SEQ ID NO: 188 - DNA, 18 bp, Artificial sequence
  synthetic polynucleotide sequence
tctacagcagcgtcagca

SEQ ID NO: 189 - DNA, 18 bp, Artificial sequence
  synthetic polynucleotide sequence
cagcatggagctgccaga

SEQ ID NO: 190 - DNA, 18 bp, Artificial sequence
  synthetic polynucleotide sequence
ccatgcctcctgcaacca

SEQ ID NO: 191 - DNA, 18 bp, Artificial sequence
  synthetic polynucleotide sequence
tgagctgcccccaccaga

SEQ ID NO: 192 - DNA, 18 bp, Artificial sequence
  synthetic polynucleotide sequence
ctggagcagccaaggaca

SEQ ID NO: 193 - DNA, 18 bp, Artificial sequence
  synthetic polynucleotide sequence
ttccaggagctgcagcca

SEQ ID NO: 194 - DNA, 18 bp, Artificial sequence
  synthetic polynucleotide sequence
ctgaagggaagggcacca

SEQ ID NO: 195 - DNA, 18 bp, Artificial sequence
  synthetic polynucleotide sequence
aagtgacctggcagccga

SEQ ID NO: 196 - DNA, 18 bp, Artificial sequence
  synthetic polynucleotide sequence
catccacaggggccagga

SEQ ID NO: 197 - DNA, 18 bp, Artificial sequence
  synthetic polynucleotide sequence
gccccagtccaatcccaa

SEQ ID NO: 198 - DNA, 18 bp, Artificial sequence
  synthetic polynucleotide sequence
cagagggacggtccacca

SEQ ID NO: 199 - DNA, 18 bp, Artificial sequence
  synthetic polynucleotide sequence
gtggaactgccacgcaga

SEQ ID NO: 200 - DNA, 18 bp, Artificial sequence
  synthetic polynucleotide sequence
tcatggcaaggagtggaa

SEQ ID NO: 201 - DNA, 18 bp, Artificial sequence
  synthetic polynucleotide sequence
gtccccagccaatcagga

SEQ ID NO: 202 - DNA, 18 bp, Artificial sequence
  synthetic polynucleotide sequence
tcagcaagatggcagcca

SEQ ID NO: 203 - DNA, 18 bp, Artificial sequence
  synthetic polynucleotide sequence
ctggagcccacaacacca

SEQ ID NO: 204 - DNA, 18 bp, Artificial sequence
  synthetic polynucleotide sequence
gcatccaaggcaccccca

SEQ ID NO: 205 - DNA, 18 bp, Artificial sequence
  synthetic polynucleotide sequence
ccgtcatggcacggggaa

SEQ ID NO: 206 - DNA, 18 bp, Artificial sequence
  synthetic polynucleotide sequence
ctttgccagccagaacga

SEQ ID NO: 207 - DNA, 18 bp, Artificial sequence
  synthetic polynucleotide sequence
ctaccagcacccacccaa

SEQ ID NO: 208 - DNA, 18 bp, Artificial sequence
  synthetic polynucleotide sequence
cccacggaacttgagcca

SEQ ID NO: 209 - DNA, 18 bp, Artificial sequence
  synthetic polynucleotide sequence
ggaggagaaagccccaga

SEQ ID NO: 210 - DNA, 18 bp, Artificial sequence
  synthetic polynucleotide sequence
caccaaggcatgcaggga

SEQ ID NO: 211 - DNA, 18 bp, Artificial sequence
  synthetic polynucleotide sequence
ccccttccgagctgacca

SEQ ID NO: 212 - DNA, 18 bp, Artificial sequence
  synthetic polynucleotide sequence
atcacgccctcctgggca

SEQ ID NO: 213 - DNA, 18 bp, Artificial sequence
  synthetic polynucleotide sequence
gggcgcatacatgaagga

SEQ ID NO: 214 - DNA, 18 bp, Artificial sequence
  synthetic polynucleotide sequence
gaatagccatgcccacca

SEQ ID NO: 215 - DNA, 18 bp, Artificial sequence
  synthetic polynucleotide sequence
atccggagctgaccagca

SEQ ID NO: 216 - DNA, 18 bp, Artificial sequence
  synthetic polynucleotide sequence
cacagaggcgcttgagca

SEQ ID NO: 217 - DNA, 18 bp, Artificial sequence
  synthetic polynucleotide sequence
agctcacggtggtccaga

SEQ ID NO: 218 - DNA, 18 bp, Artificial sequence
  synthetic polynucleotide sequence
gaccacagggcgtacaga

SEQ ID NO: 219 - DNA, 17 bp, Artificial sequence
  synthetic polynucleotide sequence
ggcattcccatgagcca

SEQ ID NO: 220 - DNA, 19 bp, Artificial sequence
  synthetic polynucleotide sequence
ctctgcagcacctgacaca

SEQ ID NO: 221 - DNA, 18 bp, Artificial sequence
  synthetic polynucleotide sequence
ggaggggatgctacagca

SEQ ID NO: 222 - DNA, 18 bp, Artificial sequence
  synthetic polynucleotide sequence
gcctcagcactcatgaga

SEQ ID NO: 223 - DNA, 18 bp, Artificial sequence
  synthetic polynucleotide sequence
cagatggcagtaggccca

SEQ ID NO: 224 - DNA, 18 bp, Artificial sequence
  synthetic polynucleotide sequence
atggtcaggtcaacagca

SEQ ID NO: 225 - DNA, 18 bp, Artificial sequence
  synthetic polynucleotide sequence
cagaagccaggttcccaa

SEQ ID NO: 226 - DNA, 18 bp, Artificial sequence
  synthetic polynucleotide sequence
gcacatgggcttgggaga

SEQ ID NO: 227 - DNA, 18 bp, Artificial sequence
  synthetic polynucleotide sequence
acgagccgtatcccctca

SEQ ID NO: 228 - DNA, 18 bp, Artificial sequence
  synthetic polynucleotide sequence
tgagggatcacagggcca

SEQ ID NO: 229 - DNA, 18 bp, Artificial sequence
  synthetic polynucleotide sequence
aggctgtgcccgtgccaa

SEQ ID NO: 230 - DNA, 18 bp, Artificial sequence
  synthetic polynucleotide sequence
aggtggaggggtggccga

SEQ ID NO: 231 - DNA, 18 bp, Artificial sequence
  synthetic polynucleotide sequence
atcggaaggtgtcccgca

SEQ ID NO: 232 - DNA, 18 bp, Artificial sequence
  synthetic polynucleotide sequence
cctggctccatcgaagca

SEQ ID NO: 233 - DNA, 18 bp, Artificial sequence
  synthetic polynucleotide sequence
acactgtggccgagcaca

SEQ ID NO: 234 - DNA, 18 bp, Artificial sequence
  synthetic polynucleotide sequence
tcagtcgcagcgggctca

SEQ ID NO: 235 - DNA, 18 bp, Artificial sequence
  synthetic polynucleotide sequence
gcctctggggtaggcaca

SEQ ID NO: 236 - DNA, 18 bp, Artificial sequence
  synthetic polynucleotide sequence
ggccggtgacatagagga

SEQ ID NO: 237 - DNA, 18 bp, Artificial sequence
  synthetic polynucleotide sequence
cacccgaaggtgcaggaa

SEQ ID NO: 238 - DNA, 18 bp, Artificial sequence
  synthetic polynucleotide sequence
cagccgaatgcaggcaca

SEQ ID NO: 239 - DNA, 18 bp, Artificial sequence
  synthetic polynucleotide sequence
ggtgcacgaagatccgca

SEQ ID NO: 240 - DNA, 18 bp, Artificial sequence
  synthetic polynucleotide sequence
agcctatgcactccgaca

SEQ ID NO: 241 - DNA, 18 bp, Artificial sequence
  synthetic polynucleotide sequence
cttgggaaagtagaggca

SEQ ID NO: 242 - DNA, 18 bp, Artificial sequence
  synthetic polynucleotide sequence
ggggtccacggttcagga

SEQ ID NO: 243 - DNA, 18 bp, Artificial sequence
  synthetic polynucleotide sequence
ctgggaccgaaggacaca

SEQ ID NO: 244 - DNA, 18 bp, Artificial sequence
  synthetic polynucleotide sequence
tttccggaacagcagcca

SEQ ID NO: 245 - DNA, 18 bp, Artificial sequence
  synthetic polynucleotide sequence
aggacagcctgggcggaa

SEQ ID NO: 246 - DNA, 18 bp, Artificial sequence
  synthetic polynucleotide sequence
caagccaggggcacccca

SEQ ID NO: 247 - DNA, 18 bp, Artificial sequence
  synthetic polynucleotide sequence
gcctgcaaaggagaggga

SEQ ID NO: 248 - DNA, 18 bp, Artificial sequence
  synthetic polynucleotide sequence
ccagtgtgaagccagcca

SEQ ID NO: 249 - DNA, 18 bp, Artificial sequence
  synthetic polynucleotide sequence
gcccaaggatcaggagga

SEQ ID NO: 250 - DNA, 18 bp, Artificial sequence
  synthetic polynucleotide sequence
tccccagtaggtggcaca

SEQ ID NO: 251 - DNA, 18 bp, Artificial sequence
  synthetic polynucleotide sequence
cactctccaagtacccca

SEQ ID NO: 252 - DNA, 18 bp, Artificial sequence
  synthetic polynucleotide sequence
ggttccccagcactcaca

SEQ ID NO: 253 - DNA, 18 bp, Artificial sequence
  synthetic polynucleotide sequence
ggcatctgcatcgcacca

SEQ ID NO: 254 - DNA, 18 bp, Artificial sequence
  synthetic polynucleotide sequence
aggcctgggagatgcaca

SEQ ID NO: 255 - DNA, 18 bp, Artificial sequence
  synthetic polynucleotide sequence
ccacaccttcagccccaa

SEQ ID NO: 256 - DNA, 18 bp, Artificial sequence
  synthetic polynucleotide sequence
ggtgtggcaatggggcca

SEQ ID NO: 257 - DNA, 18 bp, Artificial sequence
  synthetic polynucleotide sequence
ctgggatcgctgaccgca

SEQ ID NO: 258 - DNA, 18 bp, Artificial sequence
  synthetic polynucleotide sequence
aggtggacagcgaggcca

SEQ ID NO: 259 - DNA, 18 bp, Artificial sequence
  synthetic polynucleotide sequence
gagaccctgttccagcca

SEQ ID NO: 260 - DNA, 18 bp, Artificial sequence
  synthetic polynucleotide sequence
gtgccccctgataggaca

SEQ ID NO: 261 - DNA, 18 bp, Artificial sequence
  synthetic polynucleotide sequence
gagaatgagatggccaca

SEQ ID NO: 262 - DNA, 18 bp, Artificial sequence
  synthetic polynucleotide sequence
gtgtctcaggacagcgga

SEQ ID NO: 263 - DNA, 18 bp, Artificial sequence
  synthetic polynucleotide sequence
gaccacagctgagagaga

SEQ ID NO: 264 - DNA, 18 bp, Artificial sequence
  synthetic polynucleotide sequence
gaagagggtctcagggca

SEQ ID NO: 265 - DNA, 18 bp, Artificial sequence
  synthetic polynucleotide sequence
cgggcttcaaggaggaga

SEQ ID NO: 266 - DNA, 18 bp, Artificial sequence
  synthetic polynucleotide sequence
tctcaggagcggcagcca

SEQ ID NO: 267 - DNA, 18 bp, Artificial sequence
  synthetic polynucleotide sequence
tgatcagctggagggcga

SEQ ID NO: 268 - DNA, 18 bp, Artificial sequence
  synthetic polynucleotide sequence
tggcatcccgggtcagga

SEQ ID NO: 269 - DNA, 18 bp, Artificial sequence
  synthetic polynucleotide sequence
gccatacatcctggcgga

SEQ ID NO: 270 - DNA, 18 bp, Artificial sequence
  synthetic polynucleotide sequence
ctccccgtagagtgcgga

SEQ ID NO: 271 - DNA, 18 bp, Artificial sequence
  synthetic polynucleotide sequence
tgggctacggcagcagga

SEQ ID NO: 272 - DNA, 18 bp, Artificial sequence
  synthetic polynucleotide sequence
gctcccagcccacgcgga

SEQ ID NO: 273 - DNA, 18 bp, Artificial sequence
  synthetic polynucleotide sequence
tcatgtcgcgggagacca

SEQ ID NO: 274 - DNA, 18 bp, Artificial sequence
  synthetic polynucleotide sequence
ggccctggtatggcgcca

SEQ ID NO: 275 - DNA, 18 bp, Artificial sequence
  synthetic polynucleotide sequence
ctcctatgaacccaacca

SEQ ID NO: 276 - DNA, 18 bp, Artificial sequence
  synthetic polynucleotide sequence
ccctcccagcaatatcca

SEQ ID NO: 277 - DNA, 18 bp, Artificial sequence
  synthetic polynucleotide sequence
aacggacgttgaccggta

SEQ ID NO: 278 - DNA, 18 bp, Artificial sequence
  synthetic polynucleotide sequence
acatacccttcagccaca

SEQ ID NO: 279 - DNA, 18 bp, Artificial sequence
  synthetic polynucleotide sequence
agccattgcccatcgaga

SEQ ID NO: 280 - DNA, 18 bp, Artificial sequence
  synthetic polynucleotide sequence
ttggtgcccacacgggga

SEQ ID NO: 281 - DNA, 18 bp, Artificial sequence
  synthetic polynucleotide sequence
ggttcagggaagcagaga

SEQ ID NO: 282 - DNA, 18 bp, Artificial sequence
  synthetic polynucleotide sequence
gccagcccactagcagca

SEQ ID NO: 283 - DNA, 18 bp, Artificial sequence
  synthetic polynucleotide sequence
gacggtcatgctgcgaca

SEQ ID NO: 284 - DNA, 18 bp, Artificial sequence
  synthetic polynucleotide sequence
tgaaggtgtgccagacca

SEQ ID NO: 285 - DNA, 18 bp, Artificial sequence
  synthetic polynucleotide sequence
tacacctaagccacccta

SEQ ID NO: 286 - DNA, 18 bp, Artificial sequence
  synthetic polynucleotide sequence
gtacaggagggtaggcca

SEQ ID NO: 287 - DNA, 18 bp, Artificial sequence
  synthetic polynucleotide sequence
ggacaggtaggcacgaga

SEQ ID NO: 288 - DNA, 18 bp, Artificial sequence
  synthetic polynucleotide sequence
tgcagccttgcagcgaga

SEQ ID NO: 289 - DNA, 18 bp, Artificial sequence
  synthetic polynucleotide sequence
acaacccgagagtgggca

SEQ ID NO: 290 - DNA, 18 bp, Artificial sequence
  synthetic polynucleotide sequence
gggtcattgggcaccaca

SEQ ID NO: 291 - DNA, 20 bp, Artificial sequence
  synthetic polynucleotide sequence
ggggtgtttttccgtaagca

SEQ ID NO: 292 - DNA, 18 bp, Artificial sequence
  synthetic polynucleotide sequence
cgcaccttggagatggga

SEQ ID NO: 293 - DNA, 18 bp, Artificial sequence
  synthetic polynucleotide sequence
cgtgacaggccaagtgca

SEQ ID NO: 294 - DNA, 18 bp, Artificial sequence
  synthetic polynucleotide sequence
cgagaactagggcttcca

SEQ ID NO: 295 - DNA, 18 bp, Artificial sequence
  synthetic polynucleotide sequence
ccagatgaccaaacggga

SEQ ID NO: 296 - DNA, 18 bp, Artificial sequence
  synthetic polynucleotide sequence
cagaggctgaaggtggca

SEQ ID NO: 297 - DNA, 18 bp, Artificial sequence
  synthetic polynucleotide sequence
gcctaaaggatcagccca

SEQ ID NO: 298 - DNA, 18 bp, Artificial sequence
  synthetic polynucleotide sequence
ctccctgtacaccaagca

SEQ ID NO: 299 - DNA, 18 bp, Artificial sequence
  synthetic polynucleotide sequence
gcaaactgaaacctggga

SEQ ID NO: 300 - DNA, 18 bp, Artificial sequence
  synthetic polynucleotide sequence
ctgggcagagagctgtga

SEQ ID NO: 301 - DNA, 18 bp, Artificial sequence
  synthetic polynucleotide sequence
ctaccaccagggcaagga

SEQ ID NO: 302 - DNA, 18 bp, Artificial sequence
  synthetic polynucleotide sequence
agcgatggtccaggcaca

SEQ ID NO: 303 - DNA, 18 bp, Artificial sequence
  synthetic polynucleotide sequence
ccgccagattcctaccca

SEQ ID NO: 304 - DNA, 18 bp, Artificial sequence
  synthetic polynucleotide sequence
ggtggaggggaggaagca

SEQ ID NO: 305 - DNA, 18 bp, Artificial sequence
  synthetic polynucleotide sequence
accagctccctgaccaca

SEQ ID NO: 306 - DNA, 18 bp, Artificial sequence
  synthetic polynucleotide sequence
ccgttcagagggaccaga

SEQ ID NO: 307 - DNA, 18 bp, Artificial sequence
  synthetic polynucleotide sequence
ctgcgagagggaacagca

SEQ ID NO: 308 - DNA, 18 bp, Artificial sequence
  synthetic polynucleotide sequence
cagcatcgacatagggca

SEQ ID NO: 309 - DNA, 18 bp, Artificial sequence
  synthetic polynucleotide sequence
accttgtgaacggaagga

SEQ ID NO: 310 - DNA, 18 bp, Artificial sequence
  synthetic polynucleotide sequence
ggaccacacatggtgcca

SEQ ID NO: 311 - DNA, 18 bp, Artificial sequence
  synthetic polynucleotide sequence
ccgcccttctgcaacaca

SEQ ID NO: 312 - DNA, 18 bp, Artificial sequence
  synthetic polynucleotide sequence
gcctcagcttggaaggga

SEQ ID NO: 313 - DNA, 18 bp, Artificial sequence
  synthetic polynucleotide sequence
aaatgccagtgctcagga

SEQ ID NO: 314 - DNA, 18 bp, Artificial sequence
  synthetic polynucleotide sequence
ggatctaagcgaggctga

SEQ ID NO: 315 - DNA, 18 bp, Artificial sequence
  synthetic polynucleotide sequence
tcgtggagcgccagagca

SEQ ID NO: 316 - DNA, 18 bp, Artificial sequence
  synthetic polynucleotide sequence
tcgagcgcgtcgtgccga

SEQ ID NO: 317 - DNA, 18 bp, Artificial sequence
  synthetic polynucleotide sequence
ctgcgggaaggatggaga

SEQ ID NO: 318 - DNA, 18 bp, Artificial sequence
  synthetic polynucleotide sequence
cacatcatagacgggcca

SEQ ID NO: 319 - DNA, 18 bp, Artificial sequence
  synthetic polynucleotide sequence
tgccctacctgccaccaa

SEQ ID NO: 320 - DNA, 18 bp, Artificial sequence
  synthetic polynucleotide sequence
ccataccaactaaggcca

SEQ ID NO: 321 - DNA, 18 bp, Artificial sequence
  synthetic polynucleotide sequence
gagctgtcatgaccgcaa

SEQ ID NO: 322 - DNA, 18 bp, Artificial sequence
  synthetic polynucleotide sequence
gtcattgaagcgagccca

SEQ ID NO: 323 - DNA, 18 bp, Artificial sequence
  synthetic polynucleotide sequence
gaaaccagtctgtggcaa

SEQ ID NO: 324 - DNA, 18 bp, Artificial sequence
  synthetic polynucleotide sequence
caacagcttgcaggtcca

SEQ ID NO: 325 - DNA, 18 bp, Artificial sequence
  synthetic polynucleotide sequence
gcagggtccatatgcaga

SEQ ID NO: 326 - DNA, 18 bp, Artificial sequence
  synthetic polynucleotide sequence
cttaggacaggcaggcga

SEQ ID NO: 327 - DNA, 18 bp, Artificial sequence
  synthetic polynucleotide sequence
acccttgctgcgaaggaa

SEQ ID NO: 328 - DNA, 18 bp, Artificial sequence
  synthetic polynucleotide sequence
cctcctggaaggaaccga

SEQ ID NO: 329 - DNA, 18 bp, Artificial sequence
  synthetic polynucleotide sequence
gtcacatgagctgggcca

SEQ ID NO: 330 - DNA, 18 bp, Artificial sequence
  synthetic polynucleotide sequence
agggcttcacagcagaga

SEQ ID NO: 331 - DNA, 18 bp, Artificial sequence
  synthetic polynucleotide sequence
aagccagccagcaccaga

SEQ ID NO: 332 - DNA, 18 bp, Artificial sequence
  synthetic polynucleotide sequence
cccctccatcatgggaca

SEQ ID NO: 333 - DNA, 18 bp, Artificial sequence
  synthetic polynucleotide sequence
cctgaagggagaccagga

SEQ ID NO: 334 - DNA, 18 bp, Artificial sequence
  synthetic polynucleotide sequence
tggtcccagctagaggca

SEQ ID NO: 335 - DNA, 18 bp, Artificial sequence
  synthetic polynucleotide sequence
gcaacaaccccgagccaa

SEQ ID NO: 336 - DNA, 18 bp, Artificial sequence
  synthetic polynucleotide sequence
aggggtggacgttgcaca

SEQ ID NO: 337 - DNA, 18 bp, Artificial sequence
  synthetic polynucleotide sequence
ggaggacgatggtgagga

SEQ ID NO: 338 - DNA, 18 bp, Artificial sequence
  synthetic polynucleotide sequence
ctagcagtgccaaggcca

SEQ ID NO: 339 - DNA, 18 bp, Artificial sequence
  synthetic polynucleotide sequence
gcagacgagaccaccaca

SEQ ID NO: 340 - DNA, 18 bp, Artificial sequence
  synthetic polynucleotide sequence
actcctccgtcacccaca

SEQ ID NO: 341 - DNA, 18 bp, Artificial sequence
  synthetic polynucleotide sequence
cggaaagagcttccggga

SEQ ID NO: 342 - DNA, 18 bp, Artificial sequence
  synthetic polynucleotide sequence
gccttggacacagacgga

SEQ ID NO: 343 - DNA, 18 bp, Artificial sequence
  synthetic polynucleotide sequence
gcaccaccacaccaacca

SEQ ID NO: 344 - DNA, 18 bp, Artificial sequence
  synthetic polynucleotide sequence
ctgagggcattgcgcaca

SEQ ID NO: 345 - DNA, 18 bp, Artificial sequence
  synthetic polynucleotide sequence
gcgtgtaccagctgcaga

SEQ ID NO: 346 - DNA, 18 bp, Artificial sequence
  synthetic polynucleotide sequence
ggcagagcactgtgacca

SEQ ID NO: 347 - DNA, 18 bp, Artificial sequence
  synthetic polynucleotide sequence
cagacctgagctgcagga

SEQ ID NO: 348 - DNA, 18 bp, Artificial sequence
  synthetic polynucleotide sequence
cgctccacgaagaagcga

SEQ ID NO: 349 - DNA, 18 bp, Artificial sequence
  synthetic polynucleotide sequence
cctgcagcatacaggcca

SEQ ID NO: 350 - DNA, 18 bp, Artificial sequence
  synthetic polynucleotide sequence
ccaccgcatgtcctgaca

SEQ ID NO: 351 - DNA, 18 bp, Artificial sequence
  synthetic polynucleotide sequence
cctccagcagaagccaga

SEQ ID NO: 352 - DNA, 18 bp, Artificial sequence
  synthetic polynucleotide sequence
tgcggaccggatggcaca

SEQ ID NO: 353 - DNA, 18 bp, Artificial sequence
  synthetic polynucleotide sequence
cgctcatgtggaggagga

SEQ ID NO: 354 - DNA, 18 bp, Artificial sequence
  synthetic polynucleotide sequence
gggcatgagactgcagga

SEQ ID NO: 355 - DNA, 18 bp, Artificial sequence
  synthetic polynucleotide sequence
gcctccatcaatgcagca

SEQ ID NO: 356 - DNA, 18 bp, Artificial sequence
  synthetic polynucleotide sequence
cttcagcaccagtgggca

SEQ ID NO: 357 - DNA, 18 bp, Artificial sequence
  synthetic polynucleotide sequence
cctgaacccaggacccaa

SEQ ID NO: 358 - DNA, 18 bp, Artificial sequence
  synthetic polynucleotide sequence
cggcgttcctgacaacca

SEQ ID NO: 359 - DNA, 18 bp, Artificial sequence
  synthetic polynucleotide sequence
tgagtgcaaggaccccga

SEQ ID NO: 360 - DNA, 18 bp, Artificial sequence
  synthetic polynucleotide sequence
ccccagcatacttgggga

SEQ ID NO: 361 - DNA, 18 bp, Artificial sequence
  synthetic polynucleotide sequence
gctaccctgcctagacca

SEQ ID NO: 362 - DNA, 18 bp, Artificial sequence
  synthetic polynucleotide sequence
cccacaggtcacagagca

SEQ ID NO: 363 - DNA, 18 bp, Artificial sequence
  synthetic polynucleotide sequence
gctgactgagagcaccca

SEQ ID NO: 364 - DNA, 18 bp, Artificial sequence
  synthetic polynucleotide sequence
tcccaggatccaggacca

SEQ ID NO: 365 - DNA, 18 bp, Artificial sequence
  synthetic polynucleotide sequence
ctcacaaggccaggacca

SEQ ID NO: 366 - DNA, 18 bp, Artificial sequence
  synthetic polynucleotide sequence
gcgcagaactcgtggaca

SEQ ID NO: 367 - DNA, 18 bp, Artificial sequence
  synthetic polynucleotide sequence
gccctgtaacatccggga

SEQ ID NO: 368 - DNA, 18 bp, Artificial sequence
  synthetic polynucleotide sequence
ggagacaccacctgcaca

SEQ ID NO: 369 - DNA, 18 bp, Artificial sequence
  synthetic polynucleotide sequence
gggaacctcactgaccga

SEQ ID NO: 370 - DNA, 18 bp, Artificial sequence
  synthetic polynucleotide sequence
gacccagggggatccaca

SEQ ID NO: 371 - DNA, 18 bp, Artificial sequence
  synthetic polynucleotide sequence
gtctacacccgagacaca

SEQ ID NO: 372 - DNA, 18 bp, Artificial sequence
  synthetic polynucleotide sequence
tgtagcgctcccgaggga

SEQ ID NO: 373 - DNA, 18 bp, Artificial sequence
  synthetic polynucleotide sequence
cctctcaaggtccccaga

SEQ ID NO: 374 - DNA, 18 bp, Artificial sequence
  synthetic polynucleotide sequence
agcaccggtggctcagca

SEQ ID NO: 375 - DNA, 18 bp, Artificial sequence
  synthetic polynucleotide sequence
ccgtgtacctgcagagca

SEQ ID NO: 376 - DNA, 18 bp, Artificial sequence
  synthetic polynucleotide sequence
cactcacgccgctgagga

SEQ ID NO: 377 - DNA, 18 bp, Artificial sequence
  synthetic polynucleotide sequence
cctcccccagatcagcca

SEQ ID NO: 378 - DNA, 18 bp, Artificial sequence
  synthetic polynucleotide sequence
cggcctcaatgccacgca

SEQ ID NO: 379 - DNA, 18 bp, Artificial sequence
  synthetic polynucleotide sequence
ggtcatggaagacgccca

SEQ ID NO: 380 - DNA, 18 bp, Artificial sequence
  synthetic polynucleotide sequence
cgagacggtgcctcagca

SEQ ID NO: 381 - DNA, 18 bp, Artificial sequence
  synthetic polynucleotide sequence
gcaggccccagtacgaca

SEQ ID NO: 382 - DNA, 18 bp, Artificial sequence
  synthetic polynucleotide sequence
aggggcaccttctcagca

SEQ ID NO: 383 - DNA, 18 bp, Artificial sequence
  synthetic polynucleotide sequence
agaacgacggagccccca

SEQ ID NO: 384 - DNA, 18 bp, Artificial sequence
  synthetic polynucleotide sequence
agtaccgggtcatgcgga

SEQ ID NO: 385 - DNA, 18 bp, Artificial sequence
  synthetic polynucleotide sequence
cgaggccttggtcaccaa

SEQ ID NO: 386 - DNA, 18 bp, Artificial sequence
  synthetic polynucleotide sequence
aagttgggcagggaggca

SEQ ID NO: 387 - DNA, 18 bp, Artificial sequence
  synthetic polynucleotide sequence
tgcggctgctcaacgaga

SEQ ID NO: 388 - DNA, 18 bp, Artificial sequence
  synthetic polynucleotide sequence
gcatggcgtagtcagcca

SEQ ID NO: 389 - DNA, 18 bp, Artificial sequence
  synthetic polynucleotide sequence
gcaacctcaccaagccca

SEQ ID NO: 390 - DNA, 18 bp, Artificial sequence
  synthetic polynucleotide sequence
taggcagtccaagcggca

SEQ ID NO: 391 - DNA, 18 bp, Artificial sequence
  synthetic polynucleotide sequence
ctcaggagctggtcagga

SEQ ID NO: 392 - DNA, 18 bp, Artificial sequence
  synthetic polynucleotide sequence
gggctcaggaagtccaga

SEQ ID NO: 393 - DNA, 18 bp, Artificial sequence
  synthetic polynucleotide sequence
cgagcagttctgccagga

SEQ ID NO: 394 - DNA, 18 bp, Artificial sequence
  synthetic polynucleotide sequence
acctcctcatgcccagga

SEQ ID NO: 395 - DNA, 18 bp, Artificial sequence
  synthetic polynucleotide sequence
gagatgtcgcccacggga

SEQ ID NO: 396 - DNA, 18 bp, Artificial sequence
  synthetic polynucleotide sequence
gggccacgagcgactgca

SEQ ID NO: 397 - DNA, 18 bp, Artificial sequence
  synthetic polynucleotide sequence
gaggcaatgagtccagca

SEQ ID NO: 398 - DNA, 18 bp, Artificial sequence
  synthetic polynucleotide sequence
agccctggaaggagccca

SEQ ID NO: 399 - DNA, 18 bp, Artificial sequence
  synthetic polynucleotide sequence
cgacgaagcttccgagga

SEQ ID NO: 400 - DNA, 18 bp, Artificial sequence
  synthetic polynucleotide sequence
tggcacgcagacaccgga

SEQ ID NO: 401 - DNA, 18 bp, Artificial sequence
  synthetic polynucleotide sequence
ccgaagcccgtctacaga

SEQ ID NO: 402 - DNA, 18 bp, Artificial sequence
  synthetic polynucleotide sequence
ggctgaaggggttgggca

SEQ ID NO: 403 - DNA, 18 bp, Artificial sequence
  synthetic polynucleotide sequence
gagagaagcctaggcaca

SEQ ID NO: 404 - DNA, 18 bp, Artificial sequence
  synthetic polynucleotide sequence
tgagaggagagagtggca

SEQ ID NO: 405 - DNA, 18 bp, Artificial sequence
  synthetic polynucleotide sequence
tcatcgggcagacccaga

SEQ ID NO: 406 - DNA, 18 bp, Artificial sequence
  synthetic polynucleotide sequence
agaggaagcgcttgcgga

SEQ ID NO: 407 - DNA, 18 bp, Artificial sequence
  synthetic polynucleotide sequence
tggccatgctagccacca

SEQ ID NO: 408 - DNA, 18 bp, Artificial sequence
  synthetic polynucleotide sequence
cccagcagtgtcagcaca

SEQ ID NO: 409 - DNA, 18 bp, Artificial sequence
  synthetic polynucleotide sequence
cccatccaggaggtgcta

SEQ ID NO: 410 - DNA, 18 bp, Artificial sequence
  synthetic polynucleotide sequence
ggtacccctacgatgaca

SEQ ID NO: 411 - DNA, 18 bp, Artificial sequence
  synthetic polynucleotide sequence
catgtggcacaagcgtca

SEQ ID NO: 412 - DNA, 18 bp, Artificial sequence
  synthetic polynucleotide sequence
gtccagtcagtagcagca

SEQ ID NO: 413 - DNA, 18 bp, Artificial sequence
  synthetic polynucleotide sequence
agccctgggagccactga

SEQ ID NO: 414 - DNA, 18 bp, Artificial sequence
  synthetic polynucleotide sequence
cctgcacagtcaagggca

SEQ ID NO: 415 - DNA, 18 bp, Artificial sequence
  synthetic polynucleotide sequence
acaagggctggggcgtca

SEQ ID NO: 416 - DNA, 18 bp, Artificial sequence
  synthetic polynucleotide sequence
accagctggaatggacga

SEQ ID NO: 417 - DNA, 18 bp, Artificial sequence
  synthetic polynucleotide sequence
gggcaaaccagtccacca

SEQ ID NO: 418 - DNA, 18 bp, Artificial sequence
  synthetic polynucleotide sequence
cagctgacttacagccca

SEQ ID NO: 419 - DNA, 18 bp, Artificial sequence
  synthetic polynucleotide sequence
ccaggccgtgatggcaga

SEQ ID NO: 420 - DNA, 18 bp, Artificial sequence
  synthetic polynucleotide sequence
cccggaaagcctcgggga

SEQ ID NO: 421 - DNA, 18 bp, Artificial sequence
  synthetic polynucleotide sequence
tactgctccccacagcca

SEQ ID NO: 422 - DNA, 18 bp, Artificial sequence
  synthetic polynucleotide sequence
acgacgccactcaagcca

SEQ ID NO: 423 - DNA, 18 bp, Artificial sequence
  synthetic polynucleotide sequence
gcctaggcctgagtggaa

SEQ ID NO: 424 - DNA, 18 bp, Artificial sequence
  synthetic polynucleotide sequence
agaggctggccatcagca

SEQ ID NO: 425 - DNA, 18 bp, Artificial sequence
  synthetic polynucleotide sequence
catccgagtcaagcgcta

SEQ ID NO: 426 - DNA, 18 bp, Artificial sequence
  synthetic polynucleotide sequence
gcacgtcccgaagcggca

SEQ ID NO: 427 - DNA, 18 bp, Artificial sequence
  synthetic polynucleotide sequence
aggcaccccgcaccccga

SEQ ID NO: 428 - DNA, 18 bp, Artificial sequence
  synthetic polynucleotide sequence
gcacacagcccactcgca

SEQ ID NO: 429 - DNA, 18 bp, Artificial sequence
  synthetic polynucleotide sequence
ccaagtcgctggccctca

SEQ ID NO: 430 - DNA, 18 bp, Artificial sequence
  synthetic polynucleotide sequence
cttgtggcaggacgggca

SEQ ID NO: 431 - DNA, 18 bp, Artificial sequence
  synthetic polynucleotide sequence
gcgacgacagctgaagca

SEQ ID NO: 432 - DNA, 18 bp, Artificial sequence
  synthetic polynucleotide sequence
gatgtgtaggggcagcca

SEQ ID NO: 433 - DNA, 18 bp, Artificial sequence
  synthetic polynucleotide sequence
ctgggatggaaccacgaa

SEQ ID NO: 434 - DNA, 18 bp, Artificial sequence
  synthetic polynucleotide sequence
gaagctgcctgcaggcca

SEQ ID NO: 435 - DNA, 18 bp, Artificial sequence
  synthetic polynucleotide sequence
gcacatgatggagggaca

SEQ ID NO: 436 - DNA, 18 bp, Artificial sequence
  synthetic polynucleotide sequence
aggaacaccgttccagga

SEQ ID NO: 437 - DNA, 18 bp, Artificial sequence
  synthetic polynucleotide sequence
tcggtgaccagggaggaa

SEQ ID NO: 438 - DNA, 18 bp, Artificial sequence
  synthetic polynucleotide sequence
catgcagcgtaggaagca

SEQ ID NO: 439 - DNA, 18 bp, Artificial sequence
  synthetic polynucleotide sequence
cgccaagaccaagacgca

SEQ ID NO: 440 - DNA, 18 bp, Artificial sequence
  synthetic polynucleotide sequence
aaggcagccagcagagga

SEQ ID NO: 441 - DNA, 18 bp, Artificial sequence
  synthetic polynucleotide sequence
ccaaggccaagggccaca

SEQ ID NO: 442 - DNA, 18 bp, Artificial sequence
  synthetic polynucleotide sequence
agccaagcggtagagcga

SEQ ID NO: 443 - DNA, 18 bp, Artificial sequence
  synthetic polynucleotide sequence
cgttccggagacccacga

SEQ ID NO: 444 - DNA, 18 bp, Artificial sequence
  synthetic polynucleotide sequence
gtgtgggacgcctaggga

SEQ ID NO: 445 - DNA, 18 bp, Artificial sequence
  synthetic polynucleotide sequence
ggtgctccgtgccacgca

SEQ ID NO: 446 - DNA, 18 bp, Artificial sequence
  synthetic polynucleotide sequence
tcttgaaggcgcggcgga

SEQ ID NO: 447 - DNA, 18 bp, Artificial sequence
  synthetic polynucleotide sequence
gcactgcaaggtgcccca

SEQ ID NO: 448 - DNA, 18 bp, Artificial sequence
  synthetic polynucleotide sequence
aggatcctccggaaggca

SEQ ID NO: 449 - DNA, 18 bp, Artificial sequence
  synthetic polynucleotide sequence
catcagcctggaccgcta

SEQ ID NO: 450 - DNA, 18 bp, Artificial sequence
  synthetic polynucleotide sequence
gacggccgagatgagcca

SEQ ID NO: 451 - DNA, 18 bp, Artificial sequence
  synthetic polynucleotide sequence
gaaggccttccaccgcga

SEQ ID NO: 452 - DNA, 18 bp, Artificial sequence
  synthetic polynucleotide sequence
gatggggttgaaggccga

SEQ ID NO: 453 - DNA, 18 bp, Artificial sequence
  synthetic polynucleotide sequence
ccacccaccaggaagcca

SEQ ID NO: 454 - DNA, 18 bp, Artificial sequence
  synthetic polynucleotide sequence
agaccctggagtagacga

SEQ ID NO: 455 - DNA, 18 bp, Artificial sequence
  synthetic polynucleotide sequence
ccggcagcacaagaccaa

SEQ ID NO: 456 - DNA, 18 bp, Artificial sequence
  synthetic polynucleotide sequence
catctgccagtccaggga

SEQ ID NO: 457 - DNA, 18 bp, Artificial sequence
  synthetic polynucleotide sequence
taccctgacctcgcccca

SEQ ID NO: 458 - DNA, 18 bp, Artificial sequence
  synthetic polynucleotide sequence
aggcagaccgaactggca

SEQ ID NO: 459 - DNA, 18 bp, Artificial sequence
  synthetic polynucleotide sequence
ccactggcactcaggcca

SEQ ID NO: 460 - DNA, 18 bp, Artificial sequence
  synthetic polynucleotide sequence
gtgcactgatgcccccaa

SEQ ID NO: 461 - DNA, 18 bp, Artificial sequence
  synthetic polynucleotide sequence
tccccattgccaacgcca

SEQ ID NO: 462 - DNA, 18 bp, Artificial sequence
  synthetic polynucleotide sequence
tccagttggagcgagcca

SEQ ID NO: 463 - DNA, 18 bp, Artificial sequence
  synthetic polynucleotide sequence
gatccaggtgggccagca

SEQ ID NO: 464 - DNA, 18 bp, Artificial sequence
  synthetic polynucleotide sequence
cctcggggcaggtccaga

SEQ ID NO: 465 - DNA, 18 bp, Artificial sequence
  synthetic polynucleotide sequence
agccacccctgttgcaga

SEQ ID NO: 466 - DNA, 18 bp, Artificial sequence
  synthetic polynucleotide sequence
gcaggacaacgtcgggga

SEQ ID NO: 467 - DNA, 18 bp, Artificial sequence
  synthetic polynucleotide sequence
tcagcaccccagtcacca

SEQ ID NO: 468 - DNA, 18 bp, Artificial sequence
  synthetic polynucleotide sequence
tgagggccaaggtgcaca

SEQ ID NO: 469 - DNA, 18 bp, Artificial sequence
  synthetic polynucleotide sequence
cccagcgcattcaccaca

SEQ ID NO: 470 - DNA, 18 bp, Artificial sequence
  synthetic polynucleotide sequence
cccatcagcgtgtccaga

SEQ ID NO: 471 - DNA, 18 bp, Artificial sequence
  synthetic polynucleotide sequence
gggccagtggaaagagca

SEQ ID NO: 472 - DNA, 18 bp, Artificial sequence
  synthetic polynucleotide sequence
gacgatggtcgacgggga

SEQ ID NO: 473 - DNA, 18 bp, Artificial sequence
  synthetic polynucleotide sequence
gacgagtggcagcagcaa

SEQ ID NO: 474 - DNA, 18 bp, Artificial sequence
  synthetic polynucleotide sequence
tggaggacagttagagga

SEQ ID NO: 475 - DNA, 18 bp, Artificial sequence
  synthetic polynucleotide sequence
cgctgctagctaaggcca

SEQ ID NO: 476 - DNA, 18 bp, Artificial sequence
  synthetic polynucleotide sequence
ggactctagcagggccca

SEQ ID NO: 477 - DNA, 18 bp, Artificial sequence
  synthetic polynucleotide sequence
ggggctgccacaaaagca

SEQ ID NO: 478 - DNA, 18 bp, Artificial sequence
  synthetic polynucleotide sequence
cgggatccagggtaggga

SEQ ID NO: 479 - DNA, 18 bp, Artificial sequence
  synthetic polynucleotide sequence
tatgccaacaggaggcca

SEQ ID NO: 480 - DNA, 18 bp, Artificial sequence
  synthetic polynucleotide sequence
caccctgagcttggcaca

SEQ ID NO: 481 - DNA, 18 bp, Artificial sequence
  synthetic polynucleotide sequence
ggagagtcagccaccaca

SEQ ID NO: 482 - DNA, 18 bp, Artificial sequence
  synthetic polynucleotide sequence
ggctggcaattccgagca

SEQ ID NO: 483 - DNA, 18 bp, Artificial sequence
  synthetic polynucleotide sequence
gctggattgagcacccca

SEQ ID NO: 484 - DNA, 18 bp, Artificial sequence
  synthetic polynucleotide sequence
tcggagtcactaccccga

SEQ ID NO: 485 - DNA, 18 bp, Artificial sequence
  synthetic polynucleotide sequence
ggccacccattccagcca

SEQ ID NO: 486 - DNA, 18 bp, Artificial sequence
  synthetic polynucleotide sequence
agccctgatcctcccaca

SEQ ID NO: 487 - DNA, 18 bp, Artificial sequence
  synthetic polynucleotide sequence
ccagtagcacaagcagca

SEQ ID NO: 488 - DNA, 18 bp, Artificial sequence
  synthetic polynucleotide sequence
acgacctacaactgggga

SEQ ID NO: 489 - DNA, 18 bp, Artificial sequence
  synthetic polynucleotide sequence
agggcaggttagagccca

SEQ ID NO: 490 - DNA, 18 bp, Artificial sequence
  synthetic polynucleotide sequence
tgaacagatgcaggagca

SEQ ID NO: 491 - DNA, 18 bp, Artificial sequence
  synthetic polynucleotide sequence
ctgggcacaaccacagga

SEQ ID NO: 492 - DNA, 18 bp, Artificial sequence
  synthetic polynucleotide sequence
caatggtggacagctgca

SEQ ID NO: 493 - DNA, 18 bp, Artificial sequence
  synthetic polynucleotide sequence
ggaatgctggtccccaga

SEQ ID NO: 494 - DNA, 18 bp, Artificial sequence
  synthetic polynucleotide sequence
aggcccacaatttccaca

SEQ ID NO: 495 - DNA, 18 bp, Artificial sequence
  synthetic polynucleotide sequence
gcgccagggacagggaca

SEQ ID NO: 496 - DNA, 18 bp, Artificial sequence
  synthetic polynucleotide sequence
acagcaggttagccgcca

SEQ ID NO: 497 - DNA, 18 bp, Artificial sequence
  synthetic polynucleotide sequence
gcggaagtgggaggagga

SEQ ID NO: 498 - DNA, 18 bp, Artificial sequence
  synthetic polynucleotide sequence
tcccctcgcagtacagga

SEQ ID NO: 499 - DNA, 18 bp, Artificial sequence
  synthetic polynucleotide sequence
cgggcaccttcccagaga

SEQ ID NO: 500 - DNA, 18 bp, Artificial sequence
  synthetic polynucleotide sequence
ccatcgaactcccacgga

SEQ ID NO: 501 - DNA, 18 bp, Artificial sequence
  synthetic polynucleotide sequence
gcctcccatgactagaga

SEQ ID NO: 502 - DNA, 18 bp, Artificial sequence
  synthetic polynucleotide sequence
tcccacagcaggtccaca

SEQ ID NO: 503 - DNA, 18 bp, Artificial sequence
  synthetic polynucleotide sequence
gagtgggcaagttacgga

SEQ ID NO: 504 - DNA, 18 bp, Artificial sequence
  synthetic polynucleotide sequence
acagacttcagcatccca

SEQ ID NO: 505 - DNA, 18 bp, Artificial sequence
  synthetic polynucleotide sequence
ctggccagagataccaca

SEQ ID NO: 506 - DNA, 18 bp, Artificial sequence
  synthetic polynucleotide sequence
tggagagggtctggggca

SEQ ID NO: 507 - DNA, 19 bp, Artificial sequence
  synthetic polynucleotide sequence
caacaagagcactggccaa

SEQ ID NO: 508 - DNA, 17 bp, Artificial sequence
  synthetic polynucleotide sequence
gcaatggcaaggttgga

SEQ ID NO: 509 - DNA, 18 bp, Artificial sequence
  synthetic polynucleotide sequence
gggtctcactggagcgaa

SEQ ID NO: 510 - DNA, 18 bp, Artificial sequence
  synthetic polynucleotide sequence
atggcaccgtcgaagcca

SEQ ID NO: 511 - DNA, 18 bp, Artificial sequence
  synthetic polynucleotide sequence
agacctgcaggaccgcga

SEQ ID NO: 512 - DNA, 18 bp, Artificial sequence
  synthetic polynucleotide sequence
cggcagtagcagaaggca

SEQ ID NO: 513 - DNA, 18 bp, Artificial sequence
  synthetic polynucleotide sequence
gcccacagagtctaccca

SEQ ID NO: 514 - DNA, 18 bp, Artificial sequence
  synthetic polynucleotide sequence
cccaggaagtgcagggca

SEQ ID NO: 515 - DNA, 18 bp, Artificial sequence
  synthetic polynucleotide sequence
ccaacactccatgaccca

SEQ ID NO: 516 - DNA, 18 bp, Artificial sequence
  synthetic polynucleotide sequence
ggaggcggaatgtgacca

SEQ ID NO: 517 - DNA, 17 bp, Artificial sequence
  synthetic polynucleotide sequence
cccgccttcgacgcaca

SEQ ID NO: 518 - DNA, 18 bp, Artificial sequence
  synthetic polynucleotide sequence
ggcccagccctatcggga

SEQ ID NO: 519 - DNA, 18 bp, Artificial sequence
  synthetic polynucleotide sequence
acatcgtgcacatcagca

SEQ ID NO: 520 - DNA, 18 bp, Artificial sequence
  synthetic polynucleotide sequence
aaccagtgtggaccagga

SEQ ID NO: 521 - DNA, 18 bp, Artificial sequence
  synthetic polynucleotide sequence
ggcttcccacagtcacca

SEQ ID NO: 522 - DNA, 18 bp, Artificial sequence
  synthetic polynucleotide sequence
tccgtcacgcggtccaca

SEQ ID NO: 523 - DNA, 18 bp, Artificial sequence
  synthetic polynucleotide sequence
gccacaaggacaccagca

SEQ ID NO: 524 - DNA, 18 bp, Artificial sequence
  synthetic polynucleotide sequence
tgtccaggctgaagcaca

SEQ ID NO: 525 - DNA, 18 bp, Artificial sequence
  synthetic polynucleotide sequence
agggaagtggaatcccga

SEQ ID NO: 526 - DNA, 18 bp, Artificial sequence
  synthetic polynucleotide sequence
gcatgcagactagcagga

SEQ ID NO: 527 - DNA, 18 bp, Artificial sequence
  synthetic polynucleotide sequence
ggcagtggctgaagccca

SEQ ID NO: 528 - DNA, 18 bp, Artificial sequence
  synthetic polynucleotide sequence
gaaggggccatcacagga

SEQ ID NO: 529 - DNA, 18 bp, Artificial sequence
  synthetic polynucleotide sequence
gaactgacctgggagcga

SEQ ID NO: 530 - DNA, 18 bp, Artificial sequence
  synthetic polynucleotide sequence
tagcgaccctcaggagca

SEQ ID NO: 531 - DNA, 18 bp, Artificial sequence
  synthetic polynucleotide sequence
ccccaaatcactgggcca

SEQ ID NO: 532 - DNA, 18 bp, Artificial sequence
  synthetic polynucleotide sequence
acttccacactggggcca

SEQ ID NO: 533 - DNA, 18 bp, Artificial sequence
  synthetic polynucleotide sequence
gtccctagccgacaagga

SEQ ID NO: 534 - DNA, 18 bp, Artificial sequence
  synthetic polynucleotide sequence
ccaccttcagcgcagaca

SEQ ID NO: 535 - DNA, 18 bp, Artificial sequence
  synthetic polynucleotide sequence
aaccatccccatacccca

SEQ ID NO: 536 - DNA, 18 bp, Artificial sequence
  synthetic polynucleotide sequence
ggcactgatacatcgaca

SEQ ID NO: 537 - DNA, 18 bp, Artificial sequence
  synthetic polynucleotide sequence
agctggctcacccccaga

SEQ ID NO: 538 - DNA, 18 bp, Artificial sequence
  synthetic polynucleotide sequence
ctcctgagggtgacccca

SEQ ID NO: 539 - DNA, 18 bp, Artificial sequence
  synthetic polynucleotide sequence
gctgaacactctggccaa

SEQ ID NO: 540 - DNA, 18 bp, Artificial sequence
  synthetic polynucleotide sequence
gcggtgggtgactcggga

SEQ ID NO: 541 - DNA, 18 bp, Artificial sequence
  synthetic polynucleotide sequence
caataagaacggctgcca

SEQ ID NO: 542 - DNA, 18 bp, Artificial sequence
  synthetic polynucleotide sequence
tcgggcacagtcgtagca

SEQ ID NO: 543 - DNA, 18 bp, Artificial sequence
  synthetic polynucleotide sequence
gcaggaagagaggctgga

SEQ ID NO: 544 - DNA, 18 bp, Artificial sequence
  synthetic polynucleotide sequence
ccccggagccactggaca

SEQ ID NO: 545 - DNA, 18 bp, Artificial sequence
  synthetic polynucleotide sequence
tccccgaatacctcagca

SEQ ID NO: 546 - DNA, 18 bp, Artificial sequence
  synthetic polynucleotide sequence
cattgggctccaggccca

SEQ ID NO: 547 - DNA, 18 bp, Artificial sequence
  synthetic polynucleotide sequence
ggtggagggccacagcaa

SEQ ID NO: 548 - DNA, 18 bp, Artificial sequence
  synthetic polynucleotide sequence
agaggccgctgcttcaca

SEQ ID NO: 549 - DNA, 18 bp, Artificial sequence
  synthetic polynucleotide sequence
cacaggcttcctgaggca

SEQ ID NO: 550 - DNA, 18 bp, Artificial sequence
  synthetic polynucleotide sequence
agggggaaggtgacagca

SEQ ID NO: 551 - DNA, 18 bp, Artificial sequence
  synthetic polynucleotide sequence
gcagcggacttaccgcca

SEQ ID NO: 552 - DNA, 18 bp, Artificial sequence
  synthetic polynucleotide sequence
gggtacacccacatgcca

SEQ ID NO: 553 - DNA, 18 bp, Artificial sequence
  synthetic polynucleotide sequence
ctggcccaaggagacgaa

SEQ ID NO: 554 - DNA, 18 bp, Artificial sequence
  synthetic polynucleotide sequence
cgggcatcccattgcaga

SEQ ID NO: 555 - DNA, 18 bp, Artificial sequence
  synthetic polynucleotide sequence
aagaaggcaagcaggaga

SEQ ID NO: 556 - DNA, 18 bp, Artificial sequence
  synthetic polynucleotide sequence
aacacacgtgaggcgcta

SEQ ID NO: 557 - DNA, 18 bp, Artificial sequence
  synthetic polynucleotide sequence
gacatcgtgatcaacgca

SEQ ID NO: 558 - DNA, 18 bp, Artificial sequence
  synthetic polynucleotide sequence
aggcacgctcttgaccga

SEQ ID NO: 559 - DNA, 18 bp, Artificial sequence
  synthetic polynucleotide sequence
tcaggagacgtgacccca

SEQ ID NO: 560 - DNA, 18 bp, Artificial sequence
  synthetic polynucleotide sequence
gtgctcgctcagaaggga

SEQ ID NO: 561 - DNA, 18 bp, Artificial sequence
  synthetic polynucleotide sequence
ctgagggctgtgaggaca

SEQ ID NO: 562 - DNA, 18 bp, Artificial sequence
  synthetic polynucleotide sequence
ggcaaccatggcagagca

SEQ ID NO: 563 - DNA, 18 bp, Artificial sequence
  synthetic polynucleotide sequence
cggattggacagcccaca

SEQ ID NO: 564 - DNA, 18 bp, Artificial sequence
  synthetic polynucleotide sequence
ctgtccacggagccctca

SEQ ID NO: 565 - DNA, 18 bp, Artificial sequence
  synthetic polynucleotide sequence
accctccaaaagagccca

SEQ ID NO: 566 - DNA, 18 bp, Artificial sequence
  synthetic polynucleotide sequence
ggtaggcttgcaggcgga

SEQ ID NO: 567 - DNA, 18 bp, Artificial sequence
  synthetic polynucleotide sequence
gcacctctccagcgggga

SEQ ID NO: 568 - DNA, 18 bp, Artificial sequence
  synthetic polynucleotide sequence
tcatgaagggccagccga

SEQ ID NO: 569 - DNA, 18 bp, Artificial sequence
  synthetic polynucleotide sequence
gagcgagatgacggggaa

SEQ ID NO: 570 - DNA, 18 bp, Artificial sequence
  synthetic polynucleotide sequence
caaggcctcgctccacca

SEQ ID NO: 571 - DNA, 18 bp, Artificial sequence
  synthetic polynucleotide sequence
tgcagggaaggtgggcca

SEQ ID NO: 572 - DNA, 18 bp, Artificial sequence
  synthetic polynucleotide sequence
gactcatcaggagggcca

SEQ ID NO: 573 - DNA, 18 bp, Artificial sequence
  synthetic polynucleotide sequence
cggtgcccttggcaggaa

SEQ ID NO: 574 - DNA, 18 bp, Artificial sequence
  synthetic polynucleotide sequence
acttgggcagaatcacca

SEQ ID NO: 575 - DNA, 18 bp, Artificial sequence
  synthetic polynucleotide sequence
gcagagagcagaggcaga

SEQ ID NO: 576 - DNA, 18 bp, Artificial sequence
  synthetic polynucleotide sequence
gggtggtctgccccacca

SEQ ID NO: 577 - DNA, 18 bp, Artificial sequence
  synthetic polynucleotide sequence
ttggacaccagagcccga

SEQ ID NO: 578 - DNA, 18 bp, Artificial sequence
  synthetic polynucleotide sequence
gggtgctgcactcagcca

SEQ ID NO: 579 - DNA, 18 bp, Artificial sequence
  synthetic polynucleotide sequence
ctgaagaggctgccggaa

SEQ ID NO: 580 - DNA, 18 bp, Artificial sequence
  synthetic polynucleotide sequence
cgtgtggcctcgaggaca

SEQ ID NO: 581 - DNA, 18 bp, Artificial sequence
  synthetic polynucleotide sequence
gaacaagcagcctcggca

SEQ ID NO: 582 - DNA, 18 bp, Artificial sequence
  synthetic polynucleotide sequence
ctgggaggctgcaatcca

SEQ ID NO: 583 - DNA, 18 bp, Artificial sequence
  synthetic polynucleotide sequence
gaaggagctgcagaggca

SEQ ID NO: 584 - DNA, 18 bp, Artificial sequence
  synthetic polynucleotide sequence
cctcatcctccacagaca

SEQ ID NO: 585 - DNA, 18 bp, Artificial sequence
  synthetic polynucleotide sequence
tgaaaagaacggagggga

SEQ ID NO: 586 - DNA, 18 bp, Artificial sequence
  synthetic polynucleotide sequence
gcaccgcgttctccacca

SEQ ID NO: 587 - DNA, 18 bp, Artificial sequence
  synthetic polynucleotide sequence
cgaggagccagacaccaa

SEQ ID NO: 588 - DNA, 18 bp, Artificial sequence
  synthetic polynucleotide sequence
gcctcccagagtcgcaga

SEQ ID NO: 589 - DNA, 18 bp, Artificial sequence
  synthetic polynucleotide sequence
gcatcagaaggccgagga

SEQ ID NO: 590 - DNA, 18 bp, Artificial sequence
  synthetic polynucleotide sequence
gggagactcagtgagaga

SEQ ID NO: 591 - DNA, 18 bp, Artificial sequence
  synthetic polynucleotide sequence
caggtggaatgccaccca

SEQ ID NO: 592 - DNA, 18 bp, Artificial sequence
  synthetic polynucleotide sequence
ggttcctccagcaggaca

SEQ ID NO: 593 - DNA, 18 bp, Artificial sequence
  synthetic polynucleotide sequence
tcaacaacggcgccaaga

SEQ ID NO: 594 - DNA, 18 bp, Artificial sequence
  synthetic polynucleotide sequence
ctggtacacatgggcaca

SEQ ID NO: 595 - DNA, 18 bp, Artificial sequence
  synthetic polynucleotide sequence
ctgtgacaccagcacgca

SEQ ID NO: 596 - DNA, 18 bp, Artificial sequence
  synthetic polynucleotide sequence
cacgttacaggccctcca

SEQ ID NO: 597 - DNA, 18 bp, Artificial sequence
  synthetic polynucleotide sequence
aagcacaagcgaacccca

SEQ ID NO: 598 - DNA, 18 bp, Artificial sequence
  synthetic polynucleotide sequence
agctcttggccaggacca

SEQ ID NO: 599 - DNA, 18 bp, Artificial sequence
  synthetic polynucleotide sequence
gtctgcaaccaggtggaa

SEQ ID NO: 600 - DNA, 18 bp, Artificial sequence
  synthetic polynucleotide sequence
ctgggtcctccaagagca

SEQ ID NO: 601 - DNA, 18 bp, Artificial sequence
  synthetic polynucleotide sequence
accgcaggcagctggaga

SEQ ID NO: 602 - DNA, 18 bp, Artificial sequence
  synthetic polynucleotide sequence
ctccaagagcaccgggga

SEQ ID NO: 603 - DNA, 18 bp, Artificial sequence
  synthetic polynucleotide sequence
ccctggagaggacactca

SEQ ID NO: 604 - DNA, 18 bp, Artificial sequence
  synthetic polynucleotide sequence
atcgcctcccaagtggca

SEQ ID NO: 605 - DNA, 18 bp, Artificial sequence
  synthetic polynucleotide sequence
gctgcacaaacgagggga

SEQ ID NO: 606 - DNA, 18 bp, Artificial sequence
  synthetic polynucleotide sequence
tagccaatgaaggtgcca

SEQ ID NO: 607 - DNA, 18 bp, Artificial sequence
  synthetic polynucleotide sequence
caacgaggaggacgagga

SEQ ID NO: 608 - DNA, 18 bp, Artificial sequence
  synthetic polynucleotide sequence
cggggtctgactcacaga

SEQ ID NO: 609 - DNA, 18 bp, Artificial sequence
  synthetic polynucleotide sequence
acgtccgaggtcgacaca

SEQ ID NO: 610 - DNA, 18 bp, Artificial sequence
  synthetic polynucleotide sequence
tgctggccgagtaggaga

SEQ ID NO: 611 - DNA, 18 bp, Artificial sequence
  synthetic polynucleotide sequence
gcagccaccatgaagaca

SEQ ID NO: 612 - DNA, 18 bp, Artificial sequence
  synthetic polynucleotide sequence
gacaacccctaggcccca

SEQ ID NO: 613 - DNA, 18 bp, Artificial sequence
  synthetic polynucleotide sequence
gtcaacaaatggcacgca

SEQ ID NO: 614 - DNA, 18 bp, Artificial sequence
  synthetic polynucleotide sequence
tcgaacaccaagcgtgga

SEQ ID NO: 615 - DNA, 18 bp, Artificial sequence
  synthetic polynucleotide sequence
cgggatgtacgggaagga

SEQ ID NO: 616 - DNA, 18 bp, Artificial sequence
  synthetic polynucleotide sequence
agacgtggtacacggcga

SEQ ID NO: 617 - DNA, 17 bp, Artificial sequence
  synthetic polynucleotide sequence
gtgaaccggcgagcaca

SEQ ID NO: 618 - DNA, 18 bp, Artificial sequence
  synthetic polynucleotide sequence
ccacctgccccagcacca

SEQ ID NO: 619 - DNA, 18 bp, Artificial sequence
  synthetic polynucleotide sequence
aagggagaggagggccaa

SEQ ID NO: 620 - DNA, 18 bp, Artificial sequence
  synthetic polynucleotide sequence
agggtgccaagcgcagga

SEQ ID NO: 621 - DNA, 18 bp, Artificial sequence
  synthetic polynucleotide sequence
ttggtgaacaggcgacca

SEQ ID NO: 622 - DNA, 18 bp, Artificial sequence
  synthetic polynucleotide sequence
acgagctcaacaagtgca

SEQ ID NO: 623 - DNA, 18 bp, Artificial sequence
  synthetic polynucleotide sequence
acgatgaggcagacgaga

SEQ ID NO: 624 - DNA, 18 bp, Artificial sequence
  synthetic polynucleotide sequence
acaccagcaacaagggca

SEQ ID NO: 625 - DNA, 18 bp, Artificial sequence
  synthetic polynucleotide sequence
tggcctcgaggctggaga

SEQ ID NO: 626 - DNA, 18 bp, Artificial sequence
  synthetic polynucleotide sequence
agcagggacacgaaggca

SEQ ID NO: 627 - DNA, 18 bp, Artificial sequence
  synthetic polynucleotide sequence
ctgcacacagcaaccgga

SEQ ID NO: 628 - DNA, 18 bp, Artificial sequence
  synthetic polynucleotide sequence
accagctgggaagagcca

SEQ ID NO: 629 - DNA, 18 bp, Artificial sequence
  synthetic polynucleotide sequence
gcgcattgccaaagagga

SEQ ID NO: 630 - DNA, 18 bp, Artificial sequence
  synthetic polynucleotide sequence
ggcactgggcacttacca

SEQ ID NO: 631 - DNA, 18 bp, Artificial sequence
  synthetic polynucleotide sequence
ctgagcagggtccccaga

SEQ ID NO: 632 - DNA, 18 bp, Artificial sequence
  synthetic polynucleotide sequence
gcgccctcagccacacca

SEQ ID NO: 633 - DNA, 16 bp, Artificial sequence
  synthetic polynucleotide sequence
cggacgctgacttgga

SEQ ID NO: 634 - DNA, 18 bp, Artificial sequence
  synthetic polynucleotide sequence
gacctgctcctccacgaa

SEQ ID NO: 635 - DNA, 18 bp, Artificial sequence
  synthetic polynucleotide sequence
gtgaaggaaggggccaca

SEQ ID NO: 636 - DNA, 18 bp, Artificial sequence
  synthetic polynucleotide sequence
acaccagaagccaggcca

SEQ ID NO: 637 - DNA, 18 bp, Artificial sequence
  synthetic polynucleotide sequence
gaggagatcttcgggcca

SEQ ID NO: 638 - DNA, 18 bp, Artificial sequence
  synthetic polynucleotide sequence
tgaagacagctgcggcca

SEQ ID NO: 639 - DNA, 18 bp, Artificial sequence
  synthetic polynucleotide sequence
gacggctgctgccaagca

SEQ ID NO: 640 - DNA, 18 bp, Artificial sequence
  synthetic polynucleotide sequence
ggatgtagtcaggggcca

SEQ ID NO: 641 - DNA, 18 bp, Artificial sequence
  synthetic polynucleotide sequence
tggaggtgtcacaggcaa

SEQ ID NO: 642 - DNA, 18 bp, Artificial sequence
  synthetic polynucleotide sequence
acagggacgctgatgaga

SEQ ID NO: 643 - DNA, 18 bp, Artificial sequence
  synthetic polynucleotide sequence
gccagagctggtggagca

SEQ ID NO: 644 - DNA, 18 bp, Artificial sequence
  synthetic polynucleotide sequence
ggagtgatcagagggcca

SEQ ID NO: 645 - DNA, 18 bp, Artificial sequence
  synthetic polynucleotide sequence
gcctgatggtgcaggaga

SEQ ID NO: 646 - DNA, 18 bp, Artificial sequence
  synthetic polynucleotide sequence
ccagctgttcccacagca

SEQ ID NO: 647 - DNA, 18 bp, Artificial sequence
  synthetic polynucleotide sequence
ggggcaagaatcctgcca

SEQ ID NO: 648 - DNA, 18 bp, Artificial sequence
  synthetic polynucleotide sequence
gagcacctatgctcacca

SEQ ID NO: 649 - DNA, 18 bp, Artificial sequence
  synthetic polynucleotide sequence
ggacatccaacgggctca

SEQ ID NO: 650 - DNA, 18 bp, Artificial sequence
  synthetic polynucleotide sequence
cacccatctccacacaca

SEQ ID NO: 651 - DNA, 18 bp, Artificial sequence
  synthetic polynucleotide sequence
ggctctgagtgaccacca

SEQ ID NO: 652 - DNA, 18 bp, Artificial sequence
  synthetic polynucleotide sequence
tgacggtcgccatggcaa

SEQ ID NO: 653 - DNA, 18 bp, Artificial sequence
  synthetic polynucleotide sequence
caaggccctgaatgacca

SEQ ID NO: 654 - DNA, 18 bp, Artificial sequence
  synthetic polynucleotide sequence
ccaggaacagctgcagga

SEQ ID NO: 655 - DNA, 18 bp, Artificial sequence
  synthetic polynucleotide sequence
ccattctggagaacgcca

SEQ ID NO: 656 - DNA, 18 bp, Artificial sequence
  synthetic polynucleotide sequence
agggccttgtacacagca

SEQ ID NO: 657 - DNA, 18 bp, Artificial sequence
  synthetic polynucleotide sequence
ccagaagcacttccagca

SEQ ID NO: 658 - DNA, 18 bp, Artificial sequence
  synthetic polynucleotide sequence
ccaccaccttcatgggca

SEQ ID NO: 659 - DNA, 18 bp, Artificial sequence
  synthetic polynucleotide sequence
gcgctactgtgagggcca

SEQ ID NO: 660 - DNA, 18 bp, Artificial sequence
  synthetic polynucleotide sequence
ccactccaactgacacca

SEQ ID NO: 661 - DNA, 18 bp, Artificial sequence
  synthetic polynucleotide sequence
gtggaaaaggtggagcga

SEQ ID NO: 662 - DNA, 18 bp, Artificial sequence
  synthetic polynucleotide sequence
atgagctcgagatccaca

SEQ ID NO: 663 - DNA, 18 bp, Artificial sequence
  synthetic polynucleotide sequence
acgatatcgcctggagca

SEQ ID NO: 664 - DNA, 18 bp, Artificial sequence
  synthetic polynucleotide sequence
cctctgaacagtgccaca

SEQ ID NO: 665 - DNA, 18 bp, Artificial sequence
  synthetic polynucleotide sequence
atggaaggccacggggaa

SEQ ID NO: 666 - DNA, 18 bp, Artificial sequence
  synthetic polynucleotide sequence
agggcagaggtcaccaca

SEQ ID NO: 667 - DNA, 18 bp, Artificial sequence
  synthetic polynucleotide sequence
cgcctcttgaaccacgca

SEQ ID NO: 668 - DNA, 18 bp, Artificial sequence
  synthetic polynucleotide sequence
gctggcacacacctgcca

SEQ ID NO: 669 - DNA, 18 bp, Artificial sequence
  synthetic polynucleotide sequence
atcaaggagcgccgagca

SEQ ID NO: 670 - DNA, 18 bp, Artificial sequence
  synthetic polynucleotide sequence
gacaggcgatctgaagca

SEQ ID NO: 671 - DNA, 18 bp, Artificial sequence
  synthetic polynucleotide sequence
ctcacgccaggctcacca

SEQ ID NO: 672 - DNA, 18 bp, Artificial sequence
  synthetic polynucleotide sequence
ggcagatggagctgggga

SEQ ID NO: 673 - DNA, 18 bp, Artificial sequence
  synthetic polynucleotide sequence
tcaactggccctggacca

SEQ ID NO: 674 - DNA, 18 bp, Artificial sequence
  synthetic polynucleotide sequence
ggtcagctggtccaggga

SEQ ID NO: 675 - DNA, 18 bp, Artificial sequence
  synthetic polynucleotide sequence
acaatgcggatgccccca

SEQ ID NO: 676 - DNA, 18 bp, Artificial sequence
  synthetic polynucleotide sequence
agacaggcctgccggaca

SEQ ID NO: 677 - DNA, 18 bp, Artificial sequence
  synthetic polynucleotide sequence
cacctgctctgccaagca

SEQ ID NO: 678 - DNA, 18 bp, Artificial sequence
  synthetic polynucleotide sequence
acgctgggaagttgggca

SEQ ID NO: 679 - DNA, 18 bp, Artificial sequence
  synthetic polynucleotide sequence
gggccagcatgaggagga

SEQ ID NO: 680 - DNA, 18 bp, Artificial sequence
  synthetic polynucleotide sequence
gcaggtactcgtagggca

SEQ ID NO: 681 - DNA, 18 bp, Artificial sequence
  synthetic polynucleotide sequence
gcatcgccaccttccaga

SEQ ID NO: 682 - DNA, 18 bp, Artificial sequence
  synthetic polynucleotide sequence
ggtaggtgtagggcagca

SEQ ID NO: 683 - DNA, 18 bp, Artificial sequence
  synthetic polynucleotide sequence
cggccgaggtggtagaca

SEQ ID NO: 684 - DNA, 18 bp, Artificial sequence
  synthetic polynucleotide sequence
cgcattggggatccagga

SEQ ID NO: 685 - DNA, 18 bp, Artificial sequence
  synthetic polynucleotide sequence
gcttccagaggaccggaa

SEQ ID NO: 686 - DNA, 18 bp, Artificial sequence
  synthetic polynucleotide sequence
cggacatgaggaacagga

SEQ ID NO: 687 - DNA, 18 bp, Artificial sequence
  synthetic polynucleotide sequence
ccccgattaccagcagca

SEQ ID NO: 688 - DNA, 18 bp, Artificial sequence
  synthetic polynucleotide sequence
gacaggcagcgaaggcca

SEQ ID NO: 689 - DNA, 18 bp, Artificial sequence
  synthetic polynucleotide sequence
agcccaaaggagaggcca

SEQ ID NO: 690 - DNA, 18 bp, Artificial sequence
  synthetic polynucleotide sequence
ccggaagtgctaacccca

SEQ ID NO: 691 - DNA, 18 bp, Artificial sequence
  synthetic polynucleotide sequence
tgcatgaggcggtggaga

SEQ ID NO: 692 - DNA, 18 bp, Artificial sequence
  synthetic polynucleotide sequence
ctcgttcaccgcccacca

SEQ ID NO: 693 - DNA, 18 bp, Artificial sequence
  synthetic polynucleotide sequence
acagccaaggtgggacca

SEQ ID NO: 694 - DNA, 18 bp, Artificial sequence
  synthetic polynucleotide sequence
cacagacgggtccaggga

SEQ ID NO: 695 - DNA, 18 bp, Artificial sequence
  synthetic polynucleotide sequence
acggcgtgcaggagcaga

SEQ ID NO: 696 - DNA, 18 bp, Artificial sequence
  synthetic polynucleotide sequence
ctgccagcagaggaagca

SEQ ID NO: 697 - DNA, 18 bp, Artificial sequence
  synthetic polynucleotide sequence
cccagtgacaaagccgca

SEQ ID NO: 698 - DNA, 18 bp, Artificial sequence
  synthetic polynucleotide sequence
atcctgggaagggaggca

SEQ ID NO: 699 - DNA, 18 bp, Artificial sequence
  synthetic polynucleotide sequence
cttagagcgcaagggcca

SEQ ID NO: 700 - DNA, 18 bp, Artificial sequence
  synthetic polynucleotide sequence
cctcccgctcatgaagca

SEQ ID NO: 701 - DNA, 18 bp, Artificial sequence
  synthetic polynucleotide sequence
ctggcaagggtcaggtca

SEQ ID NO: 702 - DNA, 18 bp, Artificial sequence
  synthetic polynucleotide sequence
cgaggtgcttcccacaga

SEQ ID NO: 703 - DNA, 18 bp, Artificial sequence
  synthetic polynucleotide sequence
gcgggagagaagacccaa

SEQ ID NO: 704 - DNA, 18 bp, Artificial sequence
  synthetic polynucleotide sequence
ggtggcagccactgggga

SEQ ID NO: 705 - DNA, 18 bp, Artificial sequence
  synthetic polynucleotide sequence
ctgccagggcaacgggaa

SEQ ID NO: 706 - DNA, 18 bp, Artificial sequence
  synthetic polynucleotide sequence
catcaccatcaccaggga

SEQ ID NO: 707 - DNA, 18 bp, Artificial sequence
  synthetic polynucleotide sequence
agtgagcttgacccagca

SEQ ID NO: 708 - DNA, 18 bp, Artificial sequence
  synthetic polynucleotide sequence
ccactctcacgagtgaca

SEQ ID NO: 709 - DNA, 18 bp, Artificial sequence
  synthetic polynucleotide sequence
gcccagaaacaggggaga

SEQ ID NO: 710 - DNA, 18 bp, Artificial sequence
  synthetic polynucleotide sequence
taggtcaccaggcaggaa

SEQ ID NO: 711 - DNA, 18 bp, Artificial sequence
  synthetic polynucleotide sequence
cctccagcaagctcgcaa

SEQ ID NO: 712 - DNA, 18 bp, Artificial sequence
  synthetic polynucleotide sequence
ccagcatccttcgacgca

SEQ ID NO: 713 - DNA, 18 bp, Artificial sequence
  synthetic polynucleotide sequence
ccgagacctaccaggcca

SEQ ID NO: 714 - DNA, 18 bp, Artificial sequence
  synthetic polynucleotide sequence
ggcggtgggcacgcagca

SEQ ID NO: 715 - DNA, 18 bp, Artificial sequence
  synthetic polynucleotide sequence
ccaggtattgcccaccga

SEQ ID NO: 716 - DNA, 18 bp, Artificial sequence
  synthetic polynucleotide sequence
tgagtaggggtccaggca

SEQ ID NO: 717 - DNA, 18 bp, Artificial sequence
  synthetic polynucleotide sequence
gcccggaagagcctcgaa

SEQ ID NO: 718 - DNA, 18 bp, Artificial sequence
  synthetic polynucleotide sequence
tcagaacagggagcagca

SEQ ID NO: 719 - DNA, 18 bp, Artificial sequence
  synthetic polynucleotide sequence
gcaggtgcaggtcgagga

SEQ ID NO: 720 - DNA, 18 bp, Artificial sequence
  synthetic polynucleotide sequence
ccaggaccacactaagga

SEQ ID NO: 721 - DNA, 18 bp, Artificial sequence
  synthetic polynucleotide sequence
gactccatgcccctgcaa

SEQ ID NO: 722 - DNA, 18 bp, Artificial sequence
  synthetic polynucleotide sequence
cgttcatcagcggaggca

SEQ ID NO: 723 - DNA, 18 bp, Artificial sequence
  synthetic polynucleotide sequence
cgccacctacctaccgga

SEQ ID NO: 724 - DNA, 18 bp, Artificial sequence
  synthetic polynucleotide sequence
gatgctggcgatgagcaa

SEQ ID NO: 725 - DNA, 18 bp, Artificial sequence
  synthetic polynucleotide sequence
caagacaggcagccgaga

SEQ ID NO: 726 - DNA, 18 bp, Artificial sequence
  synthetic polynucleotide sequence
gctggagcagcagcagca

SEQ ID NO: 727 - DNA, 18 bp, Artificial sequence
  synthetic polynucleotide sequence
tggaggccgacatgacca

SEQ ID NO: 728 - DNA, 18 bp, Artificial sequence
  synthetic polynucleotide sequence
tggccaccagtgagcaga

SEQ ID NO: 729 - DNA, 18 bp, Artificial sequence
  synthetic polynucleotide sequence
agctggagccctcaccca

SEQ ID NO: 730 - DNA, 18 bp, Artificial sequence
  synthetic polynucleotide sequence
ggtgacatggcgatggga

SEQ ID NO: 731 - DNA, 18 bp, Artificial sequence
  synthetic polynucleotide sequence
ggagctggaggagagcaa

SEQ ID NO: 732 - DNA, 18 bp, Artificial sequence
  synthetic polynucleotide sequence
ccagcgcatgttgggaga

SEQ ID NO: 733 - DNA, 18 bp, Artificial sequence
  synthetic polynucleotide sequence
caaggagaccaccgagga

SEQ ID NO: 734 - DNA, 18 bp, Artificial sequence
  synthetic polynucleotide sequence
agaggcctcccttgcaga

SEQ ID NO: 735 - DNA, 18 bp, Artificial sequence
  synthetic polynucleotide sequence
acccagggaaccccagca

SEQ ID NO: 736 - DNA, 18 bp, Artificial sequence
  synthetic polynucleotide sequence
gcaggggtggtcactgca

SEQ ID NO: 737 - DNA, 21 bp, Artificial sequence
  synthetic polynucleotide sequence
gtatgataatgggagcaacca

SEQ ID NO: 738 - DNA, 18 bp, Artificial sequence
  synthetic polynucleotide sequence
gtgccagcaggaagacca

SEQ ID NO: 739 - DNA, 18 bp, Artificial sequence
  synthetic polynucleotide sequence
ccaagcagttggaaagga

SEQ ID NO: 740 - DNA, 18 bp, Artificial sequence
  synthetic polynucleotide sequence
gcaagatgagagtgacca

SEQ ID NO: 741 - DNA, 18 bp, Artificial sequence
  synthetic polynucleotide sequence
acatggccatcgagccca

SEQ ID NO: 742 - DNA, 18 bp, Artificial sequence
  synthetic polynucleotide sequence
tcgatggcagcctccaga

SEQ ID NO: 743 - DNA, 18 bp, Artificial sequence
  synthetic polynucleotide sequence
tgccagtaccgagccaca

SEQ ID NO: 744 - DNA, 18 bp, Artificial sequence
  synthetic polynucleotide sequence
gactgatccaagtggaca

SEQ ID NO: 745 - DNA, 18 bp, Artificial sequence
  synthetic polynucleotide sequence
gtggcgagaatgggagga

SEQ ID NO: 746 - DNA, 18 bp, Artificial sequence
  synthetic polynucleotide sequence
gcatcaggtcctgagcca

SEQ ID NO: 747 - DNA, 18 bp, Artificial sequence
  synthetic polynucleotide sequence
ctggagctgatggacaca

SEQ ID NO: 748 - DNA, 18 bp, Artificial sequence
  synthetic polynucleotide sequence
caacctcccccattgaca

SEQ ID NO: 749 - DNA, 18 bp, Artificial sequence
  synthetic polynucleotide sequence
ggaagagcatggacagca

SEQ ID NO: 750 - DNA, 18 bp, Artificial sequence
  synthetic polynucleotide sequence
ggacacgtaggggctgga

SEQ ID NO: 751 - DNA, 18 bp, Artificial sequence
  synthetic polynucleotide sequence
actaccacgctcccgaca

SEQ ID NO: 752 - DNA, 18 bp, Artificial sequence
  synthetic polynucleotide sequence
tcatgcgagaggcacgca

SEQ ID NO: 753 - DNA, 18 bp, Artificial sequence
  synthetic polynucleotide sequence
agcaaaagaagctgggca

SEQ ID NO: 754 - DNA, 18 bp, Artificial sequence
  synthetic polynucleotide sequence
ataacagtccaaccccca

SEQ ID NO: 755 - DNA, 18 bp, Artificial sequence
  synthetic polynucleotide sequence
caccaccctggacagaga

SEQ ID NO: 756 - DNA, 18 bp, Artificial sequence
  synthetic polynucleotide sequence
tcctcggaactcagccca

SEQ ID NO: 757 - DNA, 18 bp, Artificial sequence
  synthetic polynucleotide sequence
gggacaagaactgcgcca

SEQ ID NO: 758 - DNA, 18 bp, Artificial sequence
  synthetic polynucleotide sequence
cccgccaggtcttccaga

SEQ ID NO: 759 - DNA, 18 bp, Artificial sequence
  synthetic polynucleotide sequence
caacggtgtgtggcacca

SEQ ID NO: 760 - DNA, 18 bp, Artificial sequence
  synthetic polynucleotide sequence
gaatatgccccaccacga

SEQ ID NO: 761 - DNA, 18 bp, Artificial sequence
  synthetic polynucleotide sequence
ctaccgggactggaagca

SEQ ID NO: 762 - DNA, 18 bp, Artificial sequence
  synthetic polynucleotide sequence
gtctggagagccggtgga

SEQ ID NO: 763 - DNA, 18 bp, Artificial sequence
  synthetic polynucleotide sequence
ggacaagaccctggagca

SEQ ID NO: 764 - DNA, 18 bp, Artificial sequence
  synthetic polynucleotide sequence
aggcaccaggttcccaga

SEQ ID NO: 765 - DNA, 18 bp, Artificial sequence
  synthetic polynucleotide sequence
tcagcagggtcacacgca

SEQ ID NO: 766 - DNA, 18 bp, Artificial sequence
  synthetic polynucleotide sequence
ccacggagatgtagccca

SEQ ID NO: 767 - DNA, 18 bp, Artificial sequence
  synthetic polynucleotide sequence
tgaccggggacacagaca

SEQ ID NO: 768 - DNA, 18 bp, Artificial sequence
  synthetic polynucleotide sequence
ccgaactgaaggagcgga

SEQ ID NO: 769 - DNA, 18 bp, Artificial sequence
  synthetic polynucleotide sequence
ctatcaggagcacggcca

SEQ ID NO: 770 - DNA, 18 bp, Artificial sequence
  synthetic polynucleotide sequence
tcctgccaatggccacga

SEQ ID NO: 771 - DNA, 18 bp, Artificial sequence
  synthetic polynucleotide sequence
agcccctgctcatcccga

SEQ ID NO: 772 - DNA, 18 bp, Artificial sequence
  synthetic polynucleotide sequence
gccaccagaagctcagca

SEQ ID NO: 773 - DNA, 18 bp, Artificial sequence
  synthetic polynucleotide sequence
ccagaccctgatgagcca

SEQ ID NO: 774 - DNA, 18 bp, Artificial sequence
  synthetic polynucleotide sequence
tcatcgagggccagccca

SEQ ID NO: 775 - DNA, 18 bp, Artificial sequence
  synthetic polynucleotide sequence
ctcgaggtcaccagggaa

SEQ ID NO: 776 - DNA, 18 bp, Artificial sequence
  synthetic polynucleotide sequence
gtccgagggtgagtagca

SEQ ID NO: 777 - DNA, 18 bp, Artificial sequence
  synthetic polynucleotide sequence
aaagtggggctgatccaa

SEQ ID NO: 778 - DNA, 18 bp, Artificial sequence
  synthetic polynucleotide sequence
agcctagggctacagcta

SEQ ID NO: 779 - DNA, 18 bp, Artificial sequence
  synthetic polynucleotide sequence
agccgacacgtgcgacca

SEQ ID NO: 780 - DNA, 18 bp, Artificial sequence
  synthetic polynucleotide sequence
gctgtgcagtccagccga

SEQ ID NO: 781 - DNA, 18 bp, Artificial sequence
  synthetic polynucleotide sequence
ctggacaagcagcacaga

SEQ ID NO: 782 - DNA, 18 bp, Artificial sequence
  synthetic polynucleotide sequence
gcgccatgttccagcaga

SEQ ID NO: 783 - DNA, 18 bp, Artificial sequence
  synthetic polynucleotide sequence
gcctacctcagatgacga

SEQ ID NO: 784 - DNA, 18 bp, Artificial sequence
  synthetic polynucleotide sequence
ggaaggctttcaaccaca

SEQ ID NO: 785 - DNA, 18 bp, Artificial sequence
  synthetic polynucleotide sequence
gcaacatgagcagcgaga

SEQ ID NO: 786 - DNA, 18 bp, Artificial sequence
  synthetic polynucleotide sequence
aagctggccaggaggtca

SEQ ID NO: 787 - DNA, 18 bp, Artificial sequence
  synthetic polynucleotide sequence
cagcctcccatagggcca

SEQ ID NO: 788 - DNA, 18 bp, Artificial sequence
  synthetic polynucleotide sequence
caggccggacactgagca

SEQ ID NO: 789 - DNA, 18 bp, Artificial sequence
  synthetic polynucleotide sequence
acgacgccgatgtggaca

SEQ ID NO: 790 - DNA, 18 bp, Artificial sequence
  synthetic polynucleotide sequence
cgtccagggctcccacca

SEQ ID NO: 791 - DNA, 18 bp, Artificial sequence
  synthetic polynucleotide sequence
ggaggagcgtgaacgaga

SEQ ID NO: 792 - DNA, 18 bp, Artificial sequence
  synthetic polynucleotide sequence
agtcaggccttggaggga

SEQ ID NO: 793 - DNA, 18 bp, Artificial sequence
  synthetic polynucleotide sequence
agccaatgcagggacaca

SEQ ID NO: 794 - DNA, 18 bp, Artificial sequence
  synthetic polynucleotide sequence
tcaggttgccagaggcga

SEQ ID NO: 795 - DNA, 18 bp, Artificial sequence
  synthetic polynucleotide sequence
gggtcacagtcacagcca

SEQ ID NO: 796 - DNA, 18 bp, Artificial sequence
  synthetic polynucleotide sequence
catcgggctatgcagcca

SEQ ID NO: 797 - DNA, 18 bp, Artificial sequence
  synthetic polynucleotide sequence
cagagtctgagtgggaga

SEQ ID NO: 798 - DNA, 18 bp, Artificial sequence
  synthetic polynucleotide sequence
gcatccactagggtggca

SEQ ID NO: 799 - DNA, 18 bp, Artificial sequence
  synthetic polynucleotide sequence
gcaggtacttcggggaga

SEQ ID NO: 800 - DNA, 18 bp, Artificial sequence
  synthetic polynucleotide sequence
acaccaggaagcagccca

SEQ ID NO: 801 - DNA, 18 bp, Artificial sequence
  synthetic polynucleotide sequence
gaacagatccccggagga

SEQ ID NO: 802 - DNA, 18 bp, Artificial sequence
  synthetic polynucleotide sequence
gggaagccgggccagcga

SEQ ID NO: 803 - DNA, 18 bp, Artificial sequence
  synthetic polynucleotide sequence
ctacaccctgaacccgga

SEQ ID NO: 804 - DNA, 18 bp, Artificial sequence
  synthetic polynucleotide sequence
gagaacgagccaccacca

SEQ ID NO: 805 - DNA, 18 bp, Artificial sequence
  synthetic polynucleotide sequence
ggagaaaagggctccaca

SEQ ID NO: 806 - DNA, 18 bp, Artificial sequence
  synthetic polynucleotide sequence
agtaggacccacaaggca

SEQ ID NO: 807 - DNA, 18 bp, Artificial sequence
  synthetic polynucleotide sequence
aaggatcctccaccacca

SEQ ID NO: 808 - DNA, 18 bp, Artificial sequence
  synthetic polynucleotide sequence
cctccaacccctcgacca

SEQ ID NO: 809 - DNA, 18 bp, Artificial sequence
  synthetic polynucleotide sequence
caccagaagctatccaca

SEQ ID NO: 810 - DNA, 18 bp, Artificial sequence
  synthetic polynucleotide sequence
cacgatagctgtgaggca

SEQ ID NO: 811 - DNA, 18 bp, Artificial sequence
  synthetic polynucleotide sequence
gggaccagagaggaagga

SEQ ID NO: 812 - DNA, 18 bp, Artificial sequence
  synthetic polynucleotide sequence
gacaggcttcccatagga

SEQ ID NO: 813 - DNA, 18 bp, Artificial sequence
  synthetic polynucleotide sequence
catcaggcgacttgcaga

SEQ ID NO: 814 - DNA, 18 bp, Artificial sequence
  synthetic polynucleotide sequence
ccccgcacccttcatcga

SEQ ID NO: 815 - DNA, 18 bp, Artificial sequence
  synthetic polynucleotide sequence
cccgcagtgaagtggaca

SEQ ID NO: 816 - DNA, 18 bp, Artificial sequence
  synthetic polynucleotide sequence
atctccaccacacaggta

SEQ ID NO: 817 - DNA, 18 bp, Artificial sequence
  synthetic polynucleotide sequence
gtcaaatgcacagcggca

SEQ ID NO: 818 - DNA, 18 bp, Artificial sequence
  synthetic polynucleotide sequence
gagtcactagggccacca

SEQ ID NO: 819 - DNA, 18 bp, Artificial sequence
  synthetic polynucleotide sequence
ccaaacctaccagcagca

SEQ ID NO: 820 - DNA, 18 bp, Artificial sequence
  synthetic polynucleotide sequence
atccctcccaccagctga

SEQ ID NO: 821 - DNA, 18 bp, Artificial sequence
  synthetic polynucleotide sequence
ccgcgagacttctggcaa

SEQ ID NO: 822 - DNA, 18 bp, Artificial sequence
  synthetic polynucleotide sequence
ctgcaaggtaggcaggta

SEQ ID NO: 823 - DNA, 18 bp, Artificial sequence
  synthetic polynucleotide sequence
tccaggaaactgagccca

SEQ ID NO: 824 - DNA, 18 bp, Artificial sequence
  synthetic polynucleotide sequence
cagccctgcacaaggcca

SEQ ID NO: 825 - DNA, 18 bp, Artificial sequence
  synthetic polynucleotide sequence
cagtcccagccatgacca

SEQ ID NO: 826 - DNA, 18 bp, Artificial sequence
  synthetic polynucleotide sequence
cctggaggcagttcagga

SEQ ID NO: 827 - DNA, 18 bp, Artificial sequence
  synthetic polynucleotide sequence
gggaacggtgcacacaca

SEQ ID NO: 828 - DNA, 18 bp, Artificial sequence
  synthetic polynucleotide sequence
ttccagggggcagccaca

SEQ ID NO: 829 - DNA, 18 bp, Artificial sequence
  synthetic polynucleotide sequence
ggaaggaggaggagccca

SEQ ID NO: 830 - DNA, 18 bp, Artificial sequence
  synthetic polynucleotide sequence
ctgtcacccaggccacca

SEQ ID NO: 831 - DNA, 18 bp, Artificial sequence
  synthetic polynucleotide sequence
ggagaaaggcgaaggcca

SEQ ID NO: 832 - DNA, 18 bp, Artificial sequence
  synthetic polynucleotide sequence
ggaccacgagtgtgcaga

SEQ ID NO: 833 - DNA, 18 bp, Artificial sequence
  synthetic polynucleotide sequence
gcgcctacaagcaaacca

SEQ ID NO: 834 - DNA, 18 bp, Artificial sequence
  synthetic polynucleotide sequence
gggactgaggcaggggca

SEQ ID NO: 835 - DNA, 19 bp, Artificial sequence
  synthetic polynucleotide sequence
ccaacaacgtggagatcca

SEQ ID NO: 836 - DNA, 19 bp, Artificial sequence
  synthetic polynucleotide sequence
aaggacttgatggaccaca

SEQ ID NO: 837 - DNA, 18 bp, Artificial sequence
  synthetic polynucleotide sequence
cagtgtgggcagcgccaa

SEQ ID NO: 838 - DNA, 18 bp, Artificial sequence
  synthetic polynucleotide sequence
tgtagcgaacccagggca

SEQ ID NO: 839 - DNA, 18 bp, Artificial sequence
  synthetic polynucleotide sequence
gcactaccactgcaacga

SEQ ID NO: 840 - DNA, 18 bp, Artificial sequence
  synthetic polynucleotide sequence
caaggtcactgccaagca

SEQ ID NO: 841 - DNA, 18 bp, Artificial sequence
  synthetic polynucleotide sequence
tcaagcgcatggcaggca

SEQ ID NO: 842 - DNA, 18 bp, Artificial sequence
  synthetic polynucleotide sequence
tagcgcaccttgaggcca

SEQ ID NO: 843 - DNA, 18 bp, Artificial sequence
  synthetic polynucleotide sequence
acacggtcgtggacgaga

SEQ ID NO: 844 - DNA, 18 bp, Artificial sequence
  synthetic polynucleotide sequence
gggactgtagcatcagca

SEQ ID NO: 845 - DNA, 18 bp, Artificial sequence
  synthetic polynucleotide sequence
gccttgatccagagcaga

SEQ ID NO: 846 - DNA, 18 bp, Artificial sequence
  synthetic polynucleotide sequence
gccatcacaacactgcca

SEQ ID NO: 847 - DNA, 18 bp, Artificial sequence
  synthetic polynucleotide sequence
ggcttagcaggagctcca

SEQ ID NO: 848 - DNA, 18 bp, Artificial sequence
  synthetic polynucleotide sequence
aagagggcaggtttggca

SEQ ID NO: 849 - DNA, 18 bp, Artificial sequence
  synthetic polynucleotide sequence
gcaaagcccactgggcaa

SEQ ID NO: 850 - DNA, 18 bp, Artificial sequence
  synthetic polynucleotide sequence
gggctccagaatcaggga

SEQ ID NO: 851 - DNA, 18 bp, Artificial sequence
  synthetic polynucleotide sequence
ggagctgctacccatgga

SEQ ID NO: 852 - DNA, 18 bp, Artificial sequence
  synthetic polynucleotide sequence
agtgacaacgttccacca

SEQ ID NO: 853 - DNA, 18 bp, Artificial sequence
  synthetic polynucleotide sequence
agtggagccacagagcca

SEQ ID NO: 854 - DNA, 18 bp, Artificial sequence
  synthetic polynucleotide sequence
catgcaggctggtggcga

SEQ ID NO: 855 - DNA, 18 bp, Artificial sequence
  synthetic polynucleotide sequence
catggacacggggaacca

SEQ ID NO: 856 - DNA, 18 bp, Artificial sequence
  synthetic polynucleotide sequence
cggcctggctaccaagca

SEQ ID NO: 857 - DNA, 18 bp, Artificial sequence
  synthetic polynucleotide sequence
aggtcaaggagtgggaga

SEQ ID NO: 858 - DNA, 18 bp, Artificial sequence
  synthetic polynucleotide sequence
agctggatgaggagagga

SEQ ID NO: 859 - DNA, 18 bp, Artificial sequence
  synthetic polynucleotide sequence
ggcagaccacctgagcaa

SEQ ID NO: 860 - DNA, 18 bp, Artificial sequence
  synthetic polynucleotide sequence
aagggagctgcatcggga

SEQ ID NO: 861 - DNA, 18 bp, Artificial sequence
  synthetic polynucleotide sequence
tcaacggtcagaggccca

SEQ ID NO: 862 - DNA, 18 bp, Artificial sequence
  synthetic polynucleotide sequence
aggaggcacactggacca

SEQ ID NO: 863 - DNA, 18 bp, Artificial sequence
  synthetic polynucleotide sequence
cctggggcaggaacagga

SEQ ID NO: 864 - DNA, 18 bp, Artificial sequence
  synthetic polynucleotide sequence
ttggcagggagaggggta

SEQ ID NO: 865 - DNA, 18 bp, Artificial sequence
  synthetic polynucleotide sequence
tgaccttcgcaaccccaa

SEQ ID NO: 866 - DNA, 18 bp, Artificial sequence
  synthetic polynucleotide sequence
ccagtggcacagcctgca

SEQ ID NO: 867 - DNA, 18 bp, Artificial sequence
  synthetic polynucleotide sequence
ctgacatcgggactgaca

SEQ ID NO: 868 - DNA, 18 bp, Artificial sequence
  synthetic polynucleotide sequence
agctgtgatgaaggccca

SEQ ID NO: 869 - DNA, 18 bp, Artificial sequence
  synthetic polynucleotide sequence
gttacgcaccaccgggga

SEQ ID NO: 870 - DNA, 18 bp, Artificial sequence
  synthetic polynucleotide sequence
ccacggtggtggacgaga

SEQ ID NO: 871 - DNA, 18 bp, Artificial sequence
  synthetic polynucleotide sequence
ccgagaaggcacagcaga

SEQ ID NO: 872 - DNA, 18 bp, Artificial sequence
  synthetic polynucleotide sequence
tctggtcaagcaggccca

SEQ ID NO: 873 - DNA, 18 bp, Artificial sequence
  synthetic polynucleotide sequence
ctcgaggaagagcgggaa

SEQ ID NO: 874 - DNA, 18 bp, Artificial sequence
  synthetic polynucleotide sequence
tcaccaggctgatgacga

SEQ ID NO: 875 - DNA, 18 bp, Artificial sequence
  synthetic polynucleotide sequence
gctcagcgagaaggccaa

SEQ ID NO: 876 - DNA, 18 bp, Artificial sequence
  synthetic polynucleotide sequence
gagcgctcaggaagctga

SEQ ID NO: 877 - DNA, 18 bp, Artificial sequence
  synthetic polynucleotide sequence
gggaaccgttccacagca

SEQ ID NO: 878 - DNA, 18 bp, Artificial sequence
  synthetic polynucleotide sequence
acgtcccatcctgaggga

SEQ ID NO: 879 - DNA, 17 bp, Artificial sequence
  synthetic polynucleotide sequence
gcttcaggccgaggcca

SEQ ID NO: 880 - DNA, 18 bp, Artificial sequence
  synthetic polynucleotide sequence
acacttcactgggtggca

SEQ ID NO: 881 - DNA, 18 bp, Artificial sequence
  synthetic polynucleotide sequence
cgaccaggagactgagga

SEQ ID NO: 882 - DNA, 18 bp, Artificial sequence
  synthetic polynucleotide sequence
catccagacgggcctgca

SEQ ID NO: 883 - DNA, 18 bp, Artificial sequence
  synthetic polynucleotide sequence
ctgacctgcgcaacgaga

SEQ ID NO: 884 - DNA, 18 bp, Artificial sequence
  synthetic polynucleotide sequence
gaatctggggcaggccca

SEQ ID NO: 885 - DNA, 18 bp, Artificial sequence
  synthetic polynucleotide sequence
ggttgaagcacagggcaa

SEQ ID NO: 886 - DNA, 18 bp, Artificial sequence
  synthetic polynucleotide sequence
accgcagggctgggtcga

SEQ ID NO: 887 - DNA, 18 bp, Artificial sequence
  synthetic polynucleotide sequence
agcgcctggacaatggca

SEQ ID NO: 888 - DNA, 18 bp, Artificial sequence
  synthetic polynucleotide sequence
cccggcacagccccagga

SEQ ID NO: 889 - DNA, 18 bp, Artificial sequence
  synthetic polynucleotide sequence
cctggccaggcacagcaa

SEQ ID NO: 890 - DNA, 18 bp, Artificial sequence
  synthetic polynucleotide sequence
gcccatgatctccacgga

SEQ ID NO: 891 - DNA, 18 bp, Artificial sequence
  synthetic polynucleotide sequence
gctggacctggaccagga

SEQ ID NO: 892 - DNA, 18 bp, Artificial sequence
  synthetic polynucleotide sequence
gcgggcagtgaagatgca

SEQ ID NO: 893 - DNA, 18 bp, Artificial sequence
  synthetic polynucleotide sequence
aaggtcctgcgggcagga

SEQ ID NO: 894 - DNA, 20 bp, Artificial sequence
  synthetic polynucleotide sequence
caagacgatcgacagaacca

SEQ ID NO: 895 - DNA, 18 bp, Artificial sequence
  synthetic polynucleotide sequence
ctcacccaggtgaaggaa

SEQ ID NO: 896 - DNA, 18 bp, Artificial sequence
  synthetic polynucleotide sequence
atctacagcgggcaggta

SEQ ID NO: 897 - DNA, 18 bp, Artificial sequence
  synthetic polynucleotide sequence
gcagggttacatgaagca

SEQ ID NO: 898 - DNA, 18 bp, Artificial sequence
  synthetic polynucleotide sequence
ctgctgggccacctggga

SEQ ID NO: 899 - DNA, 18 bp, Artificial sequence
  synthetic polynucleotide sequence
tgacgaccacctgaggga

SEQ ID NO: 900 - DNA, 18 bp, Artificial sequence
  synthetic polynucleotide sequence
acagacaagcctggggca

SEQ ID NO: 901 - DNA, 18 bp, Artificial sequence
  synthetic polynucleotide sequence
accccagttaacctcaca

SEQ ID NO: 902 - DNA, 18 bp, Artificial sequence
  synthetic polynucleotide sequence
gatccagtacggtgccga

SEQ ID NO: 903 - DNA, 18 bp, Artificial sequence
  synthetic polynucleotide sequence
aggagcaggcccagcaga

SEQ ID NO: 904 - DNA, 18 bp, Artificial sequence
  synthetic polynucleotide sequence
cttccaccaggggctcga

SEQ ID NO: 905 - DNA, 18 bp, Artificial sequence
  synthetic polynucleotide sequence
ggcaaggccagggaacga

SEQ ID NO: 906 - DNA, 18 bp, Artificial sequence
  synthetic polynucleotide sequence
cactgatcgctagaccca

SEQ ID NO: 907 - DNA, 18 bp, Artificial sequence
  synthetic polynucleotide sequence
gagccgtacgctatacga

SEQ ID NO: 908 - DNA, 18 bp, Artificial sequence
  synthetic polynucleotide sequence
ggagggcagatgatggga

SEQ ID NO: 909 - DNA, 18 bp, Artificial sequence
  synthetic polynucleotide sequence
cccgggtcactgagccaa

SEQ ID NO: 910 - DNA, 18 bp, Artificial sequence
  synthetic polynucleotide sequence
agaagcttacaggggcca

SEQ ID NO: 911 - DNA, 18 bp, Artificial sequence
  synthetic polynucleotide sequence
tgcagaggaggttgagca

SEQ ID NO: 912 - DNA, 18 bp, Artificial sequence
  synthetic polynucleotide sequence
gctcccagacccatgcca

SEQ ID NO: 913 - DNA, 18 bp, Artificial sequence
  synthetic polynucleotide sequence
gaacgattgcaggcacca

SEQ ID NO: 914 - DNA, 18 bp, Artificial sequence
  synthetic polynucleotide sequence
ccacatccagtgcaagga

SEQ ID NO: 915 - DNA, 18 bp, Artificial sequence
  synthetic polynucleotide sequence
tgggacctgcgaaaccga

SEQ ID NO: 916 - DNA, 18 bp, Artificial sequence
  synthetic polynucleotide sequence
cacacagacacacagaca

SEQ ID NO: 917 - DNA, 18 bp, Artificial sequence
  synthetic polynucleotide sequence
agctcccaccaaggagga

SEQ ID NO: 918 - DNA, 18 bp, Artificial sequence
  synthetic polynucleotide sequence
atgcggatggtagcacga

SEQ ID NO: 919 - DNA, 18 bp, Artificial sequence
  synthetic polynucleotide sequence
tactgcaccaccgctcca

SEQ ID NO: 920 - DNA, 18 bp, Artificial sequence
  synthetic polynucleotide sequence
aaccagttgcagtgcgga

SEQ ID NO: 921 - DNA, 18 bp, Artificial sequence
  synthetic polynucleotide sequence
ggccgaggagattcagga

SEQ ID NO: 922 - DNA, 18 bp, Artificial sequence
  synthetic polynucleotide sequence
cgggcatcaacaggctca

SEQ ID NO: 923 - DNA, 18 bp, Artificial sequence
  synthetic polynucleotide sequence
cggttgcgagatcggcaa

SEQ ID NO: 924 - DNA, 18 bp, Artificial sequence
  synthetic polynucleotide sequence
tcaggaaggactgcacca

SEQ ID NO: 925 - DNA, 18 bp, Artificial sequence
  synthetic polynucleotide sequence
ccctggagccaggacaga

SEQ ID NO: 926 - DNA, 18 bp, Artificial sequence
  synthetic polynucleotide sequence
tcagctccaccaggctca

SEQ ID NO: 927 - DNA, 18 bp, Artificial sequence
  synthetic polynucleotide sequence
ccaatggcacagccggca

SEQ ID NO: 928 - DNA, 18 bp, Artificial sequence
  synthetic polynucleotide sequence
gttgacggcatagccgga

SEQ ID NO: 929 - DNA, 18 bp, Artificial sequence
  synthetic polynucleotide sequence
cgtatgaagaccacggga

SEQ ID NO: 930 - DNA, 18 bp, Artificial sequence
  synthetic polynucleotide sequence
gttggcagggctcacaga

SEQ ID NO: 931 - DNA, 18 bp, Artificial sequence
  synthetic polynucleotide sequence
acccagctcgagacctga

SEQ ID NO: 932 - DNA, 18 bp, Artificial sequence
  synthetic polynucleotide sequence
aagggcccactacaggaa

SEQ ID NO: 933 - DNA, 18 bp, Artificial sequence
  synthetic polynucleotide sequence
ggcactgggaacgccaca

SEQ ID NO: 934 - DNA, 18 bp, Artificial sequence
  synthetic polynucleotide sequence
ccttcaccaggcccgaga

SEQ ID NO: 935 - DNA, 18 bp, Artificial sequence
  synthetic polynucleotide sequence
cccacctggtacaggcaa

SEQ ID NO: 936 - DNA, 18 bp, Artificial sequence
  synthetic polynucleotide sequence
ctccatgaccaagacgca

SEQ ID NO: 937 - DNA, 18 bp, Artificial sequence
  synthetic polynucleotide sequence
acagcgcaggcaagagca

SEQ ID NO: 938 - DNA, 18 bp, Artificial sequence
  synthetic polynucleotide sequence
gagacagggtagacggca

SEQ ID NO: 939 - DNA, 18 bp, Artificial sequence
  synthetic polynucleotide sequence
gcaacggtcactccccaa

SEQ ID NO: 940 - DNA, 18 bp, Artificial sequence
  synthetic polynucleotide sequence
gcgctgagtaggcaggca

SEQ ID NO: 941 - DNA, 18 bp, Artificial sequence
  synthetic polynucleotide sequence
gcccaccgcagttggaga

SEQ ID NO: 942 - DNA, 18 bp, Artificial sequence
  synthetic polynucleotide sequence
cgcgtttaggaggagaca

SEQ ID NO: 943 - DNA, 18 bp, Artificial sequence
  synthetic polynucleotide sequence
cagctgtggcaagaccca

SEQ ID NO: 944 - DNA, 18 bp, Artificial sequence
  synthetic polynucleotide sequence
cgggactgcagtacagga

SEQ ID NO: 945 - DNA, 18 bp, Artificial sequence
  synthetic polynucleotide sequence
cgacatgacagtcgacga

SEQ ID NO: 946 - DNA, 18 bp, Artificial sequence
  synthetic polynucleotide sequence
cattgggctgcccagcaa

SEQ ID NO: 947 - DNA, 18 bp, Artificial sequence
  synthetic polynucleotide sequence
ggtgtggggaaaagtcca

SEQ ID NO: 948 - DNA, 19 bp, Artificial sequence
  synthetic polynucleotide sequence
aacagctgtgaggatcaca

SEQ ID NO: 949 - DNA, 18 bp, Artificial sequence
  synthetic polynucleotide sequence
cagagagcgtgtgaacga

SEQ ID NO: 950 - DNA, 18 bp, Artificial sequence
  synthetic polynucleotide sequence
ggaggacagcatcccgga

SEQ ID NO: 951 - DNA, 18 bp, Artificial sequence
  synthetic polynucleotide sequence
taggggagatagtcacca

SEQ ID NO: 952 - DNA, 18 bp, Artificial sequence
  synthetic polynucleotide sequence
ttgaccaccaacatccca

SEQ ID NO: 953 - DNA, 18 bp, Artificial sequence
  synthetic polynucleotide sequence
gggagatgagggacgcca

SEQ ID NO: 954 - DNA, 18 bp, Artificial sequence
  synthetic polynucleotide sequence
gcacaggagggctgcaca

SEQ ID NO: 955 - DNA, 18 bp, Artificial sequence
  synthetic polynucleotide sequence
gcttcaccactggagcca

SEQ ID NO: 956 - DNA, 18 bp, Artificial sequence
  synthetic polynucleotide sequence
gccaactgagagacccca

SEQ ID NO: 957 - DNA, 18 bp, Artificial sequence
  synthetic polynucleotide sequence
gcatgcaagtcggaggaa

SEQ ID NO: 958 - DNA, 18 bp, Artificial sequence
  synthetic polynucleotide sequence
tgcttgagaggcgagcga

SEQ ID NO: 959 - DNA, 18 bp, Artificial sequence
  synthetic polynucleotide sequence
gggaggaggtccagcaga

SEQ ID NO: 960 - DNA, 18 bp, Artificial sequence
  synthetic polynucleotide sequence
acagcacgaagttcagga

SEQ ID NO: 961 - DNA, 18 bp, Artificial sequence
  synthetic polynucleotide sequence
gtgagaccagctcgcaga

SEQ ID NO: 962 - DNA, 18 bp, Artificial sequence
  synthetic polynucleotide sequence
ggacacagcacacagcca

SEQ ID NO: 963 - DNA, 18 bp, Artificial sequence
  synthetic polynucleotide sequence
ggtctctcagaaacccaa

SEQ ID NO: 964 - DNA, 18 bp, Artificial sequence
  synthetic polynucleotide sequence
gccagtcgactagctgca

SEQ ID NO: 965 - DNA, 18 bp, Artificial sequence
  synthetic polynucleotide sequence
tgagaagctgcggggaga

SEQ ID NO: 966 - DNA, 18 bp, Artificial sequence
  synthetic polynucleotide sequence
aagtaggcggacacagca

SEQ ID NO: 967 - DNA, 18 bp, Artificial sequence
  synthetic polynucleotide sequence
ggctggcaaggtggcaga

SEQ ID NO: 968 - DNA, 18 bp, Artificial sequence
  synthetic polynucleotide sequence
agtgtgagcatccaccca

SEQ ID NO: 969 - DNA, 18 bp, Artificial sequence
  synthetic polynucleotide sequence
gggggactaacctatcga

SEQ ID NO: 970 - DNA, 18 bp, Artificial sequence
  synthetic polynucleotide sequence
gaggtggccaactgagga

SEQ ID NO: 971 - DNA, 18 bp, Artificial sequence
  synthetic polynucleotide sequence
atcccaggccagacccga

SEQ ID NO: 972 - DNA, 18 bp, Artificial sequence
  synthetic polynucleotide sequence
cacggatacacggctcga

SEQ ID NO: 973 - DNA, 18 bp, Artificial sequence
  synthetic polynucleotide sequence
cgccaaatcgtgacacca

SEQ ID NO: 974 - DNA, 19 bp, Artificial sequence
  synthetic polynucleotide sequence
cgcagaagggtaggtccaa

SEQ ID NO: 975 - DNA, 18 bp, Artificial sequence
  synthetic polynucleotide sequence
aggaggtcaccagggaca

SEQ ID NO: 976 - DNA, 18 bp, Artificial sequence
  synthetic polynucleotide sequence
gatgggcacctccaggga

SEQ ID NO: 977 - DNA, 18 bp, Artificial sequence
  synthetic polynucleotide sequence
taaggcaggggaagggca

SEQ ID NO: 978 - DNA, 18 bp, Artificial sequence
  synthetic polynucleotide sequence
accctggcagggaaggga

SEQ ID NO: 979 - DNA, 18 bp, Artificial sequence
  synthetic polynucleotide sequence
tcaggaggcagacagcca

SEQ ID NO: 980 - DNA, 18 bp, Artificial sequence
  synthetic polynucleotide sequence
tgcaggaaggccagcaga

SEQ ID NO: 981 - DNA, 18 bp, Artificial sequence
  synthetic polynucleotide sequence
gtggaaacctggccacca

SEQ ID NO: 982 - DNA, 18 bp, Artificial sequence
  synthetic polynucleotide sequence
ccgcaatgaactggcgga

SEQ ID NO: 983 - DNA, 18 bp, Artificial sequence
  synthetic polynucleotide sequence
tcgagcgggagactgcaa

SEQ ID NO: 984 - DNA, 18 bp, Artificial sequence
  synthetic polynucleotide sequence
gtggagcatggacccgta

SEQ ID NO: 985 - DNA, 18 bp, Artificial sequence
  synthetic polynucleotide sequence
cccagtgcactccaggaa

SEQ ID NO: 986 - DNA, 18 bp, Artificial sequence
  synthetic polynucleotide sequence
gacaggagcgagagggta

SEQ ID NO: 987 - DNA, 18 bp, Artificial sequence
  synthetic polynucleotide sequence
gtggagacctcagcgaga

SEQ ID NO: 988 - DNA, 18 bp, Artificial sequence
  synthetic polynucleotide sequence
tcacaatgcgactcacca

SEQ ID NO: 989 - DNA, 18 bp, Artificial sequence
  synthetic polynucleotide sequence
gacgcaggaacttgagga

SEQ ID NO: 990 - DNA, 18 bp, Artificial sequence
  synthetic polynucleotide sequence
tcgtcatgggaacgggca

SEQ ID NO: 991 - DNA, 18 bp, Artificial sequence
  synthetic polynucleotide sequence
ccctctggacacagacga

SEQ ID NO: 992 - DNA, 18 bp, Artificial sequence
  synthetic polynucleotide sequence
aaggccctggcggacaga

SEQ ID NO: 993 - DNA, 18 bp, Artificial sequence
  synthetic polynucleotide sequence
gagcccaattcctgccaa

SEQ ID NO: 994 - DNA, 18 bp, Artificial sequence
  synthetic polynucleotide sequence
agcttgagcagcactgca

SEQ ID NO: 995 - DNA, 18 bp, Artificial sequence
  synthetic polynucleotide sequence
cagacccccttctcacca

SEQ ID NO: 996 - DNA, 18 bp, Artificial sequence
  synthetic polynucleotide sequence
gcctggccacgatggaga

SEQ ID NO: 997 - DNA, 18 bp, Artificial sequence
  synthetic polynucleotide sequence
gagagatagtgtccggca

SEQ ID NO: 998 - DNA, 18 bp, Artificial sequence
  synthetic polynucleotide sequence
cctcctccacgggggtca

SEQ ID NO: 999 - DNA, 18 bp, Artificial sequence
  synthetic polynucleotide sequence
agatccgaaagcccccaa

SEQ ID NO: 1000 - DNA, 18 bp, Artificial sequence
  synthetic polynucleotide sequence
cgaggtccatagctgcca

SEQ ID NO: 1001 - DNA, 18 bp, Artificial sequence
  synthetic polynucleotide sequence
cggtggaggaagcgccga

SEQ ID NO: 1002 - DNA, 18 bp, Artificial sequence
  synthetic polynucleotide sequence
ccagtcctggcagatgca

SEQ ID NO: 1003 - DNA, 18 bp, Artificial sequence
  synthetic polynucleotide sequence
gcacttccgagtggagga

SEQ ID NO: 1004 - DNA, 18 bp, Artificial sequence
  synthetic polynucleotide sequence
agctggagccgtgagaca

SEQ ID NO: 1005 - DNA, 18 bp, Artificial sequence
  synthetic polynucleotide sequence
gggctcctcagacagcaa

SEQ ID NO: 1006 - DNA, 18 bp, Artificial sequence
  synthetic polynucleotide sequence
ccagcttggaggtgcaga

SEQ ID NO: 1007 - DNA, 18 bp, Artificial sequence
  synthetic polynucleotide sequence
cacttaccctgcagccca

SEQ ID NO: 1008 - DNA, 18 bp, Artificial sequence
  synthetic polynucleotide sequence
cagcgctgctggaccaga

SEQ ID NO: 1009 - DNA, 18 bp, Artificial sequence
  synthetic polynucleotide sequence
aggcttacctgcggcgaa

SEQ ID NO: 1010 - DNA, 18 bp, Artificial sequence
  synthetic polynucleotide sequence
gaccctccacctcacgga

SEQ ID NO: 1011 - DNA, 18 bp, Artificial sequence
  synthetic polynucleotide sequence
caccaccgggagcagaga

SEQ ID NO: 1012 - DNA, 18 bp, Artificial sequence
  synthetic polynucleotide sequence
gctcacagtcgaggctga

SEQ ID NO: 1013 - DNA, 18 bp, Artificial sequence
  synthetic polynucleotide sequence
ccaaaagccgtcaaagga

SEQ ID NO: 1014 - DNA, 18 bp, Artificial sequence
  synthetic polynucleotide sequence
acctccacagtactcaga

SEQ ID NO: 1015 - DNA, 18 bp, Artificial sequence
  synthetic polynucleotide sequence
gcaggaatgggtggagca

SEQ ID NO: 1016 - DNA, 18 bp, Artificial sequence
  synthetic polynucleotide sequence
ggaggggagggtatgaga

SEQ ID NO: 1017 - DNA, 18 bp, Artificial sequence
  synthetic polynucleotide sequence
acccccacctcagcgaga

SEQ ID NO: 1018 - DNA, 18 bp, Artificial sequence
  synthetic polynucleotide sequence
atctgctgcaagaggcga

SEQ ID NO: 1019 - DNA, 18 bp, Artificial sequence
  synthetic polynucleotide sequence
gcagccaaggagagcaga

SEQ ID NO: 1020 - DNA, 18 bp, Artificial sequence
  synthetic polynucleotide sequence
cctgagcgagactgagca

SEQ ID NO: 1021 - DNA, 18 bp, Artificial sequence
  synthetic polynucleotide sequence
tgagcagcatgaccccca

SEQ ID NO: 1022 - DNA, 18 bp, Artificial sequence
  synthetic polynucleotide sequence
agggagagctggaagcca

SEQ ID NO: 1023 - DNA, 18 bp, Artificial sequence
  synthetic polynucleotide sequence
gctcacggaaatgggaga

SEQ ID NO: 1024 - DNA, 18 bp, Artificial sequence
  synthetic polynucleotide sequence
gctagtgcatcagggcca

SEQ ID NO: 1025 - DNA, 18 bp, Artificial sequence
  synthetic polynucleotide sequence
acgaacagaggaaggaga

SEQ ID NO: 1026 - DNA, 18 bp, Artificial sequence
  synthetic polynucleotide sequence
tccgttgcagacaccaca

SEQ ID NO: 1027 - DNA, 18 bp, Artificial sequence
  synthetic polynucleotide sequence
agaaggcagccggcagca

SEQ ID NO: 1028 - DNA, 18 bp, Artificial sequence
  synthetic polynucleotide sequence
ccccagcaacactatcca

SEQ ID NO: 1029 - DNA, 18 bp, Artificial sequence
  synthetic polynucleotide sequence
cgcacaaacctaccggca

SEQ ID NO: 1030 - DNA, 18 bp, Artificial sequence
  synthetic polynucleotide sequence
agacctggaactgggaga

SEQ ID NO: 1031 - DNA, 18 bp, Artificial sequence
  synthetic polynucleotide sequence
gcccacggtgggcaccaa

SEQ ID NO: 1032 - DNA, 18 bp, Artificial sequence
  synthetic polynucleotide sequence
gagagctgggtggggtca

SEQ ID NO: 1033 - DNA, 18 bp, Artificial sequence
  synthetic polynucleotide sequence
ccgagtctggcagatcca

SEQ ID NO: 1034 - DNA, 18 bp, Artificial sequence
  synthetic polynucleotide sequence
cagacccagttcatgcca

SEQ ID NO: 1035 - DNA, 18 bp, Artificial sequence
  synthetic polynucleotide sequence
gaagaacagctgcaagga

SEQ ID NO: 1036 - DNA, 18 bp, Artificial sequence
  synthetic polynucleotide sequence
aacgccggacagaacaga

SEQ ID NO: 1037 - DNA, 18 bp, Artificial sequence
  synthetic polynucleotide sequence
ctgggacattgggggaca

SEQ ID NO: 1038 - DNA, 18 bp, Artificial sequence
  synthetic polynucleotide sequence
cctggtcagcagcatcca

SEQ ID NO: 1039 - DNA, 18 bp, Artificial sequence
  synthetic polynucleotide sequence
gggcttcaacatgaggaa

SEQ ID NO: 1040 - DNA, 18 bp, Artificial sequence
  synthetic polynucleotide sequence
tgcaataccgctcccaca

SEQ ID NO: 1041 - DNA, 18 bp, Artificial sequence
  synthetic polynucleotide sequence
tagcccaacctcccagca

SEQ ID NO: 1042 - DNA, 18 bp, Artificial sequence
  synthetic polynucleotide sequence
tcctcaccagcctcacca

SEQ ID NO: 1043 - DNA, 18 bp, Artificial sequence
  synthetic polynucleotide sequence
acagtggcagggccagca

SEQ ID NO: 1044 - DNA, 18 bp, Artificial sequence
  synthetic polynucleotide sequence
gatctcccagcatggaca

SEQ ID NO: 1045 - DNA, 18 bp, Artificial sequence
  synthetic polynucleotide sequence
cagcaggaacccagcaga

SEQ ID NO: 1046 - DNA, 18 bp, Artificial sequence
  synthetic polynucleotide sequence
gcccgtggaagaagagga

SEQ ID NO: 1047 - DNA, 18 bp, Artificial sequence
  synthetic polynucleotide sequence
caggctcaggagaaccca

SEQ ID NO: 1048 - DNA, 18 bp, Artificial sequence
  synthetic polynucleotide sequence
agtcaacagggccaccca

SEQ ID NO: 1049 - DNA, 18 bp, Artificial sequence
  synthetic polynucleotide sequence
gccatgactgctgcccaa

SEQ ID NO: 1050 - DNA, 18 bp, Artificial sequence
  synthetic polynucleotide sequence
cggaagcgttccatggca

SEQ ID NO: 1051 - DNA, 18 bp, Artificial sequence
  synthetic polynucleotide sequence
ccaaaagccaaggtgaga

SEQ ID NO: 1052 - DNA, 18 bp, Artificial sequence
  synthetic polynucleotide sequence
aaccaggctctccaggaa

SEQ ID NO: 1053 - DNA, 18 bp, Artificial sequence
  synthetic polynucleotide sequence
tgtggacgagcaggagga

SEQ ID NO: 1054 - DNA, 18 bp, Artificial sequence
  synthetic polynucleotide sequence
gagttccgcaaggctgca

SEQ ID NO: 1055 - DNA, 18 bp, Artificial sequence
  synthetic polynucleotide sequence
aagggtcactcccagcca

SEQ ID NO: 1056 - DNA, 18 bp, Artificial sequence
  synthetic polynucleotide sequence
gctgacatcactgggaca

SEQ ID NO: 1057 - DNA, 18 bp, Artificial sequence
  synthetic polynucleotide sequence
gacccccttcctagccaa

SEQ ID NO: 1058 - DNA, 18 bp, Artificial sequence
  synthetic polynucleotide sequence
acagggtgctagaggcca

SEQ ID NO: 1059 - DNA, 18 bp, Artificial sequence
  synthetic polynucleotide sequence
cgtgaaggagggtgccaa

SEQ ID NO: 1060 - DNA, 18 bp, Artificial sequence
  synthetic polynucleotide sequence
cgcctcgagacaccacca

SEQ ID NO: 1061 - DNA, 18 bp, Artificial sequence
  synthetic polynucleotide sequence
cccgtcctacccagacga

SEQ ID NO: 1062 - DNA, 18 bp, Artificial sequence
  synthetic polynucleotide sequence
caccagggtccttggaca

SEQ ID NO: 1063 - DNA, 18 bp, Artificial sequence
  synthetic polynucleotide sequence
accgggagctcatccaca

SEQ ID NO: 1064 - DNA, 18 bp, Artificial sequence
  synthetic polynucleotide sequence
ttccacacgtcgaagcca

SEQ ID NO: 1065 - DNA, 18 bp, Artificial sequence
  synthetic polynucleotide sequence
gagtcctgtgccccagca

SEQ ID NO: 1066 - DNA, 18 bp, Artificial sequence
  synthetic polynucleotide sequence
cctcgtggcatgaacaga

SEQ ID NO: 1067 - DNA, 18 bp, Artificial sequence
  synthetic polynucleotide sequence
tgattggcgagcccacga

SEQ ID NO: 1068 - DNA, 18 bp, Artificial sequence
  synthetic polynucleotide sequence
tccccaggagcaagggca

SEQ ID NO: 1069 - DNA, 18 bp, Artificial sequence
  synthetic polynucleotide sequence
gggaagtccagccaagca

SEQ ID NO: 1070 - DNA, 18 bp, Artificial sequence
  synthetic polynucleotide sequence
tgggccagggctaccaca

SEQ ID NO: 1071 - DNA, 18 bp, Artificial sequence
  synthetic polynucleotide sequence
ggtggtaccacctcagca

SEQ ID NO: 1072 - DNA, 18 bp, Artificial sequence
  synthetic polynucleotide sequence
gcacggcggtgttccaga

SEQ ID NO: 1073 - DNA, 18 bp, Artificial sequence
  synthetic polynucleotide sequence
gcatggctaccgaacaca

SEQ ID NO: 1074 - DNA, 18 bp, Artificial sequence
  synthetic polynucleotide sequence
gtccacgcttccacacga

SEQ ID NO: 1075 - DNA, 18 bp, Artificial sequence
  synthetic polynucleotide sequence
gagggctaaaccaagcca

SEQ ID NO: 1076 - DNA, 18 bp, Artificial sequence
  synthetic polynucleotide sequence
gccagccccctcctgtga

SEQ ID NO: 1077 - DNA, 18 bp, Artificial sequence
  synthetic polynucleotide sequence
cctacacaggggccacca

SEQ ID NO: 1078 - DNA, 18 bp, Artificial sequence
  synthetic polynucleotide sequence
gtgcacccaggcaggtga

SEQ ID NO: 1079 - DNA, 18 bp, Artificial sequence
  synthetic polynucleotide sequence
aaggcagtggcccacaga

SEQ ID NO: 1080 - DNA, 18 bp, Artificial sequence
  synthetic polynucleotide sequence
cccacccagataggcgca

SEQ ID NO: 1081 - DNA, 18 bp, Artificial sequence
  synthetic polynucleotide sequence
ctcagcctggccagccta

SEQ ID NO: 1082 - DNA, 18 bp, Artificial sequence
  synthetic polynucleotide sequence
tgacgtccatgaaggaga

SEQ ID NO: 1083 - DNA, 18 bp, Artificial sequence
  synthetic polynucleotide sequence
gctgcagtctgagaccga

SEQ ID NO: 1084 - DNA, 18 bp, Artificial sequence
  synthetic polynucleotide sequence
tgttgagcaccgccacca

SEQ ID NO: 1085 - DNA, 18 bp, Artificial sequence
  synthetic polynucleotide sequence
ctcaacaagctgaccgta

SEQ ID NO: 1086 - DNA, 18 bp, Artificial sequence
  synthetic polynucleotide sequence
tatacaagggtcagggca

SEQ ID NO: 1087 - DNA, 18 bp, Artificial sequence
  synthetic polynucleotide sequence
cctgagcagaggtccaga

SEQ ID NO: 1088 - DNA, 18 bp, Artificial sequence
  synthetic polynucleotide sequence
acacactatctgccacga

SEQ ID NO: 1089 - DNA, 18 bp, Artificial sequence
  synthetic polynucleotide sequence
actacacgtggagcagca

SEQ ID NO: 1090 - DNA, 18 bp, Artificial sequence
  synthetic polynucleotide sequence
tccagccctcggacgcca

SEQ ID NO: 1091 - DNA, 18 bp, Artificial sequence
  synthetic polynucleotide sequence
tgctgaaacatggaggca

SEQ ID NO: 1092 - DNA, 18 bp, Artificial sequence
  synthetic polynucleotide sequence
aacagcaccgacgcccca

SEQ ID NO: 1093 - DNA, 18 bp, Artificial sequence
  synthetic polynucleotide sequence
cactacggcagggactca

SEQ ID NO: 1094 - DNA, 18 bp, Artificial sequence
  synthetic polynucleotide sequence
gatcacggcgtatcgcaa

SEQ ID NO: 1095 - DNA, 18 bp, Artificial sequence
  synthetic polynucleotide sequence
cagtggccaggacagcca

SEQ ID NO: 1096 - DNA, 18 bp, Artificial sequence
  synthetic polynucleotide sequence
ctggaggcaccagctcca

SEQ ID NO: 1097 - DNA, 18 bp, Artificial sequence
  synthetic polynucleotide sequence
caacgagcgcgagcgcaa

SEQ ID NO: 1098 - DNA, 18 bp, Artificial sequence
  synthetic polynucleotide sequence
gatgtactcgaccgccga

SEQ ID NO: 1099 - DNA, 18 bp, Artificial sequence
  synthetic polynucleotide sequence
cgcctactcgtcggacga

SEQ ID NO: 1100 - DNA, 18 bp, Artificial sequence
  synthetic polynucleotide sequence
accagctggagaagtcga

SEQ ID NO: 1101 - DNA, 18 bp, Artificial sequence
  synthetic polynucleotide sequence
ggccatagagacccagga

SEQ ID NO: 1102 - DNA, 18 bp, Artificial sequence
  synthetic polynucleotide sequence
tgcagccagggagcccca

SEQ ID NO: 1103 - DNA, 18 bp, Artificial sequence
  synthetic polynucleotide sequence
acgggacggactacgaga

SEQ ID NO: 1104 - DNA, 18 bp, Artificial sequence
  synthetic polynucleotide sequence
ggtagggcctctggcaga

SEQ ID NO: 1105 - DNA, 18 bp, Artificial sequence
  synthetic polynucleotide sequence
ggctgtcactcagccaga

SEQ ID NO: 1106 - DNA, 18 bp, Artificial sequence
  synthetic polynucleotide sequence
ctcacacacccagcggta

SEQ ID NO: 1107 - DNA, 18 bp, Artificial sequence
  synthetic polynucleotide sequence
caaaggcaggccaggaca

SEQ ID NO: 1108 - DNA, 18 bp, Artificial sequence
  synthetic polynucleotide sequence
acgacagcctgaagggga

SEQ ID NO: 1109 - DNA, 18 bp, Artificial sequence
  synthetic polynucleotide sequence
acctggtccgcaaaggga

SEQ ID NO: 1110 - DNA, 18 bp, Artificial sequence
  synthetic polynucleotide sequence
acagctggttgagggcga

SEQ ID NO: 1111 - DNA, 18 bp, Artificial sequence
  synthetic polynucleotide sequence
tgctagaaaggtggcaga

SEQ ID NO: 1112 - DNA, 18 bp, Artificial sequence
  synthetic polynucleotide sequence
ggagaaggagccttgtga

SEQ ID NO: 1113 - DNA, 18 bp, Artificial sequence
  synthetic polynucleotide sequence
tggcccagagtggagcaa

SEQ ID NO: 1114 - DNA, 18 bp, Artificial sequence
  synthetic polynucleotide sequence
agcaagacttgcacagca

SEQ ID NO: 1115 - DNA, 18 bp, Artificial sequence
  synthetic polynucleotide sequence
cagtcctggacgaccaca

SEQ ID NO: 1116 - DNA, 18 bp, Artificial sequence
  synthetic polynucleotide sequence
gcagatggggagatggca

SEQ ID NO: 1117 - DNA, 18 bp, Artificial sequence
  synthetic polynucleotide sequence
ccgccactgcatcgccaa

SEQ ID NO: 1118 - DNA, 18 bp, Artificial sequence
  synthetic polynucleotide sequence
acacctggcccttgagga

SEQ ID NO: 1119 - DNA, 18 bp, Artificial sequence
  synthetic polynucleotide sequence
ggtcccatgcccacagca

SEQ ID NO: 1120 - DNA, 18 bp, Artificial sequence
  synthetic polynucleotide sequence
cctcccgcactggaacca

SEQ ID NO: 1121 - DNA, 18 bp, Artificial sequence
  synthetic polynucleotide sequence
gcctggaacctgacacca

SEQ ID NO: 1122 - DNA, 18 bp, Artificial sequence
  synthetic polynucleotide sequence
atcatccaccacggggca

SEQ ID NO: 1123 - DNA, 18 bp, Artificial sequence
  synthetic polynucleotide sequence
ccctgggtgatcagagca

SEQ ID NO: 1124 - DNA, 18 bp, Artificial sequence
  synthetic polynucleotide sequence
ggagtctgtaccccacca

SEQ ID NO: 1125 - DNA, 18 bp, Artificial sequence
  synthetic polynucleotide sequence
agttgcccaggaaactga

SEQ ID NO: 1126 - DNA, 18 bp, Artificial sequence
  synthetic polynucleotide sequence
gctgttgaacaggccgaa

SEQ ID NO: 1127 - DNA, 18 bp, Artificial sequence
  synthetic polynucleotide sequence
gtacggtcaagcaggcaa

SEQ ID NO: 1128 - DNA, 18 bp, Artificial sequence
  synthetic polynucleotide sequence
tcgtagcaccaatgacca

SEQ ID NO: 1129 - DNA, 18 bp, Artificial sequence
  synthetic polynucleotide sequence
ggaggcgttatccccaga

SEQ ID NO: 1130 - DNA, 18 bp, Artificial sequence
  synthetic polynucleotide sequence
gtgcatgccctgaagaca

SEQ ID NO: 1131 - DNA, 18 bp, Artificial sequence
  synthetic polynucleotide sequence
gaaagctgctgcgctgga

SEQ ID NO: 1132 - DNA, 18 bp, Artificial sequence
  synthetic polynucleotide sequence
gtcctcatgaacacagca

SEQ ID NO: 1133 - DNA, 18 bp, Artificial sequence
  synthetic polynucleotide sequence
cccaagagagcagaggga

SEQ ID NO: 1134 - DNA, 18 bp, Artificial sequence
  synthetic polynucleotide sequence
ggggcagaggcgcaagga

SEQ ID NO: 1135 - DNA, 18 bp, Artificial sequence
  synthetic polynucleotide sequence
cctctgatggacagcaga

SEQ ID NO: 1136 - DNA, 18 bp, Artificial sequence
  synthetic polynucleotide sequence
tgagaggtgagagtcaca

SEQ ID NO: 1137 - DNA, 18 bp, Artificial sequence
  synthetic polynucleotide sequence
aggcagaagctgtagcca

SEQ ID NO: 1138 - DNA, 18 bp, Artificial sequence
  synthetic polynucleotide sequence
aggaaggagccataacga

SEQ ID NO: 1139 - DNA, 18 bp, Artificial sequence
  synthetic polynucleotide sequence
caagaacgagaagcagca

SEQ ID NO: 1140 - DNA, 18 bp, Artificial sequence
  synthetic polynucleotide sequence
ccattctgagcccggaca

SEQ ID NO: 1141 - DNA, 18 bp, Artificial sequence
  synthetic polynucleotide sequence
cccagacggtgaacccaa

SEQ ID NO: 1142 - DNA, 18 bp, Artificial sequence
  synthetic polynucleotide sequence
ggacaggacccctgggga

SEQ ID NO: 1143 - DNA, 18 bp, Artificial sequence
  synthetic polynucleotide sequence
gaggtaccgccagcggaa

SEQ ID NO: 1144 - DNA, 18 bp, Artificial sequence
  synthetic polynucleotide sequence
gatctcgcgctccacgga

SEQ ID NO: 1145 - DNA, 18 bp, Artificial sequence
  synthetic polynucleotide sequence
gccattggcaaagcagca

SEQ ID NO: 1146 - DNA, 18 bp, Artificial sequence
  synthetic polynucleotide sequence
gtgtgactcccccagcaa

SEQ ID NO: 1147 - DNA, 18 bp, Artificial sequence
  synthetic polynucleotide sequence
gtgccaacaagtggacca

SEQ ID NO: 1148 - DNA, 18 bp, Artificial sequence
  synthetic polynucleotide sequence
acctgccgaacagcagga

SEQ ID NO: 1149 - DNA, 18 bp, Artificial sequence
  synthetic polynucleotide sequence
ccagaaccaccagcacca

SEQ ID NO: 1150 - DNA, 18 bp, Artificial sequence
  synthetic polynucleotide sequence
caagtcagggcaatgcca

SEQ ID NO: 1151 - DNA, 18 bp, Artificial sequence
  synthetic polynucleotide sequence
cgcaacaggaacatccaa

SEQ ID NO: 1152 - DNA, 18 bp, Artificial sequence
  synthetic polynucleotide sequence
agaggtagattcagccca

SEQ ID NO: 1153 - DNA, 18 bp, Artificial sequence
  synthetic polynucleotide sequence
gaaccatccaaggactca

SEQ ID NO: 1154 - DNA, 18 bp, Artificial sequence
  synthetic polynucleotide sequence
ggtctggggaaggagcaa

SEQ ID NO: 1155 - DNA, 18 bp, Artificial sequence
  synthetic polynucleotide sequence
ctggaggcatggaccgca

SEQ ID NO: 1156 - DNA, 18 bp, Artificial sequence
  synthetic polynucleotide sequence
cctgagacaatccgcgca

SEQ ID NO: 1157 - DNA, 18 bp, Artificial sequence
  synthetic polynucleotide sequence
ccgcatgagcatcgcgga

SEQ ID NO: 1158 - DNA, 18 bp, Artificial sequence
  synthetic polynucleotide sequence
ctagggacaggttcagga

SEQ ID NO: 1159 - DNA, 18 bp, Artificial sequence
  synthetic polynucleotide sequence
gttgcacacactaggaga

SEQ ID NO: 1160 - DNA, 18 bp, Artificial sequence
  synthetic polynucleotide sequence
tcactcagccactgcaga

SEQ ID NO: 1161 - DNA, 18 bp, Artificial sequence
  synthetic polynucleotide sequence
tgccagcagcagtgacga

SEQ ID NO: 1162 - DNA, 18 bp, Artificial sequence
  synthetic polynucleotide sequence
aatgccaggctgacggga

SEQ ID NO: 1163 - DNA, 18 bp, Artificial sequence
  synthetic polynucleotide sequence
ccgccatgacctggagca

SEQ ID NO: 1164 - DNA, 18 bp, Artificial sequence
  synthetic polynucleotide sequence
ccgtgcacccgaagacca

SEQ ID NO: 1165 - DNA, 18 bp, Artificial sequence
  synthetic polynucleotide sequence
gtacacactgcagcccaa

SEQ ID NO: 1166 - DNA, 18 bp, Artificial sequence
  synthetic polynucleotide sequence
ggaattccaacagcagca

SEQ ID NO: 1167 - DNA, 18 bp, Artificial sequence
  synthetic polynucleotide sequence
ggaccagcttgaagctga

SEQ ID NO: 1168 - DNA, 18 bp, Artificial sequence
  synthetic polynucleotide sequence
ggccaatgaagccagtca

SEQ ID NO: 1169 - DNA, 18 bp, Artificial sequence
  synthetic polynucleotide sequence
ccgatggcaaggagagga

SEQ ID NO: 1170 - DNA, 18 bp, Artificial sequence
  synthetic polynucleotide sequence
cttcgctgagagagggga

SEQ ID NO: 1171 - DNA, 18 bp, Artificial sequence
  synthetic polynucleotide sequence
cccagaggccctgagaga

SEQ ID NO: 1172 - DNA, 18 bp, Artificial sequence
  synthetic polynucleotide sequence
ggcgtagggacagccgca

SEQ ID NO: 1173 - DNA, 18 bp, Artificial sequence
  synthetic polynucleotide sequence
ccctctgcacgagaacga

SEQ ID NO: 1174 - DNA, 18 bp, Artificial sequence
  synthetic polynucleotide sequence
tgctgacatcggggcaga

SEQ ID NO: 1175 - DNA, 18 bp, Artificial sequence
  synthetic polynucleotide sequence
aactggccatcctgagga

SEQ ID NO: 1176 - DNA, 18 bp, Artificial sequence
  synthetic polynucleotide sequence
tgcgggtgcagcgctgca

SEQ ID NO: 1177 - DNA, 18 bp, Artificial sequence
  synthetic polynucleotide sequence
ctgagcacagcatggaca

SEQ ID NO: 1178 - DNA, 18 bp, Artificial sequence
  synthetic polynucleotide sequence
tggaagccagcgggagga

SEQ ID NO: 1179 - DNA, 18 bp, Artificial sequence
  synthetic polynucleotide sequence
gaggaataccggccacga

SEQ ID NO: 1180 - DNA, 18 bp, Artificial sequence
  synthetic polynucleotide sequence
caatgcccaggtggagca

SEQ ID NO: 1181 - DNA, 18 bp, Artificial sequence
  synthetic polynucleotide sequence
cagcctcatggagcagca

SEQ ID NO: 1182 - DNA, 18 bp, Artificial sequence
  synthetic polynucleotide sequence
tgaacacgcgccagcgca

SEQ ID NO: 1183 - DNA, 18 bp, Artificial sequence
  synthetic polynucleotide sequence
gatgccagcatcgcagca

SEQ ID NO: 1184 - DNA, 18 bp, Artificial sequence
  synthetic polynucleotide sequence
taggccaggatgagggca

SEQ ID NO: 1185 - DNA, 18 bp, Artificial sequence
  synthetic polynucleotide sequence
atccctccaggcagccaa

SEQ ID NO: 1186 - DNA, 18 bp, Artificial sequence
  synthetic polynucleotide sequence
cagctgccaggtcacaga

SEQ ID NO: 1187 - DNA, 18 bp, Artificial sequence
  synthetic polynucleotide sequence
agacagctacgggcagca

SEQ ID NO: 1188 - DNA, 18 bp, Artificial sequence
  synthetic polynucleotide sequence
gatgaccaagtcggccca

SEQ ID NO: 1189 - DNA, 18 bp, Artificial sequence
  synthetic polynucleotide sequence
cgctctgaagaaggccga

SEQ ID NO: 1190 - DNA, 18 bp, Artificial sequence
  synthetic polynucleotide sequence
cctgtgacgatggaggca

SEQ ID NO: 1191 - DNA, 18 bp, Artificial sequence
  synthetic polynucleotide sequence
gtgcactggcaagcgaga

SEQ ID NO: 1192 - DNA, 18 bp, Artificial sequence
  synthetic polynucleotide sequence
cggccagcaggggctgca

SEQ ID NO: 1193 - DNA, 18 bp, Artificial sequence
  synthetic polynucleotide sequence
gagcctggccgagtggaa

SEQ ID NO: 1194 - DNA, 18 bp, Artificial sequence
  synthetic polynucleotide sequence
atgagaagagtgcagcca

SEQ ID NO: 1195 - DNA, 18 bp, Artificial sequence
  synthetic polynucleotide sequence
gggcttcaacccaccaga

SEQ ID NO: 1196 - DNA, 18 bp, Artificial sequence
  synthetic polynucleotide sequence
acggtggctgcacccaca

SEQ ID NO: 1197 - DNA, 18 bp, Artificial sequence
  synthetic polynucleotide sequence
ccccggaacccaaaggaa

SEQ ID NO: 1198 - DNA, 18 bp, Artificial sequence
  synthetic polynucleotide sequence
cttggaccaccgtcagca

SEQ ID NO: 1199 - DNA, 18 bp, Artificial sequence
  synthetic polynucleotide sequence
tgtctcagaccaacgcca

SEQ ID NO: 1200 - DNA, 18 bp, Artificial sequence
  synthetic polynucleotide sequence
cagttccagcaataccca

SEQ ID NO: 1201 - DNA, 18 bp, Artificial sequence
  synthetic polynucleotide sequence
ggctcatccgcaacgaga

SEQ ID NO: 1202 - DNA, 18 bp, Artificial sequence
  synthetic polynucleotide sequence
tgggagaagatcgcgcca

SEQ ID NO: 1203 - DNA, 18 bp, Artificial sequence
  synthetic polynucleotide sequence
acctcctcgcaactggaa

SEQ ID NO: 1204 - DNA, 18 bp, Artificial sequence
  synthetic polynucleotide sequence
ctcgtagctcacgccaga

SEQ ID NO: 1205 - DNA, 18 bp, Artificial sequence
  synthetic polynucleotide sequence
ccctcaacgccatgcaga

SEQ ID NO: 1206 - DNA, 18 bp, Artificial sequence
  synthetic polynucleotide sequence
aggatggtgtcccgcaca

SEQ ID NO: 1207 - DNA, 18 bp, Artificial sequence
  synthetic polynucleotide sequence
ccaaggccattgcagcca

SEQ ID NO: 1208 - DNA, 18 bp, Artificial sequence
  synthetic polynucleotide sequence
acctggtctacgggcaca

SEQ ID NO: 1209 - DNA, 18 bp, Artificial sequence
  synthetic polynucleotide sequence
ccagccccactacagcaa

SEQ ID NO: 1210 - DNA, 18 bp, Artificial sequence
  synthetic polynucleotide sequence
ccgccatgaccttgcaca

SEQ ID NO: 1211 - DNA, 18 bp, Artificial sequence
  synthetic polynucleotide sequence
aaccagggctatgaagca

SEQ ID NO: 1212 - DNA, 18 bp, Artificial sequence
  synthetic polynucleotide sequence
tcagttagacgcacgcca

SEQ ID NO: 1213 - DNA, 18 bp, Artificial sequence
  synthetic polynucleotide sequence
gaggacccgtgaaggcaa

SEQ ID NO: 1214 - DNA, 18 bp, Artificial sequence
  synthetic polynucleotide sequence
gcagacacctctgaacca

SEQ ID NO: 1215 - DNA, 18 bp, Artificial sequence
  synthetic polynucleotide sequence
caacgtccggcaggtgga

SEQ ID NO: 1216 - DNA, 18 bp, Artificial sequence
  synthetic polynucleotide sequence
atggaaccgctgctcaca

SEQ ID NO: 1217 - DNA, 17 bp, Artificial sequence
  synthetic polynucleotide sequence
gcccggctgagccgaca

SEQ ID NO: 1218 - DNA, 19 bp, Artificial sequence
  synthetic polynucleotide sequence
cagatctgggagtatcgga

SEQ ID NO: 1219 - DNA, 18 bp, Artificial sequence
  synthetic polynucleotide sequence
tcatacagggcagccaca

SEQ ID NO: 1220 - DNA, 18 bp, Artificial sequence
  synthetic polynucleotide sequence
agataagcccagttccga

SEQ ID NO: 1221 - DNA, 18 bp, Artificial sequence
  synthetic polynucleotide sequence
gacgggagttccagacca

SEQ ID NO: 1222 - DNA, 18 bp, Artificial sequence
  synthetic polynucleotide sequence
agagacgggttcctggca

SEQ ID NO: 1223 - DNA, 18 bp, Artificial sequence
  synthetic polynucleotide sequence
gccgcagcttccaaacca

SEQ ID NO: 1224 - DNA, 18 bp, Artificial sequence
  synthetic polynucleotide sequence
ccagaaccagccacccca

SEQ ID NO: 1225 - DNA, 18 bp, Artificial sequence
  synthetic polynucleotide sequence
ggagagggctctacggta

SEQ ID NO: 1226 - DNA, 18 bp, Artificial sequence
  synthetic polynucleotide sequence
cagaaccagccactccta

SEQ ID NO: 1227 - DNA, 18 bp, Artificial sequence
  synthetic polynucleotide sequence
caaggccaatgtggccaa

SEQ ID NO: 1228 - DNA, 18 bp, Artificial sequence
  synthetic polynucleotide sequence
tcggcatccacctgggca

SEQ ID NO: 1229 - DNA, 18 bp, Artificial sequence
  synthetic polynucleotide sequence
cggtgcggaggtcaggga

SEQ ID NO: 1230 - DNA, 18 bp, Artificial sequence
  synthetic polynucleotide sequence
gtggctccgtaggccaca

SEQ ID NO: 1231 - DNA, 18 bp, Artificial sequence
  synthetic polynucleotide sequence
ggccggaagtagagcgga

SEQ ID NO: 1232 - DNA, 18 bp, Artificial sequence
  synthetic polynucleotide sequence
actgagacggctgaccga

SEQ ID NO: 1233 - DNA, 18 bp, Artificial sequence
  synthetic polynucleotide sequence
cccagtaccagtgaagga

SEQ ID NO: 1234 - DNA, 18 bp, Artificial sequence
  synthetic polynucleotide sequence
taggactgaagtcccgca

SEQ ID NO: 1235 - DNA, 18 bp, Artificial sequence
  synthetic polynucleotide sequence
ctcccacccctgctgaga

SEQ ID NO: 1236 - DNA, 18 bp, Artificial sequence
  synthetic polynucleotide sequence
tcaacacctcagtggcca

SEQ ID NO: 1237 - DNA, 18 bp, Artificial sequence
  synthetic polynucleotide sequence
ggagaggtaccttgcaca

SEQ ID NO: 1238 - DNA, 18 bp, Artificial sequence
  synthetic polynucleotide sequence
gcacaatcattccaccca

SEQ ID NO: 1239 - DNA, 18 bp, Artificial sequence
  synthetic polynucleotide sequence
ggcgtaaagaaactccca

SEQ ID NO: 1240 - DNA, 18 bp, Artificial sequence
  synthetic polynucleotide sequence
cctggccatggtagcgca

SEQ ID NO: 1241 - DNA, 18 bp, Artificial sequence
  synthetic polynucleotide sequence
aggtcacagggcccagca

SEQ ID NO: 1242 - DNA, 18 bp, Artificial sequence
  synthetic polynucleotide sequence
tgagcagccccatccaga

SEQ ID NO: 1243 - DNA, 18 bp, Artificial sequence
  synthetic polynucleotide sequence
aagcgaagaacccagcaa

SEQ ID NO: 1244 - DNA, 18 bp, Artificial sequence
  synthetic polynucleotide sequence
taatcacagccaaggcca

SEQ ID NO: 1245 - DNA, 18 bp, Artificial sequence
  synthetic polynucleotide sequence
gtgaagagcttggcggga

SEQ ID NO: 1246 - DNA, 18 bp, Artificial sequence
  synthetic polynucleotide sequence
caacccagtgtaagcgca

SEQ ID NO: 1247 - DNA, 18 bp, Artificial sequence
  synthetic polynucleotide sequence
gacccagccataccagga

SEQ ID NO: 1248 - DNA, 18 bp, Artificial sequence
  synthetic polynucleotide sequence
ggctgaggatgacaccga

SEQ ID NO: 1249 - DNA, 18 bp, Artificial sequence
  synthetic polynucleotide sequence
ccgatgctcagaacccca

SEQ ID NO: 1250 - DNA, 18 bp, Artificial sequence
  synthetic polynucleotide sequence
attgcgacgatgacccca

SEQ ID NO: 1251 - DNA, 18 bp, Artificial sequence
  synthetic polynucleotide sequence
ggcagtcctcatcgccaa

SEQ ID NO: 1252 - DNA, 18 bp, Artificial sequence
  synthetic polynucleotide sequence
cccacgatgccgatggca

SEQ ID NO: 1253 - DNA, 18 bp, Artificial sequence
  synthetic polynucleotide sequence
ggtcaagaacgtggccga

SEQ ID NO: 1254 - DNA, 18 bp, Artificial sequence
  synthetic polynucleotide sequence
actggttcaggaaggcca

SEQ ID NO: 1255 - DNA, 18 bp, Artificial sequence
  synthetic polynucleotide sequence
ggaaggacgtgcaggcca

SEQ ID NO: 1256 - DNA, 18 bp, Artificial sequence
  synthetic polynucleotide sequence
gcagcagcttccagccca

SEQ ID NO: 1257 - DNA, 18 bp, Artificial sequence
  synthetic polynucleotide sequence
ggagaaaacctgtcagca

SEQ ID NO: 1258 - DNA, 18 bp, Artificial sequence
  synthetic polynucleotide sequence
catctgacaagccaacca

SEQ ID NO: 1259 - DNA, 18 bp, Artificial sequence
  synthetic polynucleotide sequence
accagtacatcgcagaga

SEQ ID NO: 1260 - DNA, 18 bp, Artificial sequence
  synthetic polynucleotide sequence
tctccaggacagcgggga

SEQ ID NO: 1261 - DNA, 18 bp, Artificial sequence
  synthetic polynucleotide sequence
accgcctgcagagggaga

SEQ ID NO: 1262 - DNA, 18 bp, Artificial sequence
  synthetic polynucleotide sequence
gctgcaactgccacggga

SEQ ID NO: 1263 - DNA, 18 bp, Artificial sequence
  synthetic polynucleotide sequence
gaacactgcgtggcccta

SEQ ID NO: 1264 - DNA, 18 bp, Artificial sequence
  synthetic polynucleotide sequence
ccggccacgcactgcaca

SEQ ID NO: 1265 - DNA, 18 bp, Artificial sequence
  synthetic polynucleotide sequence
ggatgggatctgcagcaa

SEQ ID NO: 1266 - DNA, 18 bp, Artificial sequence
  synthetic polynucleotide sequence
tctggctccgggcaggca

SEQ ID NO: 1267 - DNA, 18 bp, Artificial sequence
  synthetic polynucleotide sequence
gttgaaggcggaggagca

SEQ ID NO: 1268 - DNA, 18 bp, Artificial sequence
  synthetic polynucleotide sequence
gatggcatcaagcggcga

SEQ ID NO: 1269 - DNA, 18 bp, Artificial sequence
  synthetic polynucleotide sequence
ccaggatgtgagtgacca

SEQ ID NO: 1270 - DNA, 18 bp, Artificial sequence
  synthetic polynucleotide sequence
cactgaccacaatgacca

SEQ ID NO: 1271 - DNA, 18 bp, Artificial sequence
  synthetic polynucleotide sequence
tggcgctgaccatccaga

SEQ ID NO: 1272 - DNA, 18 bp, Artificial sequence
  synthetic polynucleotide sequence
agaacaccagggaggcga

SEQ ID NO: 1273 - DNA, 18 bp, Artificial sequence
  synthetic polynucleotide sequence
gcattccaggcaaggtga

SEQ ID NO: 1274 - DNA, 18 bp, Artificial sequence
  synthetic polynucleotide sequence
ggactgagcccggttcca

SEQ ID NO: 1275 - DNA, 17 bp, Artificial sequence
  synthetic polynucleotide sequence
gaatgggaggatgggca

SEQ ID NO: 1276 - DNA, 18 bp, Artificial sequence
  synthetic polynucleotide sequence
acacgatcggagcggcca

SEQ ID NO: 1277 - DNA, 18 bp, Artificial sequence
  synthetic polynucleotide sequence
gagattgcaccagcggca

SEQ ID NO: 1278 - DNA, 18 bp, Artificial sequence
  synthetic polynucleotide sequence
aaggaggccacgtaggca

SEQ ID NO: 1279 - DNA, 18 bp, Artificial sequence
  synthetic polynucleotide sequence
ggaagatgatcgccacca

SEQ ID NO: 1280 - DNA, 18 bp, Artificial sequence
  synthetic polynucleotide sequence
ccagctgttgaaccgaca

SEQ ID NO: 1281 - DNA, 18 bp, Artificial sequence
  synthetic polynucleotide sequence
cagaaggctccagcagca

SEQ ID NO: 1282 - DNA, 18 bp, Artificial sequence
  synthetic polynucleotide sequence
gcatcatgaggtgaccca

SEQ ID NO: 1283 - DNA, 18 bp, Artificial sequence
  synthetic polynucleotide sequence
cccttcccaagagcgaga

SEQ ID NO: 1284 - DNA, 18 bp, Artificial sequence
  synthetic polynucleotide sequence
aggccacggactgcacca

SEQ ID NO: 1285 - DNA, 18 bp, Artificial sequence
  synthetic polynucleotide sequence
cccactggacagcagcaa

SEQ ID NO: 1286 - DNA, 18 bp, Artificial sequence
  synthetic polynucleotide sequence
gagggtggagttggcgca

SEQ ID NO: 1287 - DNA, 18 bp, Artificial sequence
  synthetic polynucleotide sequence
cagaaggaggagtcacca

SEQ ID NO: 1288 - DNA, 18 bp, Artificial sequence
  synthetic polynucleotide sequence
ccccagaacttcaaggca

SEQ ID NO: 1289 - DNA, 18 bp, Artificial sequence
  synthetic polynucleotide sequence
gatgaagacggaggacga

SEQ ID NO: 1290 - DNA, 18 bp, Artificial sequence
  synthetic polynucleotide sequence
ttaaggtcagcaccagca

SEQ ID NO: 1291 - DNA, 18 bp, Artificial sequence
  synthetic polynucleotide sequence
catcttccaggaggacca

SEQ ID NO: 1292 - DNA, 18 bp, Artificial sequence
  synthetic polynucleotide sequence
gaactccaaggctccaga

SEQ ID NO: 1293 - DNA, 18 bp, Artificial sequence
  synthetic polynucleotide sequence
agcagcgaacagccacga

SEQ ID NO: 1294 - DNA, 18 bp, Artificial sequence
  synthetic polynucleotide sequence
gcactccaatgcaccaca

SEQ ID NO: 1295 - DNA, 18 bp, Artificial sequence
  synthetic polynucleotide sequence
aacagcgcacagccacga

SEQ ID NO: 1296 - DNA, 18 bp, Artificial sequence
  synthetic polynucleotide sequence
gtgtgcacagaccagcca

SEQ ID NO: 1297 - DNA, 18 bp, Artificial sequence
  synthetic polynucleotide sequence
ggagcggaaggaagacca

SEQ ID NO: 1298 - DNA, 18 bp, Artificial sequence
  synthetic polynucleotide sequence
gaatgcccgtcaccccca

SEQ ID NO: 1299 - DNA, 18 bp, Artificial sequence
  synthetic polynucleotide sequence
tgggagggaggtgacgaa

SEQ ID NO: 1300 - DNA, 18 bp, Artificial sequence
  synthetic polynucleotide sequence
gcagtgtggcagccagca

SEQ ID NO: 1301 - DNA, 18 bp, Artificial sequence
  synthetic polynucleotide sequence
cgacctggagctgagaca

SEQ ID NO: 1302 - DNA, 18 bp, Artificial sequence
  synthetic polynucleotide sequence
gccggactggcagggcga

SEQ ID NO: 1303 - DNA, 18 bp, Artificial sequence
  synthetic polynucleotide sequence
ctttaggcaagcagccca

SEQ ID NO: 1304 - DNA, 18 bp, Artificial sequence
  synthetic polynucleotide sequence
ggaaggactgtggcagga

SEQ ID NO: 1305 - DNA, 18 bp, Artificial sequence
  synthetic polynucleotide sequence
agcaagggtgcagagcaa

SEQ ID NO: 1306 - DNA, 18 bp, Artificial sequence
  synthetic polynucleotide sequence
cggacatgggatcccaga

SEQ ID NO: 1307 - DNA, 18 bp, Artificial sequence
  synthetic polynucleotide sequence
ccaccttagctgccacca

SEQ ID NO: 1308 - DNA, 18 bp, Artificial sequence
  synthetic polynucleotide sequence
gaagaagggagcccagca

SEQ ID NO: 1309 - DNA, 18 bp, Artificial sequence
  synthetic polynucleotide sequence
gcctcaacagctgcacca

SEQ ID NO: 1310 - DNA, 18 bp, Artificial sequence
  synthetic polynucleotide sequence
gtccttggccagggagga

SEQ ID NO: 1311 - DNA, 18 bp, Artificial sequence
  synthetic polynucleotide sequence
gaccaagccagccaccaa

SEQ ID NO: 1312 - DNA, 18 bp, Artificial sequence
  synthetic polynucleotide sequence
ggtcggcaggtatccaga

SEQ ID NO: 1313 - DNA, 18 bp, Artificial sequence
  synthetic polynucleotide sequence
ccaaggctccggaaacca

SEQ ID NO: 1314 - DNA, 18 bp, Artificial sequence
  synthetic polynucleotide sequence
tggagacgagcgggcaga

SEQ ID NO: 1315 - DNA, 18 bp, Artificial sequence
  synthetic polynucleotide sequence
ccagccagaccctaagga

SEQ ID NO: 1316 - DNA, 18 bp, Artificial sequence
  synthetic polynucleotide sequence
aggggttgtggaagggca

SEQ ID NO: 1317 - DNA, 18 bp, Artificial sequence
  synthetic polynucleotide sequence
cactgggctgtccaagca

SEQ ID NO: 1318 - DNA, 18 bp, Artificial sequence
  synthetic polynucleotide sequence
cagagtcccatgggctga

SEQ ID NO: 1319 - DNA, 18 bp, Artificial sequence
  synthetic polynucleotide sequence
ggacaagtacgaggccga

SEQ ID NO: 1320 - DNA, 18 bp, Artificial sequence
  synthetic polynucleotide sequence
gcccttcagctccgagca

SEQ ID NO: 1321 - DNA, 18 bp, Artificial sequence
  synthetic polynucleotide sequence
tgtgacccccgaggacca

SEQ ID NO: 1322 - DNA, 18 bp, Artificial sequence
  synthetic polynucleotide sequence
gagaacaccatcgatcca

SEQ ID NO: 1323 - DNA, 18 bp, Artificial sequence
  synthetic polynucleotide sequence
catccagcagagaatgga

SEQ ID NO: 1324 - DNA, 18 bp, Artificial sequence
  synthetic polynucleotide sequence
tggttcacacggcaggca

SEQ ID NO: 1325 - DNA, 18 bp, Artificial sequence
  synthetic polynucleotide sequence
cccaatgccaagtacgta

SEQ ID NO: 1326 - DNA, 18 bp, Artificial sequence
  synthetic polynucleotide sequence
ataacccaacccactgca

SEQ ID NO: 1327 - DNA, 18 bp, Artificial sequence
  synthetic polynucleotide sequence
aaccggaaagtggcagga

SEQ ID NO: 1328 - DNA, 18 bp, Artificial sequence
  synthetic polynucleotide sequence
ctatggcagccatccaga

SEQ ID NO: 1329 - DNA, 18 bp, Artificial sequence
  synthetic polynucleotide sequence
ccgcgtatcagaggagca

SEQ ID NO: 1330 - DNA, 18 bp, Artificial sequence
  synthetic polynucleotide sequence
gggtagtgggtggcacca

SEQ ID NO: 1331 - DNA, 18 bp, Artificial sequence
  synthetic polynucleotide sequence
agctccactcccagccga

SEQ ID NO: 1332 - DNA, 18 bp, Artificial sequence
  synthetic polynucleotide sequence
gagcctgccagtagtcca

SEQ ID NO: 1333 - DNA, 18 bp, Artificial sequence
  synthetic polynucleotide sequence
agcagagcctggaggaca

SEQ ID NO: 1334 - DNA, 18 bp, Artificial sequence
  synthetic polynucleotide sequence
acacgtaggacaggcgca

SEQ ID NO: 1335 - DNA, 18 bp, Artificial sequence
  synthetic polynucleotide sequence
tcacgggaggaggaggaa

SEQ ID NO: 1336 - DNA, 18 bp, Artificial sequence
  synthetic polynucleotide sequence
agcacattcccaggacca

SEQ ID NO: 1337 - DNA, 18 bp, Artificial sequence
  synthetic polynucleotide sequence
agatgcgcagcaccagga

SEQ ID NO: 1338 - DNA, 18 bp, Artificial sequence
  synthetic polynucleotide sequence
acaccgtcttccagccga

SEQ ID NO: 1339 - DNA, 18 bp, Artificial sequence
  synthetic polynucleotide sequence
gatgcgaaccacccgcaa

SEQ ID NO: 1340 - DNA, 18 bp, Artificial sequence
  synthetic polynucleotide sequence
cagccggtgtaccagcca

SEQ ID NO: 1341 - DNA, 18 bp, Artificial sequence
  synthetic polynucleotide sequence
caacacctacagccggga

SEQ ID NO: 1342 - DNA, 18 bp, Artificial sequence
  synthetic polynucleotide sequence
acagcaagggcagggcca

SEQ ID NO: 1343 - DNA, 18 bp, Artificial sequence
  synthetic polynucleotide sequence
agcgaggggctgtggaga

SEQ ID NO: 1344 - DNA, 18 bp, Artificial sequence
  synthetic polynucleotide sequence
tttcgaaggcaggcacca

SEQ ID NO: 1345 - DNA, 18 bp, Artificial sequence
  synthetic polynucleotide sequence
ccaccctatgcaggggga

SEQ ID NO: 1346 - DNA, 18 bp, Artificial sequence
  synthetic polynucleotide sequence
tctctggaacgaggccga

SEQ ID NO: 1347 - DNA, 18 bp, Artificial sequence
  synthetic polynucleotide sequence
ggagacaaggtgcgccaa

SEQ ID NO: 1348 - DNA, 18 bp, Artificial sequence
  synthetic polynucleotide sequence
cgggacagcaagaagcca

SEQ ID NO: 1349 - DNA, 18 bp, Artificial sequence
  synthetic polynucleotide sequence
gctgagccctatgcacca

SEQ ID NO: 1350 - DNA, 18 bp, Artificial sequence
  synthetic polynucleotide sequence
tatggggccagctgcaca

SEQ ID NO: 1351 - DNA, 18 bp, Artificial sequence
  synthetic polynucleotide sequence
gctctacccgatcgacga

SEQ ID NO: 1352 - DNA, 18 bp, Artificial sequence
  synthetic polynucleotide sequence
ggttccgggagatgccga

SEQ ID NO: 1353 - DNA, 18 bp, Artificial sequence
  synthetic polynucleotide sequence
cttgcgagctcaggacga

SEQ ID NO: 1354 - DNA, 18 bp, Artificial sequence
  synthetic polynucleotide sequence
ccggcaatgacgtagcca

SEQ ID NO: 1355 - DNA, 18 bp, Artificial sequence
  synthetic polynucleotide sequence
gctcacgcccgagcctca

SEQ ID NO: 1356 - DNA, 18 bp, Artificial sequence
  synthetic polynucleotide sequence
aaggggcctgcagcgaca

SEQ ID NO: 1357 - DNA, 18 bp, Artificial sequence
  synthetic polynucleotide sequence
gaaagacccaagccccga

SEQ ID NO: 1358 - DNA, 18 bp, Artificial sequence
  synthetic polynucleotide sequence
gcttcacgcagatgacga

SEQ ID NO: 1359 - DNA, 18 bp, Artificial sequence
  synthetic polynucleotide sequence
gactgacaaggtgcgcga

SEQ ID NO: 1360 - DNA, 18 bp, Artificial sequence
  synthetic polynucleotide sequence
caccacgacgtcggagca

SEQ ID NO: 1361 - DNA, 18 bp, Artificial sequence
  synthetic polynucleotide sequence
gctgcttccagagcagga

SEQ ID NO: 1362 - DNA, 18 bp, Artificial sequence
  synthetic polynucleotide sequence
gccagcctcgtgcagaca

SEQ ID NO: 1363 - DNA, 18 bp, Artificial sequence
  synthetic polynucleotide sequence
cctgagacgaaccgggaa

SEQ ID NO: 1364 - DNA, 18 bp, Artificial sequence
  synthetic polynucleotide sequence
ggatgtgcaggtcgcaga

SEQ ID NO: 1365 - DNA, 18 bp, Artificial sequence
  synthetic polynucleotide sequence
ggtggcgactccagccca

SEQ ID NO: 1366 - DNA, 18 bp, Artificial sequence
  synthetic polynucleotide sequence
gcccacaagcagcgggga

SEQ ID NO: 1367 - DNA, 18 bp, Artificial sequence
  synthetic polynucleotide sequence
ccgcatgatcaagcacga

SEQ ID NO: 1368 - DNA, 18 bp, Artificial sequence
  synthetic polynucleotide sequence
tggtaccgcactgaccca

SEQ ID NO: 1369 - DNA, 18 bp, Artificial sequence
  synthetic polynucleotide sequence
cgtcatccaccaggctga

SEQ ID NO: 1370 - DNA, 18 bp, Artificial sequence
  synthetic polynucleotide sequence
tcgggtaccaggtccaca

SEQ ID NO: 1371 - DNA, 18 bp, Artificial sequence
  synthetic polynucleotide sequence
tgaagggcccaatagaca

SEQ ID NO: 1372 - DNA, 18 bp, Artificial sequence
  synthetic polynucleotide sequence
ggcggttccggaagggga

SEQ ID NO: 1373 - DNA, 18 bp, Artificial sequence
  synthetic polynucleotide sequence
gctcaaccaggtggacca

SEQ ID NO: 1374 - DNA, 18 bp, Artificial sequence
  synthetic polynucleotide sequence
aagggcccagcctcagga

SEQ ID NO: 1375 - DNA, 18 bp, Artificial sequence
  synthetic polynucleotide sequence
cctacggctggccacaga

SEQ ID NO: 1376 - DNA, 18 bp, Artificial sequence
  synthetic polynucleotide sequence
ggccttcaccctgagcca

SEQ ID NO: 1377 - DNA, 18 bp, Artificial sequence
  synthetic polynucleotide sequence
gctgaagagacatgggaa

SEQ ID NO: 1378 - DNA, 18 bp, Artificial sequence
  synthetic polynucleotide sequence
ggtcgttgaggcacagca

SEQ ID NO: 1379 - DNA, 18 bp, Artificial sequence
  synthetic polynucleotide sequence
gggtgggcttcgcagcga

SEQ ID NO: 1380 - DNA, 18 bp, Artificial sequence
  synthetic polynucleotide sequence
aaggaggatggctccaca

SEQ ID NO: 1381 - DNA, 18 bp, Artificial sequence
  synthetic polynucleotide sequence
cggacaccgaaggagaca

SEQ ID NO: 1382 - DNA, 18 bp, Artificial sequence
  synthetic polynucleotide sequence
cgacagcgctgtgcagca

SEQ ID NO: 1383 - DNA, 18 bp, Artificial sequence
  synthetic polynucleotide sequence
agacatccagagccccga

SEQ ID NO: 1384 - DNA, 18 bp, Artificial sequence
  synthetic polynucleotide sequence
gctccaagcagcagggca

SEQ ID NO: 1385 - DNA, 18 bp, Artificial sequence
  synthetic polynucleotide sequence
gactgtcacccacagcaa

SEQ ID NO: 1386 - DNA, 18 bp, Artificial sequence
  synthetic polynucleotide sequence
cttcaacaacctgggcca

SEQ ID NO: 1387 - DNA, 18 bp, Artificial sequence
  synthetic polynucleotide sequence
gcccatgacccatcgaga

SEQ ID NO: 1388 - DNA, 18 bp, Artificial sequence
  synthetic polynucleotide sequence
gggacagcagaagggcca

SEQ ID NO: 1389 - DNA, 18 bp, Artificial sequence
  synthetic polynucleotide sequence
ggaccgactgtacgacca

SEQ ID NO: 1390 - DNA, 18 bp, Artificial sequence
  synthetic polynucleotide sequence
agagccactgctaggcca

SEQ ID NO: 1391 - DNA, 18 bp, Artificial sequence
  synthetic polynucleotide sequence
tgtgccacctgcagcaga

SEQ ID NO: 1392 - DNA, 18 bp, Artificial sequence
  synthetic polynucleotide sequence
agccccaacaggtaccca

SEQ ID NO: 1393 - DNA, 18 bp, Artificial sequence
  synthetic polynucleotide sequence
gcagatgccagctcagga

SEQ ID NO: 1394 - DNA, 18 bp, Artificial sequence
  synthetic polynucleotide sequence
ctgcacagccgatcacca

SEQ ID NO: 1395 - DNA, 18 bp, Artificial sequence
  synthetic polynucleotide sequence
cttgctaaggggcagcga

SEQ ID NO: 1396 - DNA, 18 bp, Artificial sequence
  synthetic polynucleotide sequence
caccatcagatgcaggga

SEQ ID NO: 1397 - DNA, 18 bp, Artificial sequence
  synthetic polynucleotide sequence
gtatgcgggtgaaggcca

SEQ ID NO: 1398 - DNA, 18 bp, Artificial sequence
  synthetic polynucleotide sequence
tcaggcaccagcagggta

SEQ ID NO: 1399 - DNA, 18 bp, Artificial sequence
  synthetic polynucleotide sequence
cccggtggattgcacaga

SEQ ID NO: 1400 - DNA, 18 bp, Artificial sequence
  synthetic polynucleotide sequence
gaaccacacccagaacca

SEQ ID NO: 1401 - DNA, 18 bp, Artificial sequence
  synthetic polynucleotide sequence
ccgagacttcgtggcaga

SEQ ID NO: 1402 - DNA, 18 bp, Artificial sequence
  synthetic polynucleotide sequence
tgcccaggacttcaccaa

SEQ ID NO: 1403 - DNA, 18 bp, Artificial sequence
  synthetic polynucleotide sequence
cccacaccccgacccaca

SEQ ID NO: 1404 - DNA, 18 bp, Artificial sequence
  synthetic polynucleotide sequence
cagttagacagcccctga

SEQ ID NO: 1405 - DNA, 18 bp, Artificial sequence
  synthetic polynucleotide sequence
gcagagagaagacgggga

SEQ ID NO: 1406 - DNA, 18 bp, Artificial sequence
  synthetic polynucleotide sequence
ccactaggttggccagca

SEQ ID NO: 1407 - DNA, 18 bp, Artificial sequence
  synthetic polynucleotide sequence
tgcagccaagaatgggca

SEQ ID NO: 1408 - DNA, 18 bp, Artificial sequence
  synthetic polynucleotide sequence
gcagtggctagctgagga

SEQ ID NO: 1409 - DNA, 18 bp, Artificial sequence
  synthetic polynucleotide sequence
gcacaggaaccgaaagca

SEQ ID NO: 1410 - DNA, 18 bp, Artificial sequence
  synthetic polynucleotide sequence
ggggttccgaagagggta

SEQ ID NO: 1411 - DNA, 18 bp, Artificial sequence
  synthetic polynucleotide sequence
cagcaaggaggaagggga

SEQ ID NO: 1412 - DNA, 18 bp, Artificial sequence
  synthetic polynucleotide sequence
agagggggcagcctccga

SEQ ID NO: 1413 - DNA, 18 bp, Artificial sequence
  synthetic polynucleotide sequence
gctggcaccaccaacaca

SEQ ID NO: 1414 - DNA, 18 bp, Artificial sequence
  synthetic polynucleotide sequence
acaccaggcatcgccaca

SEQ ID NO: 1415 - DNA, 19 bp, Artificial sequence
  synthetic polynucleotide sequence
gacagaggcagacacagaa

SEQ ID NO: 1416 - DNA, 18 bp, Artificial sequence
  synthetic polynucleotide sequence
gttcagcaccgacgtgaa

SEQ ID NO: 1417 - DNA, 18 bp, Artificial sequence
  synthetic polynucleotide sequence
ccaaactgcccctccaca

SEQ ID NO: 1418 - DNA, 18 bp, Artificial sequence
  synthetic polynucleotide sequence
gcagacgtgcaagcccca

SEQ ID NO: 1419 - DNA, 18 bp, Artificial sequence
  synthetic polynucleotide sequence
cgggaagctgacagagga

SEQ ID NO: 1420 - DNA, 18 bp, Artificial sequence
  synthetic polynucleotide sequence
gcagagcagcagcgggca

SEQ ID NO: 1421 - DNA, 18 bp, Artificial sequence
  synthetic polynucleotide sequence
gggctggatccaagacca

SEQ ID NO: 1422 - DNA, 18 bp, Artificial sequence
  synthetic polynucleotide sequence
tgagtgaggcggtgagca

SEQ ID NO: 1423 - DNA, 18 bp, Artificial sequence
  synthetic polynucleotide sequence
gtgcagctgccaaaacca

SEQ ID NO: 1424 - DNA, 18 bp, Artificial sequence
  synthetic polynucleotide sequence
acgggctagctgtgcaca

SEQ ID NO: 1425 - DNA, 18 bp, Artificial sequence
  synthetic polynucleotide sequence
cgagggctcagacacaga

SEQ ID NO: 1426 - DNA, 18 bp, Artificial sequence
  synthetic polynucleotide sequence
tgaggatccggtggcaca

SEQ ID NO: 1427 - DNA, 18 bp, Artificial sequence
  synthetic polynucleotide sequence
ggtagaggagctggagca

SEQ ID NO: 1428 - DNA, 18 bp, Artificial sequence
  synthetic polynucleotide sequence
ggtgctcacagtaggcca

SEQ ID NO: 1429 - DNA, 18 bp, Artificial sequence
  synthetic polynucleotide sequence
cctcagtctcagccacca

SEQ ID NO: 1430 - DNA, 18 bp, Artificial sequence
  synthetic polynucleotide sequence
aaccacaccagtgggcca

SEQ ID NO: 1431 - DNA, 18 bp, Artificial sequence
  synthetic polynucleotide sequence
cagagctccagctaccca

SEQ ID NO: 1432 - DNA, 18 bp, Artificial sequence
  synthetic polynucleotide sequence
cttgagggtggagagcca

SEQ ID NO: 1433 - DNA, 18 bp, Artificial sequence
  synthetic polynucleotide sequence
ggattacgacgcggcaga

SEQ ID NO: 1434 - DNA, 18 bp, Artificial sequence
  synthetic polynucleotide sequence
gcacggagcagttcacga

SEQ ID NO: 1435 - DNA, 18 bp, Artificial sequence
  synthetic polynucleotide sequence
cacacccgaggaacagga

SEQ ID NO: 1436 - DNA, 18 bp, Artificial sequence
  synthetic polynucleotide sequence
ggacgccatccgaccaca

SEQ ID NO: 1437 - DNA, 18 bp, Artificial sequence
  synthetic polynucleotide sequence
aatgggctgcagtggcaa

SEQ ID NO: 1438 - DNA, 18 bp, Artificial sequence
  synthetic polynucleotide sequence
gccatctctgaggaggaa

SEQ ID NO: 1439 - DNA, 18 bp, Artificial sequence
  synthetic polynucleotide sequence
ggcggagagtgctagtga

SEQ ID NO: 1440 - DNA, 18 bp, Artificial sequence
  synthetic polynucleotide sequence
acctcagcattcccgaca

SEQ ID NO: 1441 - DNA, 18 bp, Artificial sequence
  synthetic polynucleotide sequence
ggcaatgctgcccacaca

SEQ ID NO: 1442 - DNA, 18 bp, Artificial sequence
  synthetic polynucleotide sequence
cctgaccatgtgccacca

SEQ ID NO: 1443 - DNA, 18 bp, Artificial sequence
  synthetic polynucleotide sequence
cgctgaggggatcagaca

SEQ ID NO: 1444 - DNA, 18 bp, Artificial sequence
  synthetic polynucleotide sequence
ttgagccaggcagaggga

SEQ ID NO: 1445 - DNA, 18 bp, Artificial sequence
  synthetic polynucleotide sequence
ggcacatcagtggggtga

SEQ ID NO: 1446 - DNA, 18 bp, Artificial sequence
  synthetic polynucleotide sequence
acaacacaggctgtacca

SEQ ID NO: 1447 - DNA, 18 bp, Artificial sequence
  synthetic polynucleotide sequence
tcaccgaggtgggaacca

SEQ ID NO: 1448 - DNA, 18 bp, Artificial sequence
  synthetic polynucleotide sequence
gtctgaccactccaggca

SEQ ID NO: 1449 - DNA, 18 bp, Artificial sequence
  synthetic polynucleotide sequence
tcctgaggctccagggaa

SEQ ID NO: 1450 - DNA, 18 bp, Artificial sequence
  synthetic polynucleotide sequence
gatgttaccgcccaagga

SEQ ID NO: 1451 - DNA, 18 bp, Artificial sequence
  synthetic polynucleotide sequence
ccacagcaccagtgacga

SEQ ID NO: 1452 - DNA, 18 bp, Artificial sequence
  synthetic polynucleotide sequence
accagccttggctcagca

SEQ ID NO: 1453 - DNA, 19 bp, Artificial sequence
  synthetic polynucleotide sequence
gaaggagaatccagcacga

SEQ ID NO: 1454 - DNA, 17 bp, Artificial sequence
  synthetic polynucleotide sequence
gagcccctgggtcccca

SEQ ID NO: 1455 - DNA, 18 bp, Artificial sequence
  synthetic polynucleotide sequence
cagggacacttgcgacga

SEQ ID NO: 1456 - DNA, 18 bp, Artificial sequence
  synthetic polynucleotide sequence
agagaaggggctcagcga

SEQ ID NO: 1457 - DNA, 18 bp, Artificial sequence
  synthetic polynucleotide sequence
tgaaccccttccagccca

SEQ ID NO: 1458 - DNA, 18 bp, Artificial sequence
  synthetic polynucleotide sequence
gccgcagaactcgcacga

SEQ ID NO: 1459 - DNA, 18 bp, Artificial sequence
  synthetic polynucleotide sequence
tgaaccggcacctgcaca

SEQ ID NO: 1460 - DNA, 18 bp, Artificial sequence
  synthetic polynucleotide sequence
aagctcccaccagggcca

SEQ ID NO: 1461 - DNA, 18 bp, Artificial sequence
  synthetic polynucleotide sequence
agccgaaagggccaggaa

SEQ ID NO: 1462 - DNA, 18 bp, Artificial sequence
  synthetic polynucleotide sequence
gactgaagagtgagccca

SEQ ID NO: 1463 - DNA, 18 bp, Artificial sequence
  synthetic polynucleotide sequence
ccgccaggttacggcaga

SEQ ID NO: 1464 - DNA, 18 bp, Artificial sequence
  synthetic polynucleotide sequence
gcgtccctgcgaaggtca

SEQ ID NO: 1465 - DNA, 18 bp, Artificial sequence
  synthetic polynucleotide sequence
ccaagcagccgaagacca

SEQ ID NO: 1466 - DNA, 18 bp, Artificial sequence
  synthetic polynucleotide sequence
ttctccacaccaggcgga

SEQ ID NO: 1467 - DNA, 18 bp, Artificial sequence
  synthetic polynucleotide sequence
gcacttcctgaagcccca

SEQ ID NO: 1468 - DNA, 18 bp, Artificial sequence
  synthetic polynucleotide sequence
gttccagtgcggggacca

SEQ ID NO: 1469 - DNA, 18 bp, Artificial sequence
  synthetic polynucleotide sequence
ggtgggacaagtgcagga

SEQ ID NO: 1470 - DNA, 18 bp, Artificial sequence
  synthetic polynucleotide sequence
aactccgcccagccccca

SEQ ID NO: 1471 - DNA, 18 bp, Artificial sequence
  synthetic polynucleotide sequence
ggtgccgacatcgacgca

SEQ ID NO: 1472 - DNA, 18 bp, Artificial sequence
  synthetic polynucleotide sequence
ggaccagcgtgcgcacca

SEQ ID NO: 1473 - DNA, 18 bp, Artificial sequence
  synthetic polynucleotide sequence
gttcaaccggccagccaa

SEQ ID NO: 1474 - DNA, 18 bp, Artificial sequence
  synthetic polynucleotide sequence
taagcacatgggcacgga

SEQ ID NO: 1475 - DNA, 18 bp, Artificial sequence
  synthetic polynucleotide sequence
cgacggcaccgaggccaa

SEQ ID NO: 1476 - DNA, 18 bp, Artificial sequence
  synthetic polynucleotide sequence
ctctgcggccagacccga

SEQ ID NO: 1477 - DNA, 18 bp, Artificial sequence
  synthetic polynucleotide sequence
gcccaccctgatgagcaa

SEQ ID NO: 1478 - DNA, 18 bp, Artificial sequence
  synthetic polynucleotide sequence
tcatgcctggagagccca

SEQ ID NO: 1479 - DNA, 18 bp, Artificial sequence
  synthetic polynucleotide sequence
ttcagagaggaaagccca

SEQ ID NO: 1480 - DNA, 18 bp, Artificial sequence
  synthetic polynucleotide sequence
caagaggaacaggtgcca

SEQ ID NO: 1481 - DNA, 18 bp, Artificial sequence
  synthetic polynucleotide sequence
cactgagcatggaccgca

SEQ ID NO: 1482 - DNA, 18 bp, Artificial sequence
  synthetic polynucleotide sequence
ctctgagcccagtccaca

SEQ ID NO: 1483 - DNA, 18 bp, Artificial sequence
  synthetic polynucleotide sequence
gcagcaaggctacggaga

SEQ ID NO: 1484 - DNA, 18 bp, Artificial sequence
  synthetic polynucleotide sequence
tgtgcaccctgaaggcca

SEQ ID NO: 1485 - DNA, 18 bp, Artificial sequence
  synthetic polynucleotide sequence
caaccaaggcagccgtga

SEQ ID NO: 1486 - DNA, 18 bp, Artificial sequence
  synthetic polynucleotide sequence
tgggcacacacagttgca

SEQ ID NO: 1487 - DNA, 18 bp, Artificial sequence
  synthetic polynucleotide sequence
ggtggccatcagccagga

SEQ ID NO: 1488 - DNA, 18 bp, Artificial sequence
  synthetic polynucleotide sequence
aggcctcatgggggagga

SEQ ID NO: 1489 - DNA, 18 bp, Artificial sequence
  synthetic polynucleotide sequence
ctccagctgccaggacga

SEQ ID NO: 1490 - DNA, 18 bp, Artificial sequence
  synthetic polynucleotide sequence
ggaagcgcttgcccacga

SEQ ID NO: 1491 - DNA, 18 bp, Artificial sequence
  synthetic polynucleotide sequence
ccagaaagttcggcccaa

SEQ ID NO: 1492 - DNA, 18 bp, Artificial sequence
  synthetic polynucleotide sequence
gccggaccctcatggaca

SEQ ID NO: 1493 - DNA, 18 bp, Artificial sequence
  synthetic polynucleotide sequence
gctggtacaacaggccaa

SEQ ID NO: 1494 - DNA, 18 bp, Artificial sequence
  synthetic polynucleotide sequence
atggcgggaccgctgcca

SEQ ID NO: 1495 - DNA, 18 bp, Artificial sequence
  synthetic polynucleotide sequence
ctcggatggagccggaca

SEQ ID NO: 1496 - DNA, 18 bp, Artificial sequence
  synthetic polynucleotide sequence
aggcctaggaagcggcca

SEQ ID NO: 1497 - DNA, 18 bp, Artificial sequence
  synthetic polynucleotide sequence
aagagcctgagaccccca

SEQ ID NO: 1498 - DNA, 18 bp, Artificial sequence
  synthetic polynucleotide sequence
actcaggagagggctcca

SEQ ID NO: 1499 - DNA, 18 bp, Artificial sequence
  synthetic polynucleotide sequence
caggagggaggtgtgtga

SEQ ID NO: 1500 - DNA, 18 bp, Artificial sequence
  synthetic polynucleotide sequence
gggccgtagaagcgccga

SEQ ID NO: 1501 - DNA, 18 bp, Artificial sequence
  synthetic polynucleotide sequence
gggcctactacaacggca

SEQ ID NO: 1502 - DNA, 18 bp, Artificial sequence
  synthetic polynucleotide sequence
caggcggtcagtgacgca

SEQ ID NO: 1503 - DNA, 18 bp, Artificial sequence
  synthetic polynucleotide sequence
ctcaacgcctctgccgca

SEQ ID NO: 1504 - DNA, 18 bp, Artificial sequence
  synthetic polynucleotide sequence
gacagaagagtcgacgga

SEQ ID NO: 1505 - DNA, 18 bp, Artificial sequence
  synthetic polynucleotide sequence
cgcgctgctgagacccga

SEQ ID NO: 1506 - DNA, 18 bp, Artificial sequence
  synthetic polynucleotide sequence
ggatgccggggtatagca

SEQ ID NO: 1507 - DNA, 18 bp, Artificial sequence
  synthetic polynucleotide sequence
ggaggaccggaacaggga

SEQ ID NO: 1508 - DNA, 18 bp, Artificial sequence
  synthetic polynucleotide sequence
agcaaggacggcgtgtga

SEQ ID NO: 1509 - DNA, 18 bp, Artificial sequence
  synthetic polynucleotide sequence
catcggggacgagatgga

SEQ ID NO: 1510 - DNA, 18 bp, Artificial sequence
  synthetic polynucleotide sequence
gggatctccagaacctca

SEQ ID NO: 1511 - DNA, 18 bp, Artificial sequence
  synthetic polynucleotide sequence
cccatctcagccagcaga

SEQ ID NO: 1512 - DNA, 18 bp, Artificial sequence
  synthetic polynucleotide sequence
ctgggaaggtctccacca

SEQ ID NO: 1513 - DNA, 18 bp, Artificial sequence
  synthetic polynucleotide sequence
cagcccaaggggaagaca

SEQ ID NO: 1514 - DNA, 18 bp, Artificial sequence
  synthetic polynucleotide sequence
caggctggtagaggctca

SEQ ID NO: 1515 - DNA, 18 bp, Artificial sequence
  synthetic polynucleotide sequence
gaaaatgctgacccacca

SEQ ID NO: 1516 - DNA, 18 bp, Artificial sequence
  synthetic polynucleotide sequence
aagcccatttccaaggca

SEQ ID NO: 1517 - DNA, 19 bp, Artificial sequence
  synthetic polynucleotide sequence
catcagacagcccaggaga

SEQ ID NO: 1518 - DNA, 19 bp, Artificial sequence
  synthetic polynucleotide sequence
cacggcagcattaatcaca

SEQ ID NO: 1519 - DNA, 18 bp, Artificial sequence
  synthetic polynucleotide sequence
ttctcaaggaccaccgca

SEQ ID NO: 1520 - DNA, 18 bp, Artificial sequence
  synthetic polynucleotide sequence
gggcagtggatgaagcca

SEQ ID NO: 1521 - DNA, 18 bp, Artificial sequence
  synthetic polynucleotide sequence
ccacacaggccatcagga

SEQ ID NO: 1522 - DNA, 18 bp, Artificial sequence
  synthetic polynucleotide sequence
ccggagcaggaactgaca

SEQ ID NO: 1523 - DNA, 18 bp, Artificial sequence
  synthetic polynucleotide sequence
agggatgagcaaccccga

SEQ ID NO: 1524 - DNA, 18 bp, Artificial sequence
  synthetic polynucleotide sequence
ccagcaccgactgcagga

SEQ ID NO: 1525 - DNA, 18 bp, Artificial sequence
  synthetic polynucleotide sequence
ggcgagaatgtgacacca

SEQ ID NO: 1526 - DNA, 18 bp, Artificial sequence
  synthetic polynucleotide sequence
cagataacctgacagcca

SEQ ID NO: 1527 - DNA, 18 bp, Artificial sequence
  synthetic polynucleotide sequence
cacttatgacccacgcca

SEQ ID NO: 1528 - DNA, 18 bp, Artificial sequence
  synthetic polynucleotide sequence
gctctaacacagctagca

SEQ ID NO: 1529 - DNA, 18 bp, Artificial sequence
  synthetic polynucleotide sequence
ccacccttcagcaagaca

SEQ ID NO: 1530 - DNA, 18 bp, Artificial sequence
  synthetic polynucleotide sequence
tcttccacggggaccaca

SEQ ID NO: 1531 - DNA, 18 bp, Artificial sequence
  synthetic polynucleotide sequence
agtcttgcacgaggagca

SEQ ID NO: 1532 - DNA, 18 bp, Artificial sequence
  synthetic polynucleotide sequence
tgccgctgaatgcaggga

SEQ ID NO: 1533 - DNA, 18 bp, Artificial sequence
  synthetic polynucleotide sequence
ggaacattgtggcagcca

SEQ ID NO: 1534 - DNA, 18 bp, Artificial sequence
  synthetic polynucleotide sequence
tggtagggtcccagagca

SEQ ID NO: 1535 - DNA, 18 bp, Artificial sequence
  synthetic polynucleotide sequence
ccagcctcccccagccaa

SEQ ID NO: 1536 - DNA, 18 bp, Artificial sequence
  synthetic polynucleotide sequence
tgggcaagactgctggga

SEQ ID NO: 1537 - DNA, 18 bp, Artificial sequence
  synthetic polynucleotide sequence
tgggagtgacaaggccaa

SEQ ID NO: 1538 - DNA, 18 bp, Artificial sequence
  synthetic polynucleotide sequence
gagtactggggctaggca

SEQ ID NO: 1539 - DNA, 18 bp, Artificial sequence
  synthetic polynucleotide sequence
cattgcccaagcccgcaa

SEQ ID NO: 1540 - DNA, 18 bp, Artificial sequence
  synthetic polynucleotide sequence
gccttcctccagaagcca

SEQ ID NO: 1541 - DNA, 18 bp, Artificial sequence
  synthetic polynucleotide sequence
ctgcccgaatcagaagga

SEQ ID NO: 1542 - DNA, 18 bp, Artificial sequence
  synthetic polynucleotide sequence
cgtatccaggcggagcga

SEQ ID NO: 1543 - DNA, 18 bp, Artificial sequence
  synthetic polynucleotide sequence
gagaacccgacaagcaga

SEQ ID NO: 1544 - DNA, 18 bp, Artificial sequence
  synthetic polynucleotide sequence
gcgtagtactcggagaca

SEQ ID NO: 1545 - DNA, 18 bp, Artificial sequence
  synthetic polynucleotide sequence
gacaaagaccaaaggcca

SEQ ID NO: 1546 - DNA, 18 bp, Artificial sequence
  synthetic polynucleotide sequence
ccgaattcaccaggagca

SEQ ID NO: 1547 - DNA, 18 bp, Artificial sequence
  synthetic polynucleotide sequence
gccagctgccaaagagga

SEQ ID NO: 1548 - DNA, 18 bp, Artificial sequence
  synthetic polynucleotide sequence
agaggcagcaagacccca

SEQ ID NO: 1549 - DNA, 18 bp, Artificial sequence
  synthetic polynucleotide sequence
gggcacctcatcacacga

SEQ ID NO: 1550 - DNA, 18 bp, Artificial sequence
  synthetic polynucleotide sequence
acctcaatggctagccca

SEQ ID NO: 1551 - DNA, 18 bp, Artificial sequence
  synthetic polynucleotide sequence
tgggatggcaggactgga

SEQ ID NO: 1552 - DNA, 18 bp, Artificial sequence
  synthetic polynucleotide sequence
cacatgagcgtactacca

SEQ ID NO: 1553 - DNA, 18 bp, Artificial sequence
  synthetic polynucleotide sequence
agacctgggatggcagga

SEQ ID NO: 1554 - DNA, 18 bp, Artificial sequence
  synthetic polynucleotide sequence
cacagcacggtttgggga

SEQ ID NO: 1555 - DNA, 18 bp, Artificial sequence
  synthetic polynucleotide sequence
gacgcccaagaaccagga

SEQ ID NO: 1556 - DNA, 18 bp, Artificial sequence
  synthetic polynucleotide sequence
gagttcagagggaaggca

SEQ ID NO: 1557 - DNA, 18 bp, Artificial sequence
  synthetic polynucleotide sequence
tggcgacgacgacgagga

SEQ ID NO: 1558 - DNA, 18 bp, Artificial sequence
  synthetic polynucleotide sequence
ccgcctccccagccggga

SEQ ID NO: 1559 - DNA, 18 bp, Artificial sequence
  synthetic polynucleotide sequence
atgccaccaaccacgcca

SEQ ID NO: 1560 - DNA, 18 bp, Artificial sequence
  synthetic polynucleotide sequence
cacagcacgccttgggga

SEQ ID NO: 1561 - DNA, 18 bp, Artificial sequence
  synthetic polynucleotide sequence
cctgccagagagagggca

SEQ ID NO: 1562 - DNA, 18 bp, Artificial sequence
  synthetic polynucleotide sequence
gtggcacccagcaacgca

SEQ ID NO: 1563 - DNA, 18 bp, Artificial sequence
  synthetic polynucleotide sequence
cccaaggaaagcccgcaa

SEQ ID NO: 1564 - DNA, 18 bp, Artificial sequence
  synthetic polynucleotide sequence
acagcaaggcccaggtca

SEQ ID NO: 1565 - DNA, 18 bp, Artificial sequence
  synthetic polynucleotide sequence
ccaccaccctagacgcta

SEQ ID NO: 1566 - DNA, 18 bp, Artificial sequence
  synthetic polynucleotide sequence
atttaacagccaggccca

SEQ ID NO: 1567 - DNA, 18 bp, Artificial sequence
  synthetic polynucleotide sequence
tcactgcagatggacgca

SEQ ID NO: 1568 - DNA, 18 bp, Artificial sequence
  synthetic polynucleotide sequence
cagtcagcctcatggaca

SEQ ID NO: 1569 - DNA, 18 bp, Artificial sequence
  synthetic polynucleotide sequence
cagcaagcctcccagaca

SEQ ID NO: 1570 - DNA, 18 bp, Artificial sequence
  synthetic polynucleotide sequence
ctcgctcaaggggccaga

SEQ ID NO: 1571 - DNA, 18 bp, Artificial sequence
  synthetic polynucleotide sequence
tggccacccatgagccca

SEQ ID NO: 1572 - DNA, 18 bp, Artificial sequence
  synthetic polynucleotide sequence
ttgaccacagctccacca

SEQ ID NO: 1573 - DNA, 19 bp, Artificial sequence
  synthetic polynucleotide sequence
ctcagcatgaggaacacga

SEQ ID NO: 1574 - DNA, 18 bp, Artificial sequence
  synthetic polynucleotide sequence
caatccgatggccagcaa

SEQ ID NO: 1575 - DNA, 18 bp, Artificial sequence
  synthetic polynucleotide sequence
gcacaccagcagggacca

SEQ ID NO: 1576 - DNA, 18 bp, Artificial sequence
  synthetic polynucleotide sequence
ggaccagtctgataccca

SEQ ID NO: 1577 - DNA, 18 bp, Artificial sequence
  synthetic polynucleotide sequence
cgacgactccactcacca

SEQ ID NO: 1578 - DNA, 18 bp, Artificial sequence
  synthetic polynucleotide sequence
caactggcacaaggccca

SEQ ID NO: 1579 - DNA, 18 bp, Artificial sequence
  synthetic polynucleotide sequence
ctggcgctactggggcca

SEQ ID NO: 1580 - DNA, 18 bp, Artificial sequence
  synthetic polynucleotide sequence
agctgctccacgatgaga

SEQ ID NO: 1581 - DNA, 18 bp, Artificial sequence
  synthetic polynucleotide sequence
tgcgcaagaccctggcaa

SEQ ID NO: 1582 - DNA, 18 bp, Artificial sequence
  synthetic polynucleotide sequence
agaaggcagccttcagga

SEQ ID NO: 1583 - DNA, 18 bp, Artificial sequence
  synthetic polynucleotide sequence
gcctggcagtgagactca

SEQ ID NO: 1584 - DNA, 18 bp, Artificial sequence
  synthetic polynucleotide sequence
gccagcgcatggaccgga

SEQ ID NO: 1585 - DNA, 18 bp, Artificial sequence
  synthetic polynucleotide sequence
tggaggacacgaccctca

SEQ ID NO: 1586 - DNA, 18 bp, Artificial sequence
  synthetic polynucleotide sequence
ctaggcacgcgttcacca

SEQ ID NO: 1587 - DNA, 18 bp, Artificial sequence
  synthetic polynucleotide sequence
cccgcctcccattgagga

SEQ ID NO: 1588 - DNA, 18 bp, Artificial sequence
  synthetic polynucleotide sequence
gcagttgatccaagggca

SEQ ID NO: 1589 - DNA, 18 bp, Artificial sequence
  synthetic polynucleotide sequence
agctgcattaccagcaga

SEQ ID NO: 1590 - DNA, 18 bp, Artificial sequence
  synthetic polynucleotide sequence
cccaggcgaccaccgtga

SEQ ID NO: 1591 - DNA, 18 bp, Artificial sequence
  synthetic polynucleotide sequence
tggcacctccagcaacca

SEQ ID NO: 1592 - DNA, 18 bp, Artificial sequence
  synthetic polynucleotide sequence
agtagtctgagaggccca

SEQ ID NO: 1593 - DNA, 18 bp, Artificial sequence
  synthetic polynucleotide sequence
tccctgctgggaaacaca

SEQ ID NO: 1594 - DNA, 18 bp, Artificial sequence
  synthetic polynucleotide sequence
tggagcacaagtatccca

SEQ ID NO: 1595 - DNA, 18 bp, Artificial sequence
  synthetic polynucleotide sequence
ggaagacgacgacgacga

SEQ ID NO: 1596 - DNA, 18 bp, Artificial sequence
  synthetic polynucleotide sequence
ataggagaacgaggccga

SEQ ID NO: 1597 - DNA, 18 bp, Artificial sequence
  synthetic polynucleotide sequence
acctcagcgagaaaggaa

SEQ ID NO: 1598 - DNA, 18 bp, Artificial sequence
  synthetic polynucleotide sequence
tgccacatcaccatgcca

SEQ ID NO: 1599 - DNA, 18 bp, Artificial sequence
  synthetic polynucleotide sequence
gagcagggagaagccaga

SEQ ID NO: 1600 - DNA, 18 bp, Artificial sequence
  synthetic polynucleotide sequence
gggtcaggccagacacca

SEQ ID NO: 1601 - DNA, 18 bp, Artificial sequence
  synthetic polynucleotide sequence
acctcttgaagccccaga

SEQ ID NO: 1602 - DNA, 18 bp, Artificial sequence
  synthetic polynucleotide sequence
agcgatgataagggcaga

SEQ ID NO: 1603 - DNA, 18 bp, Artificial sequence
  synthetic polynucleotide sequence
gcctgcagtctcagcgaa

SEQ ID NO: 1604 - DNA, 18 bp, Artificial sequence
  synthetic polynucleotide sequence
gcagcagctcgatcagca

SEQ ID NO: 1605 - DNA, 18 bp, Artificial sequence
  synthetic polynucleotide sequence
aggaagagagcaggccca

SEQ ID NO: 1606 - DNA, 18 bp, Artificial sequence
  synthetic polynucleotide sequence
tatgcacaactcggccca

SEQ ID NO: 1607 - DNA, 18 bp, Artificial sequence
  synthetic polynucleotide sequence
cgttctcagcaagcggga

SEQ ID NO: 1608 - DNA, 18 bp, Artificial sequence
  synthetic polynucleotide sequence
gctcccagactcggagga

SEQ ID NO: 1609 - DNA, 18 bp, Artificial sequence
  synthetic polynucleotide sequence
gttccagagcctgaccca

SEQ ID NO: 1610 - DNA, 18 bp, Artificial sequence
  synthetic polynucleotide sequence
ggcctcccgacatccaca

SEQ ID NO: 1611 - DNA, 18 bp, Artificial sequence
  synthetic polynucleotide sequence
gcctgaagatgaaggcca

SEQ ID NO: 1612 - DNA, 18 bp, Artificial sequence
  synthetic polynucleotide sequence
acttcaactggaacgcca

SEQ ID NO: 1613 - DNA, 18 bp, Artificial sequence
  synthetic polynucleotide sequence
agcggccagcctagagga

SEQ ID NO: 1614 - DNA, 18 bp, Artificial sequence
  synthetic polynucleotide sequence
aagcagggctgctgggga

SEQ ID NO: 1615 - DNA, 18 bp, Artificial sequence
  synthetic polynucleotide sequence
ggaccctgacgacagcca

SEQ ID NO: 1616 - DNA, 18 bp, Artificial sequence
  synthetic polynucleotide sequence
cgttggacagggagctga

SEQ ID NO: 1617 - DNA, 18 bp, Artificial sequence
  synthetic polynucleotide sequence
cccagaactgcctcccga

SEQ ID NO: 1618 - DNA, 18 bp, Artificial sequence
  synthetic polynucleotide sequence
ggcgggagctctcccgga

SEQ ID NO: 1619 - DNA, 18 bp, Artificial sequence
  synthetic polynucleotide sequence
gtcataccacgccgacga

SEQ ID NO: 1620 - DNA, 18 bp, Artificial sequence
  synthetic polynucleotide sequence
tcatcgccatcacagcca

SEQ ID NO: 1621 - DNA, 18 bp, Artificial sequence
  synthetic polynucleotide sequence
gcagaagtggagacccga

SEQ ID NO: 1622 - DNA, 18 bp, Artificial sequence
  synthetic polynucleotide sequence
ggtggcaagagaagggca

SEQ ID NO: 1623 - DNA, 18 bp, Artificial sequence
  synthetic polynucleotide sequence
tgagcgacgccgcagcga

SEQ ID NO: 1624 - DNA, 18 bp, Artificial sequence
  synthetic polynucleotide sequence
cctccagccgcaaccgca

SEQ ID NO: 1625 - DNA, 18 bp, Artificial sequence
  synthetic polynucleotide sequence
gaggccgttgtacaacca

SEQ ID NO: 1626 - DNA, 18 bp, Artificial sequence
  synthetic polynucleotide sequence
atcagccaatccagcaca

SEQ ID NO: 1627 - DNA, 18 bp, Artificial sequence
  synthetic polynucleotide sequence
atcagtgggcggatgaca

SEQ ID NO: 1628 - DNA, 18 bp, Artificial sequence
  synthetic polynucleotide sequence
aacagaagccagttccga

SEQ ID NO: 1629 - DNA, 18 bp, Artificial sequence
  synthetic polynucleotide sequence
tcaccaaccgcctgacca

SEQ ID NO: 1630 - DNA, 18 bp, Artificial sequence
  synthetic polynucleotide sequence
cgtagcaatgggacccca

SEQ ID NO: 1631 - DNA, 18 bp, Artificial sequence
  synthetic polynucleotide sequence
gcagtggcttccaaggga

SEQ ID NO: 1632 - DNA, 18 bp, Artificial sequence
  synthetic polynucleotide sequence
tcgcacggtcataggcca

SEQ ID NO: 1633 - DNA, 18 bp, Artificial sequence
  synthetic polynucleotide sequence
caaggcggagcggcctga

SEQ ID NO: 1634 - DNA, 18 bp, Artificial sequence
  synthetic polynucleotide sequence
actacacccagtgaacga

SEQ ID NO: 1635 - DNA, 18 bp, Artificial sequence
  synthetic polynucleotide sequence
ccgacgtcctagagagca

SEQ ID NO: 1636 - DNA, 18 bp, Artificial sequence
  synthetic polynucleotide sequence
tcccgtgacggctcagca

SEQ ID NO: 1637 - DNA, 18 bp, Artificial sequence
  synthetic polynucleotide sequence
accagagtcgtccccaga

SEQ ID NO: 1638 - DNA, 18 bp, Artificial sequence
  synthetic polynucleotide sequence
gactgggaatcgacagga

SEQ ID NO: 1639 - DNA, 19 bp, Artificial sequence
  synthetic polynucleotide sequence
cagaacacaagcacaggca

SEQ ID NO: 1640 - DNA, 17 bp, Artificial sequence
  synthetic polynucleotide sequence
tccacctgcgcagccca

SEQ ID NO: 1641 - DNA, 18 bp, Artificial sequence
  synthetic polynucleotide sequence
ataccccgacgttcccca

SEQ ID NO: 1642 - DNA, 18 bp, Artificial sequence
  synthetic polynucleotide sequence
cacagtgtgggtgggcca

SEQ ID NO: 1643 - DNA, 18 bp, Artificial sequence
  synthetic polynucleotide sequence
agctgtccgaggaggaga

SEQ ID NO: 1644 - DNA, 18 bp, Artificial sequence
  synthetic polynucleotide sequence
gtctctaggacaggggca

SEQ ID NO: 1645 - DNA, 18 bp, Artificial sequence
  synthetic polynucleotide sequence
cctgaacatggaggccga

SEQ ID NO: 1646 - DNA, 18 bp, Artificial sequence
  synthetic polynucleotide sequence
gatgcccaggaagggcca

SEQ ID NO: 1647 - DNA, 18 bp, Artificial sequence
  synthetic polynucleotide sequence
cgtggaccacagcaccca

SEQ ID NO: 1648 - DNA, 18 bp, Artificial sequence
  synthetic polynucleotide sequence
ctggaagccagcaccaga

SEQ ID NO: 1649 - DNA, 18 bp, Artificial sequence
  synthetic polynucleotide sequence
gcaacaagagctgaccga

SEQ ID NO: 1650 - DNA, 18 bp, Artificial sequence
  synthetic polynucleotide sequence
gggaagccattagggcca

SEQ ID NO: 1651 - DNA, 18 bp, Artificial sequence
  synthetic polynucleotide sequence
ccaactccagcagcacca

SEQ ID NO: 1652 - DNA, 18 bp, Artificial sequence
  synthetic polynucleotide sequence
ggcaaccgttgagtccca

SEQ ID NO: 1653 - DNA, 18 bp, Artificial sequence
  synthetic polynucleotide sequence
gggacacacaacacagca

SEQ ID NO: 1654 - DNA, 18 bp, Artificial sequence
  synthetic polynucleotide sequence
cgagctgctgaccggcca

SEQ ID NO: 1655 - DNA, 18 bp, Artificial sequence
  synthetic polynucleotide sequence
ccacacaatcaaagcgga

SEQ ID NO: 1656 - DNA, 18 bp, Artificial sequence
  synthetic polynucleotide sequence
ggccaccacgaagcggca

SEQ ID NO: 1657 - DNA, 18 bp, Artificial sequence
  synthetic polynucleotide sequence
tggctgggagaatgacca

SEQ ID NO: 1658 - DNA, 18 bp, Artificial sequence
  synthetic polynucleotide sequence
ctctcatacaagcgccca

SEQ ID NO: 1659 - DNA, 18 bp, Artificial sequence
  synthetic polynucleotide sequence
agcggattggactgagca

SEQ ID NO: 1660 - DNA, 18 bp, Artificial sequence
  synthetic polynucleotide sequence
agcacacagatggagcca

SEQ ID NO: 1661 - DNA, 18 bp, Artificial sequence
  synthetic polynucleotide sequence
cggactcagccagcccca

SEQ ID NO: 1662 - DNA, 18 bp, Artificial sequence
  synthetic polynucleotide sequence
atgcggtaggacacctca

SEQ ID NO: 1663 - DNA, 18 bp, Artificial sequence
  synthetic polynucleotide sequence
cggtgactgcagccgcaa

SEQ ID NO: 1664 - DNA, 18 bp, Artificial sequence
  synthetic polynucleotide sequence
gaggaggtacccatgtca

SEQ ID NO: 1665 - DNA, 18 bp, Artificial sequence
  synthetic polynucleotide sequence
atggagaggccagtacga

SEQ ID NO: 1666 - DNA, 19 bp, Artificial sequence
  synthetic polynucleotide sequence
gtagttcaggaggcagcca

SEQ ID NO: 1667 - DNA, 18 bp, Artificial sequence
  synthetic polynucleotide sequence
cgaccctccaaggacgaa

SEQ ID NO: 1668 - DNA, 18 bp, Artificial sequence
  synthetic polynucleotide sequence
caggcagcagaacaggca

SEQ ID NO: 1669 - DNA, 18 bp, Artificial sequence
  synthetic polynucleotide sequence
ctagagggtggtacccaa

SEQ ID NO: 1670 - DNA, 18 bp, Artificial sequence
  synthetic polynucleotide sequence
tcacagccgtggtgacca

SEQ ID NO: 1671 - DNA, 18 bp, Artificial sequence
  synthetic polynucleotide sequence
agacaccgctcatcccga

SEQ ID NO: 1672 - DNA, 18 bp, Artificial sequence
  synthetic polynucleotide sequence
agacccccacagtccaca

SEQ ID NO: 1673 - DNA, 18 bp, Artificial sequence
  synthetic polynucleotide sequence
ggactctaactgagccca

SEQ ID NO: 1674 - DNA, 18 bp, Artificial sequence
  synthetic polynucleotide sequence
tgcgatccatccacagca

SEQ ID NO: 1675 - DNA, 18 bp, Artificial sequence
  synthetic polynucleotide sequence
gagaggcggctccgggga

SEQ ID NO: 1676 - DNA, 18 bp, Artificial sequence
  synthetic polynucleotide sequence
gcagcagcaagataggca

SEQ ID NO: 1677 - DNA, 18 bp, Artificial sequence
  synthetic polynucleotide sequence
agcccactgccctgacca

SEQ ID NO: 1678 - DNA, 18 bp, Artificial sequence
  synthetic polynucleotide sequence
ggtgggcagggagaagca

SEQ ID NO: 1679 - DNA, 18 bp, Artificial sequence
  synthetic polynucleotide sequence
gtggttcccacagcccca

SEQ ID NO: 1680 - DNA, 18 bp, Artificial sequence
  synthetic polynucleotide sequence
agtgacgtccacagcgga

SEQ ID NO: 1681 - DNA, 18 bp, Artificial sequence
  synthetic polynucleotide sequence
agagacggctcacccgaa

SEQ ID NO: 1682 - DNA, 18 bp, Artificial sequence
  synthetic polynucleotide sequence
gtccacatcatcccggca

SEQ ID NO: 1683 - DNA, 18 bp, Artificial sequence
  synthetic polynucleotide sequence
aacccacaggagccagga

SEQ ID NO: 1684 - DNA, 18 bp, Artificial sequence
  synthetic polynucleotide sequence
gacgcaagttgtgcagca

SEQ ID NO: 1685 - DNA, 18 bp, Artificial sequence
  synthetic polynucleotide sequence
gcccttggaacacaggca

SEQ ID NO: 1686 - DNA, 18 bp, Artificial sequence
  synthetic polynucleotide sequence
tgggaagcacagcgggta

SEQ ID NO: 1687 - DNA, 18 bp, Artificial sequence
  synthetic polynucleotide sequence
ggaacagcaggccgcaga

SEQ ID NO: 1688 - DNA, 18 bp, Artificial sequence
  synthetic polynucleotide sequence
aacgctcgtatgcagcga

SEQ ID NO: 1689 - DNA, 18 bp, Artificial sequence
  synthetic polynucleotide sequence
acagcggtgccaacagca

SEQ ID NO: 1690 - DNA, 18 bp, Artificial sequence
  synthetic polynucleotide sequence
ggaggcactggtgccaca

SEQ ID NO: 1691 - DNA, 18 bp, Artificial sequence
  synthetic polynucleotide sequence
ttggtggaagcagccgga

SEQ ID NO: 1692 - DNA, 18 bp, Artificial sequence
  synthetic polynucleotide sequence
ggccctcaattacgggga

SEQ ID NO: 1693 - DNA, 18 bp, Artificial sequence
  synthetic polynucleotide sequence
ctgcgagacatcaccgca

SEQ ID NO: 1694 - DNA, 18 bp, Artificial sequence
  synthetic polynucleotide sequence
cagtccagggggtccaca

SEQ ID NO: 1695 - DNA, 18 bp, Artificial sequence
  synthetic polynucleotide sequence
cgaggggctagagaagca

SEQ ID NO: 1696 - DNA, 18 bp, Artificial sequence
  synthetic polynucleotide sequence
tcatggcagcatcggaca

SEQ ID NO: 1697 - DNA, 18 bp, Artificial sequence
  synthetic polynucleotide sequence
cgaccaggagaccagcaa

SEQ ID NO: 1698 - DNA, 18 bp, Artificial sequence
  synthetic polynucleotide sequence
acttgtgccaggcaggca

SEQ ID NO: 1699 - DNA, 18 bp, Artificial sequence
  synthetic polynucleotide sequence
agctcctgcaagatggga

SEQ ID NO: 1700 - DNA, 18 bp, Artificial sequence
  synthetic polynucleotide sequence
ggccaggatggctgagga

SEQ ID NO: 1701 - DNA, 18 bp, Artificial sequence
  synthetic polynucleotide sequence
cgaggccaaagtcaggca

SEQ ID NO: 1702 - DNA, 18 bp, Artificial sequence
  synthetic polynucleotide sequence
agggacagggtccaggga

SEQ ID NO: 1703 - DNA, 18 bp, Artificial sequence
  synthetic polynucleotide sequence
accagcccagtgaaccca

SEQ ID NO: 1704 - DNA, 18 bp, Artificial sequence
  synthetic polynucleotide sequence
agcaggaagaggactcca

SEQ ID NO: 1705 - DNA, 18 bp, Artificial sequence
  synthetic polynucleotide sequence
caccggagcaggtagaga

SEQ ID NO: 1706 - DNA, 18 bp, Artificial sequence
  synthetic polynucleotide sequence
ggggctcagtggtgacca

SEQ ID NO: 1707 - DNA, 18 bp, Artificial sequence
  synthetic polynucleotide sequence
gccaggtggagcagccaa

SEQ ID NO: 1708 - DNA, 18 bp, Artificial sequence
  synthetic polynucleotide sequence
agaggcctgaatgggaga

SEQ ID NO: 1709 - DNA, 18 bp, Artificial sequence
  synthetic polynucleotide sequence
ggcaggatgtgcatgcca

SEQ ID NO: 1710 - DNA, 18 bp, Artificial sequence
  synthetic polynucleotide sequence
tgtggcagacctcacaca

SEQ ID NO: 1711 - DNA, 18 bp, Artificial sequence
  synthetic polynucleotide sequence
cagggcactgaggacgca

SEQ ID NO: 1712 - DNA, 18 bp, Artificial sequence
  synthetic polynucleotide sequence
gccctggcagagcgcaga

SEQ ID NO: 1713 - DNA, 18 bp, Artificial sequence
  synthetic polynucleotide sequence
cacctcagctgcacccta

SEQ ID NO: 1714 - DNA, 18 bp, Artificial sequence
  synthetic polynucleotide sequence
ggtgaccaagcacttcga

SEQ ID NO: 1715 - DNA, 18 bp, Artificial sequence
  synthetic polynucleotide sequence
cactgaccaggctggaca

SEQ ID NO: 1716 - DNA, 18 bp, Artificial sequence
  synthetic polynucleotide sequence
tggacgaagatgcagcca

SEQ ID NO: 1717 - DNA, 18 bp, Artificial sequence
  synthetic polynucleotide sequence
cagtgtgacctgcaggca

SEQ ID NO: 1718 - DNA, 18 bp, Artificial sequence
  synthetic polynucleotide sequence
ccaatgcacagcagtgga

SEQ ID NO: 1719 - DNA, 18 bp, Artificial sequence
  synthetic polynucleotide sequence
ctacctgaaaggggcaca

SEQ ID NO: 1720 - DNA, 18 bp, Artificial sequence
  synthetic polynucleotide sequence
cggcagtggccggtcgga

SEQ ID NO: 1721 - DNA, 18 bp, Artificial sequence
  synthetic polynucleotide sequence
cgtccctagcacgaagca

SEQ ID NO: 1722 - DNA, 18 bp, Artificial sequence
  synthetic polynucleotide sequence
cggctgcccggttgagga

SEQ ID NO: 1723 - DNA, 18 bp, Artificial sequence
  synthetic polynucleotide sequence
gtacgacgaggagacgca

SEQ ID NO: 1724 - DNA, 18 bp, Artificial sequence
  synthetic polynucleotide sequence
agggtcacttcggccaca

SEQ ID NO: 1725 - DNA, 18 bp, Artificial sequence
  synthetic polynucleotide sequence
tgatggaagctgaggaca

SEQ ID NO: 1726 - DNA, 18 bp, Artificial sequence
  synthetic polynucleotide sequence
gcagagcaactgcagcca

SEQ ID NO: 1727 - DNA, 18 bp, Artificial sequence
  synthetic polynucleotide sequence
caggtactaccgaccgga

SEQ ID NO: 1728 - DNA, 21 bp, Artificial sequence
  synthetic polynucleotide sequence
cggctaaacatccactgagca

SEQ ID NO: 1729 - DNA, 18 bp, Artificial sequence
  synthetic polynucleotide sequence
ggcccatcctacctgcaa

SEQ ID NO: 1730 - DNA, 18 bp, Artificial sequence
  synthetic polynucleotide sequence
ggctgtcaccgacgccga

SEQ ID NO: 1731 - DNA, 18 bp, Artificial sequence
  synthetic polynucleotide sequence
agatgaccccaactggga

SEQ ID NO: 1732 - DNA, 18 bp, Artificial sequence
  synthetic polynucleotide sequence
ggcgaattaaggcaggca

SEQ ID NO: 1733 - DNA, 18 bp, Artificial sequence
  synthetic polynucleotide sequence
gctcccagagttggacca

SEQ ID NO: 1734 - DNA, 18 bp, Artificial sequence
  synthetic polynucleotide sequence
gagagtgcctctcgcaga

SEQ ID NO: 1735 - DNA, 18 bp, Artificial sequence
  synthetic polynucleotide sequence
aggctgtgaggaggcaca

SEQ ID NO: 1736 - DNA, 18 bp, Artificial sequence
  synthetic polynucleotide sequence
tgtagagtgcgcaggcca

SEQ ID NO: 1737 - DNA, 18 bp, Artificial sequence
  synthetic polynucleotide sequence
tcagggaagaggaccgca

SEQ ID NO: 1738 - DNA, 18 bp, Artificial sequence
  synthetic polynucleotide sequence
ggccattgtagcgcagca

SEQ ID NO: 1739 - DNA, 18 bp, Artificial sequence
  synthetic polynucleotide sequence
cgagaggatggggcagca

SEQ ID NO: 1740 - DNA, 18 bp, Artificial sequence
  synthetic polynucleotide sequence
tagcaccgcctccaggca

SEQ ID NO: 1741 - DNA, 18 bp, Artificial sequence
  synthetic polynucleotide sequence
cccagagacaggaccaga

SEQ ID NO: 1742 - DNA, 18 bp, Artificial sequence
  synthetic polynucleotide sequence
aaggcactgtccagcgca

SEQ ID NO: 1743 - DNA, 18 bp, Artificial sequence
  synthetic polynucleotide sequence
cccaacctgtgcagacca

SEQ ID NO: 1744 - DNA, 18 bp, Artificial sequence
  synthetic polynucleotide sequence
ggtcagcaggaagagcca

SEQ ID NO: 1745 - DNA, 18 bp, Artificial sequence
  synthetic polynucleotide sequence
cagtggcttccacagcca

SEQ ID NO: 1746 - DNA, 18 bp, Artificial sequence
  synthetic polynucleotide sequence
agccctctggccaagaca

SEQ ID NO: 1747 - DNA, 18 bp, Artificial sequence
  synthetic polynucleotide sequence
gcagacagggccaaagga

SEQ ID NO: 1748 - DNA, 18 bp, Artificial sequence
  synthetic polynucleotide sequence
cctgaggcatggtgagga

SEQ ID NO: 1749 - DNA, 18 bp, Artificial sequence
  synthetic polynucleotide sequence
gctgactctacagccaca

SEQ ID NO: 1750 - DNA, 18 bp, Artificial sequence
  synthetic polynucleotide sequence
acagctggctggacagca

SEQ ID NO: 1751 - DNA, 18 bp, Artificial sequence
  synthetic polynucleotide sequence
cctaccctacccgggaca

SEQ ID NO: 1752 - DNA, 18 bp, Artificial sequence
  synthetic polynucleotide sequence
gcctgagcaacagagcga

SEQ ID NO: 1753 - DNA, 18 bp, Artificial sequence
  synthetic polynucleotide sequence
cccgattgcccagggaca

SEQ ID NO: 1754 - DNA, 18 bp, Artificial sequence
  synthetic polynucleotide sequence
ggcctgagcctagaagga

SEQ ID NO: 1755 - DNA, 18 bp, Artificial sequence
  synthetic polynucleotide sequence
gcgggaatacatgcacca

SEQ ID NO: 1756 - DNA, 18 bp, Artificial sequence
  synthetic polynucleotide sequence
gcagtgagggttcagcca

SEQ ID NO: 1757 - DNA, 18 bp, Artificial sequence
  synthetic polynucleotide sequence
tcagccgcttccagccca

SEQ ID NO: 1758 - DNA, 18 bp, Artificial sequence
  synthetic polynucleotide sequence
ttcaccgtcggacaggga

SEQ ID NO: 1759 - DNA, 18 bp, Artificial sequence
  synthetic polynucleotide sequence
gctctcagagagaaggca

SEQ ID NO: 1760 - DNA, 18 bp, Artificial sequence
  synthetic polynucleotide sequence
gcacagctgtgacgtcga

SEQ ID NO: 1761 - DNA, 18 bp, Artificial sequence
  synthetic polynucleotide sequence
caagggcaaagagtgcta

SEQ ID NO: 1762 - DNA, 18 bp, Artificial sequence
  synthetic polynucleotide sequence
agggcttcaacaggacca

SEQ ID NO: 1763 - DNA, 19 bp, Artificial sequence
  synthetic polynucleotide sequence
aggagggaccaatgagcaa

SEQ ID NO: 1764 - DNA, 18 bp, Artificial sequence
  synthetic polynucleotide sequence
aggccatggcgtactcaa

SEQ ID NO: 1765 - DNA, 18 bp, Artificial sequence
  synthetic polynucleotide sequence
cggtaccaggagcaccaa

SEQ ID NO: 1766 - DNA, 18 bp, Artificial sequence
  synthetic polynucleotide sequence
cgggtgaggaactgcaga

SEQ ID NO: 1767 - DNA, 18 bp, Artificial sequence
  synthetic polynucleotide sequence
tcccaagctcagtcccca

SEQ ID NO: 1768 - DNA, 18 bp, Artificial sequence
  synthetic polynucleotide sequence
gcagcgtgggacttcaca

SEQ ID NO: 1769 - DNA, 18 bp, Artificial sequence
  synthetic polynucleotide sequence
ccaggtcaccagcaccaa

SEQ ID NO: 1770 - DNA, 18 bp, Artificial sequence
  synthetic polynucleotide sequence
accaaggccctcgctgga

SEQ ID NO: 1771 - DNA, 18 bp, Artificial sequence
  synthetic polynucleotide sequence
cagataccccagctccca

SEQ ID NO: 1772 - DNA, 18 bp, Artificial sequence
  synthetic polynucleotide sequence
gagctgacatcaccgtca

SEQ ID NO: 1773 - DNA, 18 bp, Artificial sequence
  synthetic polynucleotide sequence
agcaggagattccagaga

SEQ ID NO: 1774 - DNA, 18 bp, Artificial sequence
  synthetic polynucleotide sequence
tgcaagatcagagcagca

SEQ ID NO: 1775 - DNA, 21 bp, Artificial sequence
  synthetic polynucleotide sequence
ccgacactgaaagacaaggca

SEQ ID NO: 1776 - DNA, 18 bp, Artificial sequence
  synthetic polynucleotide sequence
cagtagaaccccagcaca

SEQ ID NO: 1777 - DNA, 18 bp, Artificial sequence
  synthetic polynucleotide sequence
gctgcagcagggtgacca

SEQ ID NO: 1778 - DNA, 18 bp, Artificial sequence
  synthetic polynucleotide sequence
agatgaggaagccgctga

SEQ ID NO: 1779 - DNA, 18 bp, Artificial sequence
  synthetic polynucleotide sequence
agctggagcagggggaga

SEQ ID NO: 1780 - DNA, 18 bp, Artificial sequence
  synthetic polynucleotide sequence
aagagcaggaacccggaa

SEQ ID NO: 1781 - DNA, 18 bp, Artificial sequence
  synthetic polynucleotide sequence
acgaggctgagagtgaca

SEQ ID NO: 1782 - DNA, 18 bp, Artificial sequence
  synthetic polynucleotide sequence
ccacccctcggtcggcaa

SEQ ID NO: 1783 - DNA, 18 bp, Artificial sequence
  synthetic polynucleotide sequence
gttgcaggtgggcgagga

SEQ ID NO: 1784 - DNA, 18 bp, Artificial sequence
  synthetic polynucleotide sequence
gaagagcaggaagccgga

SEQ ID NO: 1785 - DNA, 18 bp, Artificial sequence
  synthetic polynucleotide sequence
cgtgcaacattcccggca

SEQ ID NO: 1786 - DNA, 18 bp, Artificial sequence
  synthetic polynucleotide sequence
gcgtcctgggcaatagca

SEQ ID NO: 1787 - DNA, 18 bp, Artificial sequence
  synthetic polynucleotide sequence
cagcgccattgcacagga

SEQ ID NO: 1788 - DNA, 18 bp, Artificial sequence
  synthetic polynucleotide sequence
ccgtgagccttcccgcca

SEQ ID NO: 1789 - DNA, 18 bp, Artificial sequence
  synthetic polynucleotide sequence
accactacgaccccacca

SEQ ID NO: 1790 - DNA, 18 bp, Artificial sequence
  synthetic polynucleotide sequence
tgccgtcccctccgcgca

SEQ ID NO: 1791 - DNA, 18 bp, Artificial sequence
  synthetic polynucleotide sequence
cagcgccattgctcagga

SEQ ID NO: 1792 - DNA, 18 bp, Artificial sequence
  synthetic polynucleotide sequence
cccacgtccaggtgcaga

SEQ ID NO: 1793 - DNA, 18 bp, Artificial sequence
  synthetic polynucleotide sequence
cgtgcacacctggaacca

SEQ ID NO: 1794 - DNA, 18 bp, Artificial sequence
  synthetic polynucleotide sequence
tgtagaggcgtacccaca

SEQ ID NO: 1795 - DNA, 18 bp, Artificial sequence
  synthetic polynucleotide sequence
acaacggccagtaccgca

SEQ ID NO: 1796 - DNA, 18 bp, Artificial sequence
  synthetic polynucleotide sequence
caccctgcttgagagcca

SEQ ID NO: 1797 - DNA, 18 bp, Artificial sequence
  synthetic polynucleotide sequence
cggaggactacccccaga

SEQ ID NO: 1798 - DNA, 18 bp, Artificial sequence
  synthetic polynucleotide sequence
gctcccctcgaggcccca

SEQ ID NO: 1799 - DNA, 18 bp, Artificial sequence
  synthetic polynucleotide sequence
gcgagatgcagagccaga

SEQ ID NO: 1800 - DNA, 18 bp, Artificial sequence
  synthetic polynucleotide sequence
ggaagccggagaaggtga

SEQ ID NO: 1801 - DNA, 18 bp, Artificial sequence
  synthetic polynucleotide sequence
cgacgccgtcaccggcaa

SEQ ID NO: 1802 - DNA, 18 bp, Artificial sequence
  synthetic polynucleotide sequence
cctcaggctccagcctca

SEQ ID NO: 1803 - DNA, 18 bp, Artificial sequence
  synthetic polynucleotide sequence
ccagagggagagaaagga

SEQ ID NO: 1804 - DNA, 18 bp, Artificial sequence
  synthetic polynucleotide sequence
gagcacgatgcttccaca

SEQ ID NO: 1805 - DNA, 18 bp, Artificial sequence
  synthetic polynucleotide sequence
ggagctggtgaacctgga

SEQ ID NO: 1806 - DNA, 18 bp, Artificial sequence
  synthetic polynucleotide sequence
gcacgttgaggctgagga

SEQ ID NO: 1807 - DNA, 18 bp, Artificial sequence
  synthetic polynucleotide sequence
aaggagaagctggaccca

SEQ ID NO: 1808 - DNA, 18 bp, Artificial sequence
  synthetic polynucleotide sequence
tcagcaccgtgagcccca

SEQ ID NO: 1809 - DNA, 18 bp, Artificial sequence
  synthetic polynucleotide sequence
accaggcctctggcagca

SEQ ID NO: 1810 - DNA, 18 bp, Artificial sequence
  synthetic polynucleotide sequence
acagaaggaaccctgtga

SEQ ID NO: 1811 - DNA, 18 bp, Artificial sequence
  synthetic polynucleotide sequence
cccggactaccgtcagga

SEQ ID NO: 1812 - DNA, 18 bp, Artificial sequence
  synthetic polynucleotide sequence
gctacgggcagacggaca

SEQ ID NO: 1813 - DNA, 18 bp, Artificial sequence
  synthetic polynucleotide sequence
tggagctgcagcacagca

SEQ ID NO: 1814 - DNA, 18 bp, Artificial sequence
  synthetic polynucleotide sequence
ccctgggagctacaggca

SEQ ID NO: 1815 - DNA, 18 bp, Artificial sequence
  synthetic polynucleotide sequence
ctggaggagagaagggca

SEQ ID NO: 1816 - DNA, 18 bp, Artificial sequence
  synthetic polynucleotide sequence
acccgtgtgtagagccca

SEQ ID NO: 1817 - DNA, 18 bp, Artificial sequence
  synthetic polynucleotide sequence
ggaggtggtgacagacca

SEQ ID NO: 1818 - DNA, 18 bp, Artificial sequence
  synthetic polynucleotide sequence
gtcagcagagccaaggca

SEQ ID NO: 1819 - DNA, 18 bp, Artificial sequence
  synthetic polynucleotide sequence
aaggtggtcacgacccca

SEQ ID NO: 1820 - DNA, 18 bp, Artificial sequence
  synthetic polynucleotide sequence
ccagcaccttcctcacca

SEQ ID NO: 1821 - DNA, 18 bp, Artificial sequence
  synthetic polynucleotide sequence
gagaggacatggcctcca

SEQ ID NO: 1822 - DNA, 18 bp, Artificial sequence
  synthetic polynucleotide sequence
cacagaggagaggcctga

SEQ ID NO: 1823 - DNA, 18 bp, Artificial sequence
  synthetic polynucleotide sequence
cacccatgtccaggccca

SEQ ID NO: 1824 - DNA, 18 bp, Artificial sequence
  synthetic polynucleotide sequence
caggctccagtgacacca

SEQ ID NO: 1825 - DNA, 18 bp, Artificial sequence
  synthetic polynucleotide sequence
agccttctgggccacaga

SEQ ID NO: 1826 - DNA, 18 bp, Artificial sequence
  synthetic polynucleotide sequence
atcagagctcagcgggga

SEQ ID NO: 1827 - DNA, 18 bp, Artificial sequence
  synthetic polynucleotide sequence
gggaggagaggctagaga

SEQ ID NO: 1828 - DNA, 18 bp, Artificial sequence
  synthetic polynucleotide sequence
agtctggccaggtccaca

SEQ ID NO: 1829 - DNA, 18 bp, Artificial sequence
  synthetic polynucleotide sequence
ggcagctgtgggaccgga

SEQ ID NO: 1830 - DNA, 18 bp, Artificial sequence
  synthetic polynucleotide sequence
ctccggggaccaattgca

SEQ ID NO: 1831 - DNA, 18 bp, Artificial sequence
  synthetic polynucleotide sequence
gccctatggagtcaagca

SEQ ID NO: 1832 - DNA, 18 bp, Artificial sequence
  synthetic polynucleotide sequence
accaccagcctcaggcca

SEQ ID NO: 1833 - DNA, 18 bp, Artificial sequence
  synthetic polynucleotide sequence
ggacccagcgaaggagga

SEQ ID NO: 1834 - DNA, 18 bp, Artificial sequence
  synthetic polynucleotide sequence
tctgcacatccccaggga

SEQ ID NO: 1835 - DNA, 18 bp, Artificial sequence
  synthetic polynucleotide sequence
cccaacccagttcagcca

SEQ ID NO: 1836 - DNA, 18 bp, Artificial sequence
  synthetic polynucleotide sequence
cggagactggtcacagca

SEQ ID NO: 1837 - DNA, 18 bp, Artificial sequence
  synthetic polynucleotide sequence
ccatcaccacgtgggaga

SEQ ID NO: 1838 - DNA, 18 bp, Artificial sequence
  synthetic polynucleotide sequence
cagagtagggtagccgca

SEQ ID NO: 1839 - DNA, 18 bp, Artificial sequence
  synthetic polynucleotide sequence
caacacccctcgtggcaa

SEQ ID NO: 1840 - DNA, 18 bp, Artificial sequence
  synthetic polynucleotide sequence
agacagccaccaccacca

SEQ ID NO: 1841 - DNA, 18 bp, Artificial sequence
  synthetic polynucleotide sequence
agaccaaggactcgggca

SEQ ID NO: 1842 - DNA, 18 bp, Artificial sequence
  synthetic polynucleotide sequence
gctcggggttgaaggcca

SEQ ID NO: 1843 - DNA, 18 bp, Artificial sequence
  synthetic polynucleotide sequence
gatgagggtgcagagcca

SEQ ID NO: 1844 - DNA, 18 bp, Artificial sequence
  synthetic polynucleotide sequence
accagtgactgagcccca

SEQ ID NO: 1845 - DNA, 18 bp, Artificial sequence
  synthetic polynucleotide sequence
tcccgagaccaaggacca

SEQ ID NO: 1846 - DNA, 18 bp, Artificial sequence
  synthetic polynucleotide sequence
cgtgacaaccaagccgca

SEQ ID NO: 1847 - DNA, 18 bp, Artificial sequence
  synthetic polynucleotide sequence
taggccgacaaaagagga

SEQ ID NO: 1848 - DNA, 18 bp, Artificial sequence
  synthetic polynucleotide sequence
gggcaacataacgcctca

SEQ ID NO: 1849 - DNA, 18 bp, Artificial sequence
  synthetic polynucleotide sequence
gaggaccacacctgggca

SEQ ID NO: 1850 - DNA, 18 bp, Artificial sequence
  synthetic polynucleotide sequence
ccactccccatcaacgca

SEQ ID NO: 1851 - DNA, 18 bp, Artificial sequence
  synthetic polynucleotide sequence
tgcggaagacagcctgca

SEQ ID NO: 1852 - DNA, 18 bp, Artificial sequence
  synthetic polynucleotide sequence
cagcaggcacacagggca

SEQ ID NO: 1853 - DNA, 18 bp, Artificial sequence
  synthetic polynucleotide sequence
gagtggccagcacagaca

SEQ ID NO: 1854 - DNA, 18 bp, Artificial sequence
  synthetic polynucleotide sequence
gggagacctggttccaca

SEQ ID NO: 1855 - DNA, 18 bp, Artificial sequence
  synthetic polynucleotide sequence
cctaacactggtacggca

SEQ ID NO: 1856 - DNA, 18 bp, Artificial sequence
  synthetic polynucleotide sequence
gtcaggccctcaatggca

SEQ ID NO: 1857 - DNA, 18 bp, Artificial sequence
  synthetic polynucleotide sequence
tcgaggccaagcggacca

SEQ ID NO: 1858 - DNA, 18 bp, Artificial sequence
  synthetic polynucleotide sequence
accccaagccacggcaca

SEQ ID NO: 1859 - DNA, 18 bp, Artificial sequence
  synthetic polynucleotide sequence
ggccgctgggcacagcca

SEQ ID NO: 1860 - DNA, 18 bp, Artificial sequence
  synthetic polynucleotide sequence
tacaggaagagcatggga

SEQ ID NO: 1861 - DNA, 18 bp, Artificial sequence
  synthetic polynucleotide sequence
ggcttgcacctcaaacca

SEQ ID NO: 1862 - DNA, 18 bp, Artificial sequence
  synthetic polynucleotide sequence
tcagacacgctgtccaca

SEQ ID NO: 1863 - DNA, 18 bp, Artificial sequence
  synthetic polynucleotide sequence
agacgacaagccagacga

SEQ ID NO: 1864 - DNA, 18 bp, Artificial sequence
  synthetic polynucleotide sequence
aggatgaactcgactgca

SEQ ID NO: 1865 - DNA, 18 bp, Artificial sequence
  synthetic polynucleotide sequence
gacccaccctctcaggga

SEQ ID NO: 1866 - DNA, 18 bp, Artificial sequence
  synthetic polynucleotide sequence
ggtactccaggaagacca

SEQ ID NO: 1867 - DNA, 18 bp, Artificial sequence
  synthetic polynucleotide sequence
atcaactcggcgcacgga

SEQ ID NO: 1868 - DNA, 18 bp, Artificial sequence
  synthetic polynucleotide sequence
cactccactctggccaga

SEQ ID NO: 1869 - DNA, 18 bp, Artificial sequence
  synthetic polynucleotide sequence
acccctcccacctggaga

SEQ ID NO: 1870 - DNA, 18 bp, Artificial sequence
  synthetic polynucleotide sequence
cgaacgggtgctgctcga

SEQ ID NO: 1871 - DNA, 18 bp, Artificial sequence
  synthetic polynucleotide sequence
atcggtatccaggaggca

SEQ ID NO: 1872 - DNA, 18 bp, Artificial sequence
  synthetic polynucleotide sequence
aagagccaggagggcgga

SEQ ID NO: 1873 - DNA, 18 bp, Artificial sequence
  synthetic polynucleotide sequence
ccagcgaggaccaggcga

SEQ ID NO: 1874 - DNA, 18 bp, Artificial sequence
  synthetic polynucleotide sequence
cactccagggaaggggca

SEQ ID NO: 1875 - DNA, 18 bp, Artificial sequence
  synthetic polynucleotide sequence
acctggaccaggaaccga

SEQ ID NO: 1876 - DNA, 18 bp, Artificial sequence
  synthetic polynucleotide sequence
gcatagatggtggaggca

SEQ ID NO: 1877 - DNA, 18 bp, Artificial sequence
  synthetic polynucleotide sequence
gacaggcagattagctga

SEQ ID NO: 1878 - DNA, 18 bp, Artificial sequence
  synthetic polynucleotide sequence
acaccagaatcaaccgca

SEQ ID NO: 1879 - DNA, 18 bp, Artificial sequence
  synthetic polynucleotide sequence
aatgtcagcgctgggaga

SEQ ID NO: 1880 - DNA, 18 bp, Artificial sequence
  synthetic polynucleotide sequence
tctcagctgaggcaggca

SEQ ID NO: 1881 - DNA, 18 bp, Artificial sequence
  synthetic polynucleotide sequence
gcagccttcccgaagcca

SEQ ID NO: 1882 - DNA, 18 bp, Artificial sequence
  synthetic polynucleotide sequence
ggccaacaggagaggcca

SEQ ID NO: 1883 - DNA, 18 bp, Artificial sequence
  synthetic polynucleotide sequence
ctgcctgggactcggaga

SEQ ID NO: 1884 - DNA, 18 bp, Artificial sequence
  synthetic polynucleotide sequence
ctggcagggagtaggcca

SEQ ID NO: 1885 - DNA, 18 bp, Artificial sequence
  synthetic polynucleotide sequence
ctgaggcctcccaagtca

SEQ ID NO: 1886 - DNA, 18 bp, Artificial sequence
  synthetic polynucleotide sequence
gctctggcaggcctccaa

SEQ ID NO: 1887 - DNA, 18 bp, Artificial sequence
  synthetic polynucleotide sequence
gatgcagcctatccacga

SEQ ID NO: 1888 - DNA, 18 bp, Artificial sequence
  synthetic polynucleotide sequence
ggagctccagcaactcca

SEQ ID NO: 1889 - DNA, 18 bp, Artificial sequence
  synthetic polynucleotide sequence
ggcggacctgatgcagga

SEQ ID NO: 1890 - DNA, 18 bp, Artificial sequence
  synthetic polynucleotide sequence
gggagcacagtggcagga

SEQ ID NO: 1891 - DNA, 18 bp, Artificial sequence
  synthetic polynucleotide sequence
tgagcagcgggtccagga

SEQ ID NO: 1892 - DNA, 18 bp, Artificial sequence
  synthetic polynucleotide sequence
agcctcgcagaagccgta

SEQ ID NO: 1893 - DNA, 18 bp, Artificial sequence
  synthetic polynucleotide sequence
gcaaagcgaagccaccaa

SEQ ID NO: 1894 - DNA, 18 bp, Artificial sequence
  synthetic polynucleotide sequence
cgaagtggtagccatgga

SEQ ID NO: 1895 - DNA, 18 bp, Artificial sequence
  synthetic polynucleotide sequence
atgggcacagagaaggga

SEQ ID NO: 1896 - DNA, 18 bp, Artificial sequence
  synthetic polynucleotide sequence
ccggggacgccgcaggaa

SEQ ID NO: 1897 - DNA, 18 bp, Artificial sequence
  synthetic polynucleotide sequence
cacagagccctgtgagga

SEQ ID NO: 1898 - DNA, 18 bp, Artificial sequence
  synthetic polynucleotide sequence
cattacaccgaagtcgca

SEQ ID NO: 1899 - DNA, 18 bp, Artificial sequence
  synthetic polynucleotide sequence
gaagcgcagggagaagga

SEQ ID NO: 1900 - DNA, 18 bp, Artificial sequence
  synthetic polynucleotide sequence
tcacaccaccgatggcga

SEQ ID NO: 1901 - DNA, 18 bp, Artificial sequence
  synthetic polynucleotide sequence
cgaccgagcaggacccca

SEQ ID NO: 1902 - DNA, 18 bp, Artificial sequence
  synthetic polynucleotide sequence
ggggccaccggcatccta

SEQ ID NO: 1903 - DNA, 18 bp, Artificial sequence
  synthetic polynucleotide sequence
ttggtgaggccaacccaa

SEQ ID NO: 1904 - DNA, 18 bp, Artificial sequence
  synthetic polynucleotide sequence
agtcagagagccagggta

SEQ ID NO: 1905 - DNA, 18 bp, Artificial sequence
  synthetic polynucleotide sequence
cctgctcagccagaacca

SEQ ID NO: 1906 - DNA, 18 bp, Artificial sequence
  synthetic polynucleotide sequence
gtggctggacaggcctga

SEQ ID NO: 1907 - DNA, 18 bp, Artificial sequence
  synthetic polynucleotide sequence
gcgacaccatcactcgca

SEQ ID NO: 1908 - DNA, 18 bp, Artificial sequence
  synthetic polynucleotide sequence
gctcaggagtctcaggga

SEQ ID NO: 1909 - DNA, 18 bp, Artificial sequence
  synthetic polynucleotide sequence
ctgcacacacatggacga

SEQ ID NO: 1910 - DNA, 18 bp, Artificial sequence
  synthetic polynucleotide sequence
gaatgccagccagggcca

SEQ ID NO: 1911 - DNA, 18 bp, Artificial sequence
  synthetic polynucleotide sequence
tgcacaacaatggccaca

SEQ ID NO: 1912 - DNA, 18 bp, Artificial sequence
  synthetic polynucleotide sequence
tgcaggtggagctgggca

SEQ ID NO: 1913 - DNA, 18 bp, Artificial sequence
  synthetic polynucleotide sequence
caagggaggacccctgga

SEQ ID NO: 1914 - DNA, 18 bp, Artificial sequence
  synthetic polynucleotide sequence
cctagaacggccagtcca

SEQ ID NO: 1915 - DNA, 18 bp, Artificial sequence
  synthetic polynucleotide sequence
ctacgatggcagagagca

SEQ ID NO: 1916 - DNA, 18 bp, Artificial sequence
  synthetic polynucleotide sequence
gctgaatgggctcccgga

SEQ ID NO: 1917 - DNA, 18 bp, Artificial sequence
  synthetic polynucleotide sequence
tcagcggctctgagcaca

SEQ ID NO: 1918 - DNA, 18 bp, Artificial sequence
  synthetic polynucleotide sequence
cctcaacgaaggctgcca

SEQ ID NO: 1919 - DNA, 18 bp, Artificial sequence
  synthetic polynucleotide sequence
gagtggggctacgaggaa

SEQ ID NO: 1920 - DNA, 18 bp, Artificial sequence
  synthetic polynucleotide sequence
aatttggggagaggcgga

SEQ ID NO: 1921 - DNA, 18 bp, Artificial sequence
  synthetic polynucleotide sequence
gaacttccgagcgacgca

SEQ ID NO: 1922 - DNA, 18 bp, Artificial sequence
  synthetic polynucleotide sequence
accagcagccaggcagga

SEQ ID NO: 1923 - DNA, 18 bp, Artificial sequence
  synthetic polynucleotide sequence
gacagataggcactcgga

SEQ ID NO: 1924 - DNA, 18 bp, Artificial sequence
  synthetic polynucleotide sequence
atcccacaacgtaaggca

SEQ ID NO: 1925 - DNA, 18 bp, Artificial sequence
  synthetic polynucleotide sequence
gaagcttgcgcaggagga

SEQ ID NO: 1926 - DNA, 18 bp, Artificial sequence
  synthetic polynucleotide sequence
ggctgctaacagcacaca

SEQ ID NO: 1927 - DNA, 18 bp, Artificial sequence
  synthetic polynucleotide sequence
gctacatgcccaccgaga

SEQ ID NO: 1928 - DNA, 18 bp, Artificial sequence
  synthetic polynucleotide sequence
gccccattagctccacga

SEQ ID NO: 1929 - DNA, 18 bp, Artificial sequence
  synthetic polynucleotide sequence
tggcatcgacgtggagga

SEQ ID NO: 1930 - DNA, 18 bp, Artificial sequence
  synthetic polynucleotide sequence
gtggcactccggaagaga

SEQ ID NO: 1931 - DNA, 18 bp, Artificial sequence
  synthetic polynucleotide sequence
aacgccctgctgcagaga

SEQ ID NO: 1932 - DNA, 18 bp, Artificial sequence
  synthetic polynucleotide sequence
gaggcctcactgtccaga

SEQ ID NO: 1933 - DNA, 18 bp, Artificial sequence
  synthetic polynucleotide sequence
ggccatcaacagggccaa

SEQ ID NO: 1934 - DNA, 18 bp, Artificial sequence
  synthetic polynucleotide sequence
tgaagagctggaccccga

SEQ ID NO: 1935 - DNA, 18 bp, Artificial sequence
  synthetic polynucleotide sequence
agcagaggagtgcggaca

SEQ ID NO: 1936 - DNA, 18 bp, Artificial sequence
  synthetic polynucleotide sequence
ggtcacaggcatcagcga

SEQ ID NO: 1937 - DNA, 18 bp, Artificial sequence
  synthetic polynucleotide sequence
tgggaagctgtgcccaca

SEQ ID NO: 1938 - DNA, 18 bp, Artificial sequence
  synthetic polynucleotide sequence
tcagggatgtccggacca

SEQ ID NO: 1939 - DNA, 18 bp, Artificial sequence
  synthetic polynucleotide sequence
acgagggcaacctgagca

SEQ ID NO: 1940 - DNA, 18 bp, Artificial sequence
  synthetic polynucleotide sequence
cggaacctggactgagga

SEQ ID NO: 1941 - DNA, 18 bp, Artificial sequence
  synthetic polynucleotide sequence
gcacctggaggagagcaa

SEQ ID NO: 1942 - DNA, 18 bp, Artificial sequence
  synthetic polynucleotide sequence
gcgagagcatcctggaca

SEQ ID NO: 1943 - DNA, 18 bp, Artificial sequence
  synthetic polynucleotide sequence
agcagtcaagcaccccca

SEQ ID NO: 1944 - DNA, 18 bp, Artificial sequence
  synthetic polynucleotide sequence
acccttggtgaccgcaga

SEQ ID NO: 1945 - DNA, 18 bp, Artificial sequence
  synthetic polynucleotide sequence
ctggcagatgcctgccaa

SEQ ID NO: 1946 - DNA, 18 bp, Artificial sequence
  synthetic polynucleotide sequence
gttcaggcatcccaggga

SEQ ID NO: 1947 - DNA, 18 bp, Artificial sequence
  synthetic polynucleotide sequence
gcaggacatcgctcagca

SEQ ID NO: 1948 - DNA, 18 bp, Artificial sequence
  synthetic polynucleotide sequence
agggaggccgtgaagtca

SEQ ID NO: 1949 - DNA, 18 bp, Artificial sequence
  synthetic polynucleotide sequence
ctagtgcagagaccgcga

SEQ ID NO: 1950 - DNA, 18 bp, Artificial sequence
  synthetic polynucleotide sequence
gagcagcagttgcaggga

SEQ ID NO: 1951 - DNA, 18 bp, Artificial sequence
  synthetic polynucleotide sequence
tgacccagctgctcagca

SEQ ID NO: 1952 - DNA, 18 bp, Artificial sequence
  synthetic polynucleotide sequence
taccaggagccccagaca

SEQ ID NO: 1953 - DNA, 18 bp, Artificial sequence
  synthetic polynucleotide sequence
taccccagcagccaccca

SEQ ID NO: 1954 - DNA, 18 bp, Artificial sequence
  synthetic polynucleotide sequence
cccagctccgtgtaggca

SEQ ID NO: 1955 - DNA, 18 bp, Artificial sequence
  synthetic polynucleotide sequence
ccacagagacgagaccca

SEQ ID NO: 1956 - DNA, 18 bp, Artificial sequence
  synthetic polynucleotide sequence
tcgatccacgtcccggga

SEQ ID NO: 1957 - DNA, 18 bp, Artificial sequence
  synthetic polynucleotide sequence
ctgatgaggccagcgaga

SEQ ID NO: 1958 - DNA, 18 bp, Artificial sequence
  synthetic polynucleotide sequence
gcccgttagcactaggca

SEQ ID NO: 1959 - DNA, 18 bp, Artificial sequence
  synthetic polynucleotide sequence
ttccgagcaactcccaca

SEQ ID NO: 1960 - DNA, 18 bp, Artificial sequence
  synthetic polynucleotide sequence
acggccccactaacacca

SEQ ID NO: 1961 - DNA, 18 bp, Artificial sequence
  synthetic polynucleotide sequence
ggacaccgtctggatcga

SEQ ID NO: 1962 - DNA, 18 bp, Artificial sequence
  synthetic polynucleotide sequence
tccggggcattcgaggca

SEQ ID NO: 1963 - DNA, 18 bp, Artificial sequence
  synthetic polynucleotide sequence
ggcctacacggatggaga

SEQ ID NO: 1964 - DNA, 18 bp, Artificial sequence
  synthetic polynucleotide sequence
ccacaccatcagaggcca

SEQ ID NO: 1965 - DNA, 18 bp, Artificial sequence
  synthetic polynucleotide sequence
agccatcgggaagcccca

SEQ ID NO: 1966 - DNA, 18 bp, Artificial sequence
  synthetic polynucleotide sequence
atgaacaggttgggccca

SEQ ID NO: 1967 - DNA, 18 bp, Artificial sequence
  synthetic polynucleotide sequence
ccagaatggccctgacca

SEQ ID NO: 1968 - DNA, 18 bp, Artificial sequence
  synthetic polynucleotide sequence
ccagatatcgaccaagca

SEQ ID NO: 1969 - DNA, 18 bp, Artificial sequence
  synthetic polynucleotide sequence
ggcacctacggctgcaca

SEQ ID NO: 1970 - DNA, 18 bp, Artificial sequence
  synthetic polynucleotide sequence
gcatgatgagcagcagga

SEQ ID NO: 1971 - DNA, 18 bp, Artificial sequence
  synthetic polynucleotide sequence
gctccaggaatacaccca

SEQ ID NO: 1972 - DNA, 18 bp, Artificial sequence
  synthetic polynucleotide sequence
gacaggcaggagtcggga

SEQ ID NO: 1973 - DNA, 18 bp, Artificial sequence
  synthetic polynucleotide sequence
gcaggcttgctgagcaga

SEQ ID NO: 1974 - DNA, 18 bp, Artificial sequence
  synthetic polynucleotide sequence
aaggctttggaacccaca

SEQ ID NO: 1975 - DNA, 18 bp, Artificial sequence
  synthetic polynucleotide sequence
cctggagagcagcccaga

SEQ ID NO: 1976 - DNA, 18 bp, Artificial sequence
  synthetic polynucleotide sequence
gcacatagtcctgcacca

SEQ ID NO: 1977 - DNA, 18 bp, Artificial sequence
  synthetic polynucleotide sequence
aagcgccaatgggcccaa

SEQ ID NO: 1978 - DNA, 18 bp, Artificial sequence
  synthetic polynucleotide sequence
ggctgcagcgcgagcaga

SEQ ID NO: 1979 - DNA, 18 bp, Artificial sequence
  synthetic polynucleotide sequence
gcctaagttgccaaagga

SEQ ID NO: 1980 - DNA, 18 bp, Artificial sequence
  synthetic polynucleotide sequence
gccttcacagagcatcca

SEQ ID NO: 1981 - DNA, 18 bp, Artificial sequence
  synthetic polynucleotide sequence
gcgtgaggaaagacgcca

SEQ ID NO: 1982 - DNA, 18 bp, Artificial sequence
  synthetic polynucleotide sequence
ctgcttgggagcgacaga

SEQ ID NO: 1983 - DNA, 18 bp, Artificial sequence
  synthetic polynucleotide sequence
tcactgggtcagaaccca

SEQ ID NO: 1984 - DNA, 18 bp, Artificial sequence
  synthetic polynucleotide sequence
ctcggaatgcctcacgga

SEQ ID NO: 1985 - DNA, 17 bp, Artificial sequence
  synthetic polynucleotide sequence
gggcagaatcccacaga

SEQ ID NO: 1986 - DNA, 16 bp, Artificial sequence
  synthetic polynucleotide sequence
gcgaagttctgcagca

SEQ ID NO: 1987 - DNA, 18 bp, Artificial sequence
  synthetic polynucleotide sequence
tgaagcagagctgcagga

SEQ ID NO: 1988 - DNA, 18 bp, Artificial sequence
  synthetic polynucleotide sequence
ggccatcatggtcaggaa

SEQ ID NO: 1989 - DNA, 18 bp, Artificial sequence
  synthetic polynucleotide sequence
ctccgaggttgacagcga

SEQ ID NO: 1990 - DNA, 18 bp, Artificial sequence
  synthetic polynucleotide sequence
cgcggaaggcgacctgca

SEQ ID NO: 1991 - DNA, 18 bp, Artificial sequence
  synthetic polynucleotide sequence
cacttggatccacccaga

SEQ ID NO: 1992 - DNA, 18 bp, Artificial sequence
  synthetic polynucleotide sequence
gccagacttgacctgcca

SEQ ID NO: 1993 - DNA, 18 bp, Artificial sequence
  synthetic polynucleotide sequence
accactcagaatggccga

SEQ ID NO: 1994 - DNA, 18 bp, Artificial sequence
  synthetic polynucleotide sequence
aatgtagccccctccaca

SEQ ID NO: 1995 - DNA, 18 bp, Artificial sequence
  synthetic polynucleotide sequence
tgggtaaagacagagcga

SEQ ID NO: 1996 - DNA, 18 bp, Artificial sequence
  synthetic polynucleotide sequence
gtctgagggaaggatcca

SEQ ID NO: 1997 - DNA, 18 bp, Artificial sequence
  synthetic polynucleotide sequence
gaactgcagccacccaga

SEQ ID NO: 1998 - DNA, 18 bp, Artificial sequence
  synthetic polynucleotide sequence
caggaagccgtcggggca

SEQ ID NO: 1999 - DNA, 18 bp, Artificial sequence
  synthetic polynucleotide sequence
agtccgtcagcgcccaga

SEQ ID NO: 2000 - DNA, 18 bp, Artificial sequence
  synthetic polynucleotide sequence
agagcgtggaaggtgcca

SEQ ID NO: 2001 - DNA, 18 bp, Artificial sequence
  synthetic polynucleotide sequence
cccttaagcacccctgga

SEQ ID NO: 2002 - DNA, 18 bp, Artificial sequence
  synthetic polynucleotide sequence
ccagcatcgtggtgagaa

SEQ ID NO: 2003 - DNA, 18 bp, Artificial sequence
  synthetic polynucleotide sequence
aagcccggaagcaggaga

SEQ ID NO: 2004 - DNA, 18 bp, Artificial sequence
  synthetic polynucleotide sequence
tcagccctgggtcacaga

SEQ ID NO: 2005 - DNA, 18 bp, Artificial sequence
  synthetic polynucleotide sequence
gatgccgcctgcatagca

SEQ ID NO: 2006 - DNA, 18 bp, Artificial sequence
  synthetic polynucleotide sequence
cggcggtgccacacacga

SEQ ID NO: 2007 - DNA, 18 bp, Artificial sequence
  synthetic polynucleotide sequence
gctgagcccctacggcga

SEQ ID NO: 2008 - DNA, 18 bp, Artificial sequence
  synthetic polynucleotide sequence
gttctgcccggcgccgaa

SEQ ID NO: 2009 - DNA, 18 bp, Artificial sequence
  synthetic polynucleotide sequence
cgcagttaagggggcaca

SEQ ID NO: 2010 - DNA, 18 bp, Artificial sequence
  synthetic polynucleotide sequence
ccactgccttgggcacca

SEQ ID NO: 2011 - DNA, 18 bp, Artificial sequence
  synthetic polynucleotide sequence
gctggacaagaaccccga

SEQ ID NO: 2012 - DNA, 18 bp, Artificial sequence
  synthetic polynucleotide sequence
cccatgcctcgtgaccca

SEQ ID NO: 2013 - DNA, 18 bp, Artificial sequence
  synthetic polynucleotide sequence
tgaccctcaaccaggcca

SEQ ID NO: 2014 - DNA, 18 bp, Artificial sequence
  synthetic polynucleotide sequence
aatcacccagcagggcaa

SEQ ID NO: 2015 - DNA, 18 bp, Artificial sequence
  synthetic polynucleotide sequence
gtagcctgcagctgagca

SEQ ID NO: 2016 - DNA, 18 bp, Artificial sequence
  synthetic polynucleotide sequence
gggagtagtcggtcacca

SEQ ID NO: 2017 - DNA, 18 bp, Artificial sequence
  synthetic polynucleotide sequence
ccaacaccgacgaccaga

SEQ ID NO: 2018 - DNA, 18 bp, Artificial sequence
  synthetic polynucleotide sequence
cgtccagcgtgaaggcca

SEQ ID NO: 2019 - DNA, 18 bp, Artificial sequence
  synthetic polynucleotide sequence
cgcagagaaacctgagga

SEQ ID NO: 2020 - DNA, 18 bp, Artificial sequence
  synthetic polynucleotide sequence
aatcacaggtcgctgcca

SEQ ID NO: 2021 - DNA, 18 bp, Artificial sequence
  synthetic polynucleotide sequence
gaagaaccgaggcagcaa

SEQ ID NO: 2022 - DNA, 18 bp, Artificial sequence
  synthetic polynucleotide sequence
taagggccaggcttggga

SEQ ID NO: 2023 - DNA, 18 bp, Artificial sequence
  synthetic polynucleotide sequence
cggccgtcagcgaaagca

SEQ ID NO: 2024 - DNA, 18 bp, Artificial sequence
  synthetic polynucleotide sequence
cccaatccacatgacgca

SEQ ID NO: 2025 - DNA, 18 bp, Artificial sequence
  synthetic polynucleotide sequence
ggaaggggcgaaaagcga

SEQ ID NO: 2026 - DNA, 18 bp, Artificial sequence
  synthetic polynucleotide sequence
ggcgtactgcatgcgcga

SEQ ID NO: 2027 - DNA, 17 bp, Artificial sequence
  synthetic polynucleotide sequence
ggacaagtcgggcagca

SEQ ID NO: 2028 - DNA, 18 bp, Artificial sequence
  synthetic polynucleotide sequence
tagccgcaccaggcagca

SEQ ID NO: 2029 - DNA, 18 bp, Artificial sequence
  synthetic polynucleotide sequence
gccctgtcaactccacca

SEQ ID NO: 2030 - DNA, 18 bp, Artificial sequence
  synthetic polynucleotide sequence
gcgtttccagccgaacca

SEQ ID NO: 2031 - DNA, 18 bp, Artificial sequence
  synthetic polynucleotide sequence
ccatgcggtacgcagaca

SEQ ID NO: 2032 - DNA, 18 bp, Artificial sequence
  synthetic polynucleotide sequence
catggtgagctgcagcca

SEQ ID NO: 2033 - DNA, 18 bp, Artificial sequence
  synthetic polynucleotide sequence
cccacaaccttcgagcca

SEQ ID NO: 2034 - DNA, 18 bp, Artificial sequence
  synthetic polynucleotide sequence
ggggagtccttgaggcca

SEQ ID NO: 2035 - DNA, 18 bp, Artificial sequence
  synthetic polynucleotide sequence
ctacgaggaccaaggcaa

SEQ ID NO: 2036 - DNA, 18 bp, Artificial sequence
  synthetic polynucleotide sequence
aagccatggggaccagga

SEQ ID NO: 2037 - DNA, 18 bp, Artificial sequence
  synthetic polynucleotide sequence
ctgacaagtccggcacca

SEQ ID NO: 2038 - DNA, 18 bp, Artificial sequence
  synthetic polynucleotide sequence
cattctccagccggacca

SEQ ID NO: 2039 - DNA, 18 bp, Artificial sequence
  synthetic polynucleotide sequence
cagttcgacactgaccga

SEQ ID NO: 2040 - DNA, 18 bp, Artificial sequence
  synthetic polynucleotide sequence
cacggaacatggcgtcca

SEQ ID NO: 2041 - DNA, 18 bp, Artificial sequence
  synthetic polynucleotide sequence
ccgccaggatggaaccaa

SEQ ID NO: 2042 - DNA, 18 bp, Artificial sequence
  synthetic polynucleotide sequence
tagggcctcgtggaagga

SEQ ID NO: 2043 - DNA, 18 bp, Artificial sequence
  synthetic polynucleotide sequence
accacgaagggtaccgga

SEQ ID NO: 2044 - DNA, 18 bp, Artificial sequence
  synthetic polynucleotide sequence
gtagaacgagtcccccga

SEQ ID NO: 2045 - DNA, 18 bp, Artificial sequence
  synthetic polynucleotide sequence
tccgatcagtccaaccca

SEQ ID NO: 2046 - DNA, 18 bp, Artificial sequence
  synthetic polynucleotide sequence
gaaggcttagactgggga

SEQ ID NO: 2047 - DNA, 17 bp, Artificial sequence
  synthetic polynucleotide sequence
catcgacccctcacgca

SEQ ID NO: 2048 - DNA, 17 bp, Artificial sequence
  synthetic polynucleotide sequence
gtccaggagcacaccca

SEQ ID NO: 2049 - DNA, 18 bp, Artificial sequence
  synthetic polynucleotide sequence
cctctccaacggccagca

SEQ ID NO: 2050 - DNA, 18 bp, Artificial sequence
  synthetic polynucleotide sequence
gcgcccagtgtaccagga

SEQ ID NO: 2051 - DNA, 18 bp, Artificial sequence
  synthetic polynucleotide sequence
gagctacctccacgccaa

SEQ ID NO: 2052 - DNA, 18 bp, Artificial sequence
  synthetic polynucleotide sequence
cagacttggccatcagga

SEQ ID NO: 2053 - DNA, 18 bp, Artificial sequence
  synthetic polynucleotide sequence
ggtagaggatgcgccaca

SEQ ID NO: 2054 - DNA, 18 bp, Artificial sequence
  synthetic polynucleotide sequence
gggccattgtcggagaca

SEQ ID NO: 2055 - DNA, 18 bp, Artificial sequence
  synthetic polynucleotide sequence
gaagcgctctcccaacga

SEQ ID NO: 2056 - DNA, 18 bp, Artificial sequence
  synthetic polynucleotide sequence
catggtgggggaaccgga

SEQ ID NO: 2057 - DNA, 18 bp, Artificial sequence
  synthetic polynucleotide sequence
cgagaaggagctgatcga

SEQ ID NO: 2058 - DNA, 18 bp, Artificial sequence
  synthetic polynucleotide sequence
cggcgtcacacatgggga

SEQ ID NO: 2059 - DNA, 18 bp, Artificial sequence
  synthetic polynucleotide sequence
gagcaatctcccaggcaa

SEQ ID NO: 2060 - DNA, 18 bp, Artificial sequence
  synthetic polynucleotide sequence
ttggcgacgagcctcaca

SEQ ID NO: 2061 - DNA, 18 bp, Artificial sequence
  synthetic polynucleotide sequence
tggaaaggctggatgcaa

SEQ ID NO: 2062 - DNA, 18 bp, Artificial sequence
  synthetic polynucleotide sequence
gcagcaaccagaactcga

SEQ ID NO: 2063 - DNA, 18 bp, Artificial sequence
  synthetic polynucleotide sequence
cacaccgcccagagcaca

SEQ ID NO: 2064 - DNA, 18 bp, Artificial sequence
  synthetic polynucleotide sequence
caccacggcaggcctgga

SEQ ID NO: 2065 - DNA, 18 bp, Artificial sequence
  synthetic polynucleotide sequence
accctgagcaggcaccca

SEQ ID NO: 2066 - DNA, 18 bp, Artificial sequence
  synthetic polynucleotide sequence
cctgggacagtggccaga

SEQ ID NO: 2067 - DNA, 18 bp, Artificial sequence
  synthetic polynucleotide sequence
aatgagggagctcatcca

SEQ ID NO: 2068 - DNA, 18 bp, Artificial sequence
  synthetic polynucleotide sequence
taggcagcaagttgagga

SEQ ID NO: 2069 - DNA, 18 bp, Artificial sequence
  synthetic polynucleotide sequence
aataccagtggaggccga

SEQ ID NO: 2070 - DNA, 18 bp, Artificial sequence
  synthetic polynucleotide sequence
aagcgactggatgaacca

SEQ ID NO: 2071 - DNA, 18 bp, Artificial sequence
  synthetic polynucleotide sequence
gacccacgtggagaagga

SEQ ID NO: 2072 - DNA, 18 bp, Artificial sequence
  synthetic polynucleotide sequence
ctctaggtggcagcacca

SEQ ID NO: 2073 - DNA, 18 bp, Artificial sequence
  synthetic polynucleotide sequence
aagagagaggaccgcaga

SEQ ID NO: 2074 - DNA, 18 bp, Artificial sequence
  synthetic polynucleotide sequence
caaccacagtgtagccca

SEQ ID NO: 2075 - DNA, 18 bp, Artificial sequence
  synthetic polynucleotide sequence
cgttcgaaacggaacaga

SEQ ID NO: 2076 - DNA, 18 bp, Artificial sequence
  synthetic polynucleotide sequence
ttaagaggatgcaggcga

SEQ ID NO: 2077 - DNA, 18 bp, Artificial sequence
  synthetic polynucleotide sequence
ccccacgatgactgcaca

SEQ ID NO: 2078 - DNA, 18 bp, Artificial sequence
  synthetic polynucleotide sequence
agcagatgaagcagtcca

SEQ ID NO: 2079 - DNA, 18 bp, Artificial sequence
  synthetic polynucleotide sequence
tcgaccagctggacgcca

SEQ ID NO: 2080 - DNA, 18 bp, Artificial sequence
  synthetic polynucleotide sequence
ggtctcaacgtaccagga

SEQ ID NO: 2081 - DNA, 18 bp, Artificial sequence
  synthetic polynucleotide sequence
ggagatcaaccctgagga

SEQ ID NO: 2082 - DNA, 18 bp, Artificial sequence
  synthetic polynucleotide sequence
accagcagggggaagtca

SEQ ID NO: 2083 - DNA, 18 bp, Artificial sequence
  synthetic polynucleotide sequence
acaaccccgatctgagca

SEQ ID NO: 2084 - DNA, 18 bp, Artificial sequence
  synthetic polynucleotide sequence
gtgacattcaccacccca

SEQ ID NO: 2085 - DNA, 18 bp, Artificial sequence
  synthetic polynucleotide sequence
aggccaagatccccacca

SEQ ID NO: 2086 - DNA, 18 bp, Artificial sequence
  synthetic polynucleotide sequence
agccgatcaggaagccca

SEQ ID NO: 2087 - DNA, 18 bp, Artificial sequence
  synthetic polynucleotide sequence
aggaacagcttccaccca

SEQ ID NO: 2088 - DNA, 18 bp, Artificial sequence
  synthetic polynucleotide sequence
accacttcagagatggca

SEQ ID NO: 2089 - DNA, 18 bp, Artificial sequence
  synthetic polynucleotide sequence
cactgaggtccaccctga

SEQ ID NO: 2090 - DNA, 18 bp, Artificial sequence
  synthetic polynucleotide sequence
agtgagatccggactgca

SEQ ID NO: 2091 - DNA, 18 bp, Artificial sequence
  synthetic polynucleotide sequence
gaggagtggacacgagca

SEQ ID NO: 2092 - DNA, 18 bp, Artificial sequence
  synthetic polynucleotide sequence
acaggaggcagaaggcga

SEQ ID NO: 2093 - DNA, 18 bp, Artificial sequence
  synthetic polynucleotide sequence
gcatcccgatggcactca

SEQ ID NO: 2094 - DNA, 18 bp, Artificial sequence
  synthetic polynucleotide sequence
acagacggtgtggacgta

SEQ ID NO: 2095 - DNA, 18 bp, Artificial sequence
  synthetic polynucleotide sequence
ccaggaccgggatcccca

SEQ ID NO: 2096 - DNA, 18 bp, Artificial sequence
  synthetic polynucleotide sequence
aggcagaaccattaggca

SEQ ID NO: 2097 - DNA, 18 bp, Artificial sequence
  synthetic polynucleotide sequence
acggcgtgtggaaggtga

SEQ ID NO: 2098 - DNA, 18 bp, Artificial sequence
  synthetic polynucleotide sequence
agaaggagatgcaggcga

SEQ ID NO: 2099 - DNA, 18 bp, Artificial sequence
  synthetic polynucleotide sequence
aggaggactccagcgaga

SEQ ID NO: 2100 - DNA, 18 bp, Artificial sequence
  synthetic polynucleotide sequence
tggcagcacccacaggca

SEQ ID NO: 2101 - DNA, 18 bp, Artificial sequence
  synthetic polynucleotide sequence
agagaagcaggcaaggta

SEQ ID NO: 2102 - DNA, 18 bp, Artificial sequence
  synthetic polynucleotide sequence
tccagacagcccatacca

SEQ ID NO: 2103 - DNA, 18 bp, Artificial sequence
  synthetic polynucleotide sequence
ggcgccatctatcaccga

SEQ ID NO: 2104 - DNA, 18 bp, Artificial sequence
  synthetic polynucleotide sequence
tccagagacaaccagcca

SEQ ID NO: 2105 - DNA, 17 bp, Artificial sequence
  synthetic polynucleotide sequence
gccattaccacctgcca

SEQ ID NO: 2106 - DNA, 19 bp, Artificial sequence
  synthetic polynucleotide sequence
gatggagggagggcatcaa

SEQ ID NO: 2107 - DNA, 18 bp, Artificial sequence
  synthetic polynucleotide sequence
agcactcggacagccaga

SEQ ID NO: 2108 - DNA, 18 bp, Artificial sequence
  synthetic polynucleotide sequence
gggcaatggaggagccga

SEQ ID NO: 2109 - DNA, 18 bp, Artificial sequence
  synthetic polynucleotide sequence
caggagcaccaaccacga

SEQ ID NO: 2110 - DNA, 18 bp, Artificial sequence
  synthetic polynucleotide sequence
ccggccacccgtttagca

SEQ ID NO: 2111 - DNA, 18 bp, Artificial sequence
  synthetic polynucleotide sequence
agaatggctacccagtga

SEQ ID NO: 2112 - DNA, 18 bp, Artificial sequence
  synthetic polynucleotide sequence
atgagcagcagcacgcca

SEQ ID NO: 2113 - DNA, 18 bp, Artificial sequence
  synthetic polynucleotide sequence
tgacccgggaggcagcca

SEQ ID NO: 2114 - DNA, 18 bp, Artificial sequence
  synthetic polynucleotide sequence
cccagtagattcccccga

SEQ ID NO: 2115 - DNA, 18 bp, Artificial sequence
  synthetic polynucleotide sequence
cgcatacggggtgacgaa

SEQ ID NO: 2116 - DNA, 18 bp, Artificial sequence
  synthetic polynucleotide sequence
ggcagcaggcattcagga

SEQ ID NO: 2117 - DNA, 18 bp, Artificial sequence
  synthetic polynucleotide sequence
gcgtgctgcccaggacca

SEQ ID NO: 2118 - DNA, 18 bp, Artificial sequence
  synthetic polynucleotide sequence
tcagccccctcctccaca

SEQ ID NO: 2119 - DNA, 18 bp, Artificial sequence
  synthetic polynucleotide sequence
ggagaagggcttcgacca

SEQ ID NO: 2120 - DNA, 18 bp, Artificial sequence
  synthetic polynucleotide sequence
gcaccttcccggcaagca

SEQ ID NO: 2121 - DNA, 18 bp, Artificial sequence
  synthetic polynucleotide sequence
ccctgccaaggaagccaa

SEQ ID NO: 2122 - DNA, 18 bp, Artificial sequence
  synthetic polynucleotide sequence
cgaggggtaggaatgcca

SEQ ID NO: 2123 - DNA, 18 bp, Artificial sequence
  synthetic polynucleotide sequence
agaggcaagaggccgaga

SEQ ID NO: 2124 - DNA, 18 bp, Artificial sequence
  synthetic polynucleotide sequence
cctggcagcagaagctga

SEQ ID NO: 2125 - DNA, 18 bp, Artificial sequence
  synthetic polynucleotide sequence
cctgcagctcaccaccaa

SEQ ID NO: 2126 - DNA, 18 bp, Artificial sequence
  synthetic polynucleotide sequence
cgccgtgggtctcggaga

SEQ ID NO: 2127 - DNA, 18 bp, Artificial sequence
  synthetic polynucleotide sequence
ggttaagggacaagtgga

SEQ ID NO: 2128 - DNA, 18 bp, Artificial sequence
  synthetic polynucleotide sequence
tagctcagggcaatccaa

SEQ ID NO: 2129 - DNA, 18 bp, Artificial sequence
  synthetic polynucleotide sequence
cccctcgcctacaccaca

SEQ ID NO: 2130 - DNA, 18 bp, Artificial sequence
  synthetic polynucleotide sequence
agcctcgggctcggagga

SEQ ID NO: 2131 - DNA, 18 bp, Artificial sequence
  synthetic polynucleotide sequence
ccaacctggagagccaca

SEQ ID NO: 2132 - DNA, 18 bp, Artificial sequence
  synthetic polynucleotide sequence
agcgcaggtgtccaggga

SEQ ID NO: 2133 - DNA, 18 bp, Artificial sequence
  synthetic polynucleotide sequence
ctagctcagctgaggcca

SEQ ID NO: 2134 - DNA, 18 bp, Artificial sequence
  synthetic polynucleotide sequence
ccacagggatcctggcga

SEQ ID NO: 2135 - DNA, 18 bp, Artificial sequence
  synthetic polynucleotide sequence
gaagccggcagtgagcaa

SEQ ID NO: 2136 - DNA, 18 bp, Artificial sequence
  synthetic polynucleotide sequence
ccgagggggtagtcagca

SEQ ID NO: 2137 - DNA, 18 bp, Artificial sequence
  synthetic polynucleotide sequence
gccctgaggagacccaca

SEQ ID NO: 2138 - DNA, 18 bp, Artificial sequence
  synthetic polynucleotide sequence
actctgagcgggtgggaa

SEQ ID NO: 2139 - DNA, 18 bp, Artificial sequence
  synthetic polynucleotide sequence
aggggcaccaggaagaga

SEQ ID NO: 2140 - DNA, 18 bp, Artificial sequence
  synthetic polynucleotide sequence
tgcggatgtcagccagca

SEQ ID NO: 2141 - DNA, 18 bp, Artificial sequence
  synthetic polynucleotide sequence
cgcactccaggtaacaga

SEQ ID NO: 2142 - DNA, 18 bp, Artificial sequence
  synthetic polynucleotide sequence
tgccatccaagcacggca

SEQ ID NO: 2143 - DNA, 17 bp, Artificial sequence
  synthetic polynucleotide sequence
gcctcaccccccaggga

SEQ ID NO: 2144 - DNA, 18 bp, Artificial sequence
  synthetic polynucleotide sequence
agtccgaccaccaccgca

SEQ ID NO: 2145 - DNA, 18 bp, Artificial sequence
  synthetic polynucleotide sequence
tggccctggacgacgaga

SEQ ID NO: 2146 - DNA, 18 bp, Artificial sequence
  synthetic polynucleotide sequence
agcggtaggtgatgggca

SEQ ID NO: 2147 - DNA, 18 bp, Artificial sequence
  synthetic polynucleotide sequence
gcaccattcaaggcccca

SEQ ID NO: 2148 - DNA, 18 bp, Artificial sequence
  synthetic polynucleotide sequence
tggaaggaggaaggccca

SEQ ID NO: 2149 - DNA, 18 bp, Artificial sequence
  synthetic polynucleotide sequence
agagtcggatgggccaga

SEQ ID NO: 2150 - DNA, 18 bp, Artificial sequence
  synthetic polynucleotide sequence
cctccatggcctcaagca

SEQ ID NO: 2151 - DNA, 18 bp, Artificial sequence
  synthetic polynucleotide sequence
gaaggtgccaagtccaca

SEQ ID NO: 2152 - DNA, 18 bp, Artificial sequence
  synthetic polynucleotide sequence
actgcaggcatcacagca

SEQ ID NO: 2153 - DNA, 18 bp, Artificial sequence
  synthetic polynucleotide sequence
agatgggcccttccccca

SEQ ID NO: 2154 - DNA, 18 bp, Artificial sequence
  synthetic polynucleotide sequence
aactgataccccagcgga

SEQ ID NO: 2155 - DNA, 18 bp, Artificial sequence
  synthetic polynucleotide sequence
gccagggtaaatccagca

SEQ ID NO: 2156 - DNA, 18 bp, Artificial sequence
  synthetic polynucleotide sequence
actgcggagtagctggga

SEQ ID NO: 2157 - DNA, 18 bp, Artificial sequence
  synthetic polynucleotide sequence
aaacggagctgcggagga

SEQ ID NO: 2158 - DNA, 18 bp, Artificial sequence
  synthetic polynucleotide sequence
ccccttccgcaacccgca

SEQ ID NO: 2159 - DNA, 18 bp, Artificial sequence
  synthetic polynucleotide sequence
ctgttcgcaagggcagca

SEQ ID NO: 2160 - DNA, 18 bp, Artificial sequence
  synthetic polynucleotide sequence
gaggagcacatgagccta

SEQ ID NO: 2161 - DNA, 18 bp, Artificial sequence
  synthetic polynucleotide sequence
gaggctgaagtagcggaa

SEQ ID NO: 2162 - DNA, 18 bp, Artificial sequence
  synthetic polynucleotide sequence
agcctgcatctcagccaa

SEQ ID NO: 2163 - DNA, 18 bp, Artificial sequence
  synthetic polynucleotide sequence
gtcgacagctctccgaga

SEQ ID NO: 2164 - DNA, 18 bp, Artificial sequence
  synthetic polynucleotide sequence
gtaagggatcgggctgga

SEQ ID NO: 2165 - DNA, 18 bp, Artificial sequence
  synthetic polynucleotide sequence
gaggctgagatcccgcca

SEQ ID NO: 2166 - DNA, 18 bp, Artificial sequence
  synthetic polynucleotide sequence
tgaaggggtcagccccca

SEQ ID NO: 2167 - DNA, 18 bp, Artificial sequence
  synthetic polynucleotide sequence
tgaggccctggagaagga

SEQ ID NO: 2168 - DNA, 18 bp, Artificial sequence
  synthetic polynucleotide sequence
cagagggaaggcaggcga

SEQ ID NO: 2169 - DNA, 18 bp, Artificial sequence
  synthetic polynucleotide sequence
ggacccaaggagagcaca

SEQ ID NO: 2170 - DNA, 18 bp, Artificial sequence
  synthetic polynucleotide sequence
tgagggaggttggggcaa

SEQ ID NO: 2171 - DNA, 18 bp, Artificial sequence
  synthetic polynucleotide sequence
ctgaacacgccaggcaca

SEQ ID NO: 2172 - DNA, 18 bp, Artificial sequence
  synthetic polynucleotide sequence
cccctggctctggggaga

SEQ ID NO: 2173 - DNA, 18 bp, Artificial sequence
  synthetic polynucleotide sequence
ggccacaaagccacagca

SEQ ID NO: 2174 - DNA, 18 bp, Artificial sequence
  synthetic polynucleotide sequence
tcacttccaggggaacca

SEQ ID NO: 2175 - DNA, 18 bp, Artificial sequence
  synthetic polynucleotide sequence
tcagggtccagggaccaa

SEQ ID NO: 2176 - DNA, 18 bp, Artificial sequence
  synthetic polynucleotide sequence
accaactcgccttgggga

SEQ ID NO: 2177 - DNA, 18 bp, Artificial sequence
  synthetic polynucleotide sequence
gaagatcgaagggcagca

SEQ ID NO: 2178 - DNA, 18 bp, Artificial sequence
  synthetic polynucleotide sequence
gctccaacatggcaagca

SEQ ID NO: 2179 - DNA, 18 bp, Artificial sequence
  synthetic polynucleotide sequence
gctgcagcgggcagagga

SEQ ID NO: 2180 - DNA, 18 bp, Artificial sequence
  synthetic polynucleotide sequence
gcccaggtgcgctcggga

SEQ ID NO: 2181 - DNA, 18 bp, Artificial sequence
  synthetic polynucleotide sequence
cagcagcagcagggccaa

SEQ ID NO: 2182 - DNA, 18 bp, Artificial sequence
  synthetic polynucleotide sequence
aggaggaggtgtaggaca

SEQ ID NO: 2183 - DNA, 18 bp, Artificial sequence
  synthetic polynucleotide sequence
agaagcgcgtggtgcgaa

SEQ ID NO: 2184 - DNA, 18 bp, Artificial sequence
  synthetic polynucleotide sequence
gcgacggtgcatgaagca

SEQ ID NO: 2185 - DNA, 19 bp, Artificial sequence
  synthetic polynucleotide sequence
gatgtggacagcaagagca

SEQ ID NO: 2186 - DNA, 18 bp, Artificial sequence
  synthetic polynucleotide sequence
gcctctgaacccatccaa

SEQ ID NO: 2187 - DNA, 19 bp, Artificial sequence
  synthetic polynucleotide sequence
aggagaatcaccagtggca

SEQ ID NO: 2188 - DNA, 18 bp, Artificial sequence
  synthetic polynucleotide sequence
catggaatcctgcaccca

SEQ ID NO: 2189 - DNA, 19 bp, Artificial sequence
  synthetic polynucleotide sequence
agatgcactcaacgtccca

SEQ ID NO: 2190 - DNA, 18 bp, Artificial sequence
  synthetic polynucleotide sequence
gacagccttctggggaca

SEQ ID NO: 2191 - DNA, 18 bp, Artificial sequence
  synthetic polynucleotide sequence
ctatgagaccaacagcca

SEQ ID NO: 2192 - DNA, 18 bp, Artificial sequence
  synthetic polynucleotide sequence
ggggttggtacagacgga

SEQ ID NO: 2193 - DNA, 18 bp, Artificial sequence
  synthetic polynucleotide sequence
ccttggatcccaggccca

SEQ ID NO: 2194 - DNA, 18 bp, Artificial sequence
  synthetic polynucleotide sequence
tcatgagtgaacacggga

SEQ ID NO: 2195 - DNA, 18 bp, Artificial sequence
  synthetic polynucleotide sequence
caccaaccccaatgacga

SEQ ID NO: 2196 - DNA, 18 bp, Artificial sequence
  synthetic polynucleotide sequence
aggagctggggttgacca

SEQ ID NO: 2197 - DNA, 19 bp, Artificial sequence
  synthetic polynucleotide sequence
gagtacttcaagggagcca

SEQ ID NO: 2198 - DNA, 17 bp, Artificial sequence
  synthetic polynucleotide sequence
gttggggtccgaacaga

SEQ ID NO: 2199 - DNA, 18 bp, Artificial sequence
  synthetic polynucleotide sequence
gtgagtttccaagcccca

SEQ ID NO: 2200 - DNA, 18 bp, Artificial sequence
  synthetic polynucleotide sequence
cacaggagcagagggcca

SEQ ID NO: 2201 - DNA, 19 bp, Artificial sequence
  synthetic polynucleotide sequence
caactctgagtggcaccaa

SEQ ID NO: 2202 - DNA, 19 bp, Artificial sequence
  synthetic polynucleotide sequence
gtgaacactacagcaggca

SEQ ID NO: 2203 - DNA, 18 bp, Artificial sequence
  synthetic polynucleotide sequence
agggctcgctcagccaga

SEQ ID NO: 2204 - DNA, 18 bp, Artificial sequence
  synthetic polynucleotide sequence
gcttggggtcagcacaga

SEQ ID NO: 2205 - DNA, 19 bp, Artificial sequence
  synthetic polynucleotide sequence
gaatcagaagcagcaagca

SEQ ID NO: 2206 - DNA, 19 bp, Artificial sequence
  synthetic polynucleotide sequence
ggatttgcgcacacagaca

SEQ ID NO: 2207 - DNA, 18 bp, Artificial sequence
  synthetic polynucleotide sequence
aaaggaagattcccgcca

SEQ ID NO: 2208 - DNA, 18 bp, Artificial sequence
  synthetic polynucleotide sequence
ctgggatggagcagccta

SEQ ID NO: 2209 - DNA, 18 bp, Artificial sequence
  synthetic polynucleotide sequence
gcgccaacatggaagaca

SEQ ID NO: 2210 - DNA, 18 bp, Artificial sequence
  synthetic polynucleotide sequence
gttagcaacaccacgcca

SEQ ID NO: 2211 - DNA, 18 bp, Artificial sequence
  synthetic polynucleotide sequence
tctcctacaccccacgaa

SEQ ID NO: 2212 - DNA, 18 bp, Artificial sequence
  synthetic polynucleotide sequence
gatgacacccggcttgga

SEQ ID NO: 2213 - DNA, 17 bp, Artificial sequence
  synthetic polynucleotide sequence
ggcaggcctgatgacca

SEQ ID NO: 2214 - DNA, 18 bp, Artificial sequence
  synthetic polynucleotide sequence
gaacatgcagcagggaga

SEQ ID NO: 2215 - DNA, 18 bp, Artificial sequence
  synthetic polynucleotide sequence
cccgctgtccacacccaa

SEQ ID NO: 2216 - DNA, 18 bp, Artificial sequence
  synthetic polynucleotide sequence
cgcagcaggcagattgca

SEQ ID NO: 2217 - DNA, 18 bp, Artificial sequence
  synthetic polynucleotide sequence
caccttggaactgccaca

SEQ ID NO: 2218 - DNA, 18 bp, Artificial sequence
  synthetic polynucleotide sequence
gcttcgcacccaggtcca

SEQ ID NO: 2219 - DNA, 17 bp, Artificial sequence
  synthetic polynucleotide sequence
cctactgccacccagca

SEQ ID NO: 2220 - DNA, 16 bp, Artificial sequence
  synthetic polynucleotide sequence
gccaggtgaagcacga

SEQ ID NO: 2221 - DNA, 16 bp, Artificial sequence
  synthetic polynucleotide sequence
ccagctgttgcacgga

SEQ ID NO: 2222 - DNA, 19 bp, Artificial sequence
  synthetic polynucleotide sequence
gaaggatgacagcagccaa

SEQ ID NO: 2223 - DNA, 18 bp, Artificial sequence
  synthetic polynucleotide sequence
ctcccggcagattccaca

SEQ ID NO: 2224 - DNA, 18 bp, Artificial sequence
  synthetic polynucleotide sequence
gacaccgggcttggagca

SEQ ID NO: 2225 - DNA, 18 bp, Artificial sequence
  synthetic polynucleotide sequence
gccagtgctccaagccca

SEQ ID NO: 2226 - DNA, 18 bp, Artificial sequence
  synthetic polynucleotide sequence
ctcactggggtcagcaca

SEQ ID NO: 2227 - DNA, 16 bp, Artificial sequence
  synthetic polynucleotide sequence
agcgctctcagcacca

SEQ ID NO: 2228 - DNA, 16 bp, Artificial sequence
  synthetic polynucleotide sequence
gctggctgggagcaga

SEQ ID NO: 2229 - DNA, 17 bp, Artificial sequence
  synthetic polynucleotide sequence
cgtgcccacatcaagga

SEQ ID NO: 2230 - DNA, 18 bp, Artificial sequence
  synthetic polynucleotide sequence
gatgtactcccgaaccca

SEQ ID NO: 2231 - DNA, 18 bp, Artificial sequence
  synthetic polynucleotide sequence
gcagaggggctgagacca

SEQ ID NO: 2232 - DNA, 18 bp, Artificial sequence
  synthetic polynucleotide sequence
atcccaactggctgagca

SEQ ID NO: 2233 - DNA, 18 bp, Artificial sequence
  synthetic polynucleotide sequence
gggacttgctcagccaga

SEQ ID NO: 2234 - DNA, 18 bp, Artificial sequence
  synthetic polynucleotide sequence
ccttggggtcagcacaga

SEQ ID NO: 2235 - DNA, 19 bp, Artificial sequence
  synthetic polynucleotide sequence
agaccattggcgtgaagga

SEQ ID NO: 2236 - DNA, 18 bp, Artificial sequence
  synthetic polynucleotide sequence
cgagatcatgcggtccca

SEQ ID NO: 2237 - DNA, 18 bp, Artificial sequence
  synthetic polynucleotide sequence
gcacagacccaaagcaca

SEQ ID NO: 2238 - DNA, 18 bp, Artificial sequence
  synthetic polynucleotide sequence
cttccccaacctccacca

SEQ ID NO: 2239 - DNA, 18 bp, Artificial sequence
  synthetic polynucleotide sequence
aagacgagacgggttgca

SEQ ID NO: 2240 - DNA, 18 bp, Artificial sequence
  synthetic polynucleotide sequence
acatgaatggtgaacgca

SEQ ID NO: 2241 - DNA, 18 bp, Artificial sequence
  synthetic polynucleotide sequence
ctgcctctccaagcccaa

SEQ ID NO: 2242 - DNA, 18 bp, Artificial sequence
  synthetic polynucleotide sequence
cagtgacttcccgaccca

SEQ ID NO: 2243 - DNA, 18 bp, Artificial sequence
  synthetic polynucleotide sequence
cgcacagaactcagtcca

SEQ ID NO: 2244 - DNA, 18 bp, Artificial sequence
  synthetic polynucleotide sequence
gaaggccagcgctcggga

SEQ ID NO: 2245 - DNA, 18 bp, Artificial sequence
  synthetic polynucleotide sequence
gcagtccataaacccaca

SEQ ID NO: 2246 - DNA, 18 bp, Artificial sequence
  synthetic polynucleotide sequence
ccataatgccaacgcaca

SEQ ID NO: 2247 - DNA, 18 bp, Artificial sequence
  synthetic polynucleotide sequence
acatgggccaagaagaca

SEQ ID NO: 2248 - DNA, 18 bp, Artificial sequence
  synthetic polynucleotide sequence
gctgtacaacacaggcta

SEQ ID NO: 2249 - DNA, 18 bp, Artificial sequence
  synthetic polynucleotide sequence
tccgcaaacacgcgcaga

SEQ ID NO: 2250 - DNA, 18 bp, Artificial sequence
  synthetic polynucleotide sequence
tgaggcggtagtaggaca

SEQ ID NO: 2251 - DNA, 18 bp, Artificial sequence
  synthetic polynucleotide sequence
caccgtcgatgatcgcaa

SEQ ID NO: 2252 - DNA, 18 bp, Artificial sequence
  synthetic polynucleotide sequence
ttgaggagcaccgcctca

SEQ ID NO: 2253 - DNA, 18 bp, Artificial sequence
  synthetic polynucleotide sequence
acgcccctgaccatcgaa

SEQ ID NO: 2254 - DNA, 18 bp, Artificial sequence
  synthetic polynucleotide sequence
agagagagccggtgcaga

SEQ ID NO: 2255 - DNA, 18 bp, Artificial sequence
  synthetic polynucleotide sequence
gggttgcgtgccagcaga

SEQ ID NO: 2256 - DNA, 18 bp, Artificial sequence
  synthetic polynucleotide sequence
aggccagagtaagggtca

SEQ ID NO: 2257 - DNA, 18 bp, Artificial sequence
  synthetic polynucleotide sequence
ggaccagtgtgggagcca

SEQ ID NO: 2258 - DNA, 18 bp, Artificial sequence
  synthetic polynucleotide sequence
aggtgtggggatcaggga

SEQ ID NO: 2259 - DNA, 18 bp, Artificial sequence
  synthetic polynucleotide sequence
ggagctgagaacccagca

SEQ ID NO: 2260 - DNA, 18 bp, Artificial sequence
  synthetic polynucleotide sequence
atccggtgaggtcccaca

SEQ ID NO: 2261 - DNA, 18 bp, Artificial sequence
  synthetic polynucleotide sequence
cacgataatggcctcaga

SEQ ID NO: 2262 - DNA, 18 bp, Artificial sequence
  synthetic polynucleotide sequence
gcagctcagtccaacaca

SEQ ID NO: 2263 - DNA, 18 bp, Artificial sequence
  synthetic polynucleotide sequence
agggacaggcgtgaacga

SEQ ID NO: 2264 - DNA, 18 bp, Artificial sequence
  synthetic polynucleotide sequence
cctgagcgactgccacca

SEQ ID NO: 2265 - DNA, 18 bp, Artificial sequence
  synthetic polynucleotide sequence
ccgtgaacggcttgccaa

SEQ ID NO: 2266 - DNA, 18 bp, Artificial sequence
  synthetic polynucleotide sequence
cgctgatcgggatgggga

SEQ ID NO: 2267 - DNA, 18 bp, Artificial sequence
  synthetic polynucleotide sequence
gaagctctggaagcgcaa

SEQ ID NO: 2268 - DNA, 18 bp, Artificial sequence
  synthetic polynucleotide sequence
ctcccagtcgcaagtcca

SEQ ID NO: 2269 - DNA, 18 bp, Artificial sequence
  synthetic polynucleotide sequence
gggcatagctcagacaca

SEQ ID NO: 2270 - DNA, 18 bp, Artificial sequence
  synthetic polynucleotide sequence
ggctgaacaccctgggca

SEQ ID NO: 2271 - DNA, 18 bp, Artificial sequence
  synthetic polynucleotide sequence
ggtgatcgcctacacgca

SEQ ID NO: 2272 - DNA, 18 bp, Artificial sequence
  synthetic polynucleotide sequence
ccacggagaggaagggga

SEQ ID NO: 2273 - DNA, 18 bp, Artificial sequence
  synthetic polynucleotide sequence
cagcgggaaggccaacga

SEQ ID NO: 2274 - DNA, 18 bp, Artificial sequence
  synthetic polynucleotide sequence
cggcagtatccagcagca

SEQ ID NO: 2275 - DNA, 17 bp, Artificial sequence
  synthetic polynucleotide sequence
ccaacgagagcggtgaa

SEQ ID NO: 2276 - DNA, 17 bp, Artificial sequence
  synthetic polynucleotide sequence
gatgaggacgaccagca

SEQ ID NO: 2277 - DNA, 18 bp, Artificial sequence
  synthetic polynucleotide sequence
gctgcatgaacccggtga

SEQ ID NO: 2278 - DNA, 18 bp, Artificial sequence
  synthetic polynucleotide sequence
gcccaggtgcatgagcaa

SEQ ID NO: 2279 - DNA, 19 bp, Artificial sequence
  synthetic polynucleotide sequence
gactatgccatccaggcca

SEQ ID NO: 2280 - DNA, 19 bp, Artificial sequence
  synthetic polynucleotide sequence
ccacagtattggcagagca

SEQ ID NO: 2281 - DNA, 18 bp, Artificial sequence
  synthetic polynucleotide sequence
agaggcacagggctgtga

SEQ ID NO: 2282 - DNA, 18 bp, Artificial sequence
  synthetic polynucleotide sequence
aggtgttcaggagaagga

SEQ ID NO: 2283 - DNA, 18 bp, Artificial sequence
  synthetic polynucleotide sequence
aacactaccgcgcagcaa

SEQ ID NO: 2284 - DNA, 18 bp, Artificial sequence
  synthetic polynucleotide sequence
agagtagctcaagcccca

SEQ ID NO: 2285 - DNA, 18 bp, Artificial sequence
  synthetic polynucleotide sequence
ggcccagacggtggccaa

SEQ ID NO: 2286 - DNA, 18 bp, Artificial sequence
  synthetic polynucleotide sequence
tgcggaacttgacgccga

SEQ ID NO: 2287 - DNA, 18 bp, Artificial sequence
  synthetic polynucleotide sequence
gcataagccaacagctga

SEQ ID NO: 2288 - DNA, 18 bp, Artificial sequence
  synthetic polynucleotide sequence
cacagctctccctaggca

SEQ ID NO: 2289 - DNA, 18 bp, Artificial sequence
  synthetic polynucleotide sequence
caccctgatacaagccaa

SEQ ID NO: 2290 - DNA, 18 bp, Artificial sequence
  synthetic polynucleotide sequence
gagaacagggttcaggca

SEQ ID NO: 2291 - DNA, 18 bp, Artificial sequence
  synthetic polynucleotide sequence
gttcagggagcagaggta

SEQ ID NO: 2292 - DNA, 18 bp, Artificial sequence
  synthetic polynucleotide sequence
caggagagggttgatgca

SEQ ID NO: 2293 - DNA, 18 bp, Artificial sequence
  synthetic polynucleotide sequence
gaccctggagtgcaagga

SEQ ID NO: 2294 - DNA, 18 bp, Artificial sequence
  synthetic polynucleotide sequence
cattgaagtccccacaca

SEQ ID NO: 2295 - DNA, 18 bp, Artificial sequence
  synthetic polynucleotide sequence
gcaggtgtggaacgccta

SEQ ID NO: 2296 - DNA, 18 bp, Artificial sequence
  synthetic polynucleotide sequence
gttgagtggcaccacgca

SEQ ID NO: 2297 - DNA, 18 bp, Artificial sequence
  synthetic polynucleotide sequence
ggcccatgccttgacaga

SEQ ID NO: 2298 - DNA, 18 bp, Artificial sequence
  synthetic polynucleotide sequence
gtgcttggcccgaaggga

SEQ ID NO: 2299 - DNA, 18 bp, Artificial sequence
  synthetic polynucleotide sequence
gtgctgcgagaagagaga

SEQ ID NO: 2300 - DNA, 18 bp, Artificial sequence
  synthetic polynucleotide sequence
ctaactcagcagaaccca

SEQ ID NO: 2301 - DNA, 18 bp, Artificial sequence
  synthetic polynucleotide sequence
cactggaggtcatcccca

SEQ ID NO: 2302 - DNA, 18 bp, Artificial sequence
  synthetic polynucleotide sequence
cagtcgatgccaagagca

SEQ ID NO: 2303 - DNA, 18 bp, Artificial sequence
  synthetic polynucleotide sequence
tgaacacaggtgagccaa

SEQ ID NO: 2304 - DNA, 18 bp, Artificial sequence
  synthetic polynucleotide sequence
ggtggcaatcacagtgca

SEQ ID NO: 2305 - DNA, 18 bp, Artificial sequence
  synthetic polynucleotide sequence
caagctgcgggctcggca

SEQ ID NO: 2306 - DNA, 18 bp, Artificial sequence
  synthetic polynucleotide sequence
atcaggcacgcagcctca

SEQ ID NO: 2307 - DNA, 18 bp, Artificial sequence
  synthetic polynucleotide sequence
gtgacaaacgatgcagca

SEQ ID NO: 2308 - DNA, 18 bp, Artificial sequence
  synthetic polynucleotide sequence
aattccaggagagctcca

SEQ ID NO: 2309 - DNA, 18 bp, Artificial sequence
  synthetic polynucleotide sequence
ctccaagccttccaacca

SEQ ID NO: 2310 - DNA, 18 bp, Artificial sequence
  synthetic polynucleotide sequence
ccccatcctcactgggaa

SEQ ID NO: 2311 - DNA, 19 bp, Artificial sequence
  synthetic polynucleotide sequence
ctaaaggactgccagccaa

SEQ ID NO: 2312 - DNA, 19 bp, Artificial sequence
  synthetic polynucleotide sequence
cagttccagggaccaggaa

SEQ ID NO: 2313 - DNA, 18 bp, Artificial sequence
  synthetic polynucleotide sequence
ggcgagacagtgagtgga

SEQ ID NO: 2314 - DNA, 18 bp, Artificial sequence
  synthetic polynucleotide sequence
caccaccgtcttgcagca

SEQ ID NO: 2315 - DNA, 20 bp, Artificial sequence
  synthetic polynucleotide sequence
ggaactacacagtgacggga

SEQ ID NO: 2316 - DNA, 18 bp, Artificial sequence
  synthetic polynucleotide sequence
caaggctggtgaccagca

SEQ ID NO: 2317 - DNA, 18 bp, Artificial sequence
  synthetic polynucleotide sequence
gggaaggaacagggccca

SEQ ID NO: 2318 - DNA, 18 bp, Artificial sequence
  synthetic polynucleotide sequence
gcctgcacaccacaccca

SEQ ID NO: 2319 - DNA, 18 bp, Artificial sequence
  synthetic polynucleotide sequence
agcacccgaacgtgacga

SEQ ID NO: 2320 - DNA, 18 bp, Artificial sequence
  synthetic polynucleotide sequence
ggtgaccagcgggaggga

SEQ ID NO: 2321 - DNA, 18 bp, Artificial sequence
  synthetic polynucleotide sequence
cagtccctgaggcccaca

SEQ ID NO: 2322 - DNA, 18 bp, Artificial sequence
  synthetic polynucleotide sequence
ccttgaggaagtgcagca

SEQ ID NO: 2323 - DNA, 18 bp, Artificial sequence
  synthetic polynucleotide sequence
agccacaacagcctgaca

SEQ ID NO: 2324 - DNA, 18 bp, Artificial sequence
  synthetic polynucleotide sequence
agggaggagacggggtga

SEQ ID NO: 2325 - DNA, 18 bp, Artificial sequence
  synthetic polynucleotide sequence
accgtggcaacctgacca

SEQ ID NO: 2326 - DNA, 18 bp, Artificial sequence
  synthetic polynucleotide sequence
cacaagggaacacaggca

SEQ ID NO: 2327 - DNA, 19 bp, Artificial sequence
  synthetic polynucleotide sequence
ctgggaatatggccaagca

SEQ ID NO: 2328 - DNA, 19 bp, Artificial sequence
  synthetic polynucleotide sequence
cctgcatcaagaagaccca

SEQ ID NO: 2329 - DNA, 19 bp, Artificial sequence
  synthetic polynucleotide sequence
tgagatccagggcatagca

SEQ ID NO: 2330 - DNA, 19 bp, Artificial sequence
  synthetic polynucleotide sequence
ggaaggcacacatgaagca

SEQ ID NO: 2331 - DNA, 18 bp, Artificial sequence
  synthetic polynucleotide sequence
aacaggagcaactgggca

SEQ ID NO: 2332 - DNA, 18 bp, Artificial sequence
  synthetic polynucleotide sequence
actcgacaagacaggcca

SEQ ID NO: 2333 - DNA, 18 bp, Artificial sequence
  synthetic polynucleotide sequence
tgcccaatgctgacgaga

SEQ ID NO: 2334 - DNA, 19 bp, Artificial sequence
  synthetic polynucleotide sequence
aagcccacaatgaggagga

SEQ ID NO: 2335 - DNA, 19 bp, Artificial sequence
  synthetic polynucleotide sequence
caggggagtcagaactgaa

SEQ ID NO: 2336 - DNA, 18 bp, Artificial sequence
  synthetic polynucleotide sequence
cgtcagcattaggcagga

SEQ ID NO: 2337 - DNA, 19 bp, Artificial sequence
  synthetic polynucleotide sequence
gcagggaacaaagtcagca

SEQ ID NO: 2338 - DNA, 17 bp, Artificial sequence
  synthetic polynucleotide sequence
aacgagcagtgccacaa

SEQ ID NO: 2339 - DNA, 18 bp, Artificial sequence
  synthetic polynucleotide sequence
caccttcagcgagaacca

SEQ ID NO: 2340 - DNA, 18 bp, Artificial sequence
  synthetic polynucleotide sequence
gcgggcagtggcagagca

SEQ ID NO: 2341 - DNA, 18 bp, Artificial sequence
  synthetic polynucleotide sequence
acacccgaagtgaaccta

SEQ ID NO: 2342 - DNA, 18 bp, Artificial sequence
  synthetic polynucleotide sequence
cctctgggatccaggaga

SEQ ID NO: 2343 - DNA, 18 bp, Artificial sequence
  synthetic polynucleotide sequence
agtgacggcatggaggca

SEQ ID NO: 2344 - DNA, 18 bp, Artificial sequence
  synthetic polynucleotide sequence
tcaggaactgagaacgca

SEQ ID NO: 2345 - DNA, 18 bp, Artificial sequence
  synthetic polynucleotide sequence
ccagcggaactggcacga

SEQ ID NO: 2346 - DNA, 18 bp, Artificial sequence
  synthetic polynucleotide sequence
acagaggtgagccgtcca

SEQ ID NO: 2347 - DNA, 18 bp, Artificial sequence
  synthetic polynucleotide sequence
gccggtgaaggtccagca

SEQ ID NO: 2348 - DNA, 18 bp, Artificial sequence
  synthetic polynucleotide sequence
cgctggagcttgagccca

SEQ ID NO: 2349 - DNA, 18 bp, Artificial sequence
  synthetic polynucleotide sequence
gatcgggacccagcagga

SEQ ID NO: 2350 - DNA, 21 bp, Artificial sequence
  synthetic polynucleotide sequence
gagcaggaatagtagccaaca

SEQ ID NO: 2351 - DNA, 17 bp, Artificial sequence
  synthetic polynucleotide sequence
gggacatgggcagagca

SEQ ID NO: 2352 - DNA, 18 bp, Artificial sequence
  synthetic polynucleotide sequence
ggccaacccagagttgga

SEQ ID NO: 2353 - DNA, 18 bp, Artificial sequence
  synthetic polynucleotide sequence
atcacgagcaggagcaga

SEQ ID NO: 2354 - DNA, 18 bp, Artificial sequence
  synthetic polynucleotide sequence
gggagcagaagactggga

SEQ ID NO: 2355 - DNA, 16 bp, Artificial sequence
  synthetic polynucleotide sequence
ccatcctgcaggcaca

SEQ ID NO: 2356 - DNA, 19 bp, Artificial sequence
  synthetic polynucleotide sequence
caggaacaaggcagtgaga

SEQ ID NO: 2357 - DNA, 18 bp, Artificial sequence
  synthetic polynucleotide sequence
ttgccgagcacagccaga

SEQ ID NO: 2358 - DNA, 18 bp, Artificial sequence
  synthetic polynucleotide sequence
cccagcatggatgaccca

SEQ ID NO: 2359 - DNA, 18 bp, Artificial sequence
  synthetic polynucleotide sequence
acccactggccaccccaa

SEQ ID NO: 2360 - DNA, 18 bp, Artificial sequence
  synthetic polynucleotide sequence
tctgcaggctccacagga

SEQ ID NO: 2361 - DNA, 17 bp, Artificial sequence
  synthetic polynucleotide sequence
cggctgttgaaggacca

SEQ ID NO: 2362 - DNA, 17 bp, Artificial sequence
  synthetic polynucleotide sequence
tgtagtcggcaccacca

SEQ ID NO: 2363 - DNA, 18 bp, Artificial sequence
  synthetic polynucleotide sequence
gcagatggccaacgagca

SEQ ID NO: 2364 - DNA, 18 bp, Artificial sequence
  synthetic polynucleotide sequence
gacagacagacagcccca

SEQ ID NO: 2365 - DNA, 17 bp, Artificial sequence
  synthetic polynucleotide sequence
ggtgaagcagtcgccca

SEQ ID NO: 2366 - DNA, 20 bp, Artificial sequence
  synthetic polynucleotide sequence
caacacagacttccacagca

SEQ ID NO: 2367 - DNA, 18 bp, Artificial sequence
  synthetic polynucleotide sequence
ggtggagtggaaccctga

SEQ ID NO: 2368 - DNA, 18 bp, Artificial sequence
  synthetic polynucleotide sequence
ataggtgaagtaggccca

SEQ ID NO: 2369 - DNA, 18 bp, Artificial sequence
  synthetic polynucleotide sequence
gccagcaccaccaaggga

SEQ ID NO: 2370 - DNA, 18 bp, Artificial sequence
  synthetic polynucleotide sequence
tcccgaggcctctgagca

SEQ ID NO: 2371 - DNA, 18 bp, Artificial sequence
  synthetic polynucleotide sequence
agcagaaagcagccggga

SEQ ID NO: 2372 - DNA, 18 bp, Artificial sequence
  synthetic polynucleotide sequence
ccttcggcaaggaagcca

SEQ ID NO: 2373 - DNA, 18 bp, Artificial sequence
  synthetic polynucleotide sequence
ccagtccagctctcagca

SEQ ID NO: 2374 - DNA, 18 bp, Artificial sequence
  synthetic polynucleotide sequence
aggcctgcggctgacaga

SEQ ID NO: 2375 - DNA, 18 bp, Artificial sequence
  synthetic polynucleotide sequence
gcacatcaagacaggtga

SEQ ID NO: 2376 - DNA, 18 bp, Artificial sequence
  synthetic polynucleotide sequence
ccgtgctagcaatcacca

SEQ ID NO: 2377 - DNA, 18 bp, Artificial sequence
  synthetic polynucleotide sequence
accagtctggaagcccaa

SEQ ID NO: 2378 - DNA, 18 bp, Artificial sequence
  synthetic polynucleotide sequence
tggccaccagtaacccca

SEQ ID NO: 2379 - DNA, 18 bp, Artificial sequence
  synthetic polynucleotide sequence
agacgccaggaggaggga

SEQ ID NO: 2380 - DNA, 18 bp, Artificial sequence
  synthetic polynucleotide sequence
gctcacaggcccaggaca

SEQ ID NO: 2381 - DNA, 18 bp, Artificial sequence
  synthetic polynucleotide sequence
gttcaccaccccagccaa

SEQ ID NO: 2382 - DNA, 18 bp, Artificial sequence
  synthetic polynucleotide sequence
cacacagcactcgggcca

SEQ ID NO: 2383 - DNA, 18 bp, Artificial sequence
  synthetic polynucleotide sequence
aacccaggacgctgagga

SEQ ID NO: 2384 - DNA, 18 bp, Artificial sequence
  synthetic polynucleotide sequence
gcagctgccacagccaga

SEQ ID NO: 2385 - DNA, 18 bp, Artificial sequence
  synthetic polynucleotide sequence
gcgcgcagggcctccaga

SEQ ID NO: 2386 - DNA, 18 bp, Artificial sequence
  synthetic polynucleotide sequence
agagcgtcatgaacccga

SEQ ID NO: 2387 - DNA, 18 bp, Artificial sequence
  synthetic polynucleotide sequence
cacaggtccagcgggaca

SEQ ID NO: 2388 - DNA, 19 bp, Artificial sequence
  synthetic polynucleotide sequence
gagcatcacatggaccaca

SEQ ID NO: 2389 - DNA, 18 bp, Artificial sequence
  synthetic polynucleotide sequence
tggacctgggaaaacgca

SEQ ID NO: 2390 - DNA, 18 bp, Artificial sequence
  synthetic polynucleotide sequence
tggatccagctccacaca

SEQ ID NO: 2391 - DNA, 18 bp, Artificial sequence
  synthetic polynucleotide sequence
cccagaggaagcaaacca

SEQ ID NO: 2392 - DNA, 18 bp, Artificial sequence
  synthetic polynucleotide sequence
gtaaaccagcagcagcaa

SEQ ID NO: 2393 - DNA, 18 bp, Artificial sequence
  synthetic polynucleotide sequence
cagcctgaagccagggca

SEQ ID NO: 2394 - DNA, 17 bp, Artificial sequence
  synthetic polynucleotide sequence
ggagcctcctccccaga

SEQ ID NO: 2395 - DNA, 18 bp, Artificial sequence
  synthetic polynucleotide sequence
ccaaggaccctcgaggga

SEQ ID NO: 2396 - DNA, 18 bp, Artificial sequence
  synthetic polynucleotide sequence
gaagctctcgactggcga

SEQ ID NO: 2397 - DNA, 18 bp, Artificial sequence
  synthetic polynucleotide sequence
gctgagtgactcgggaca

SEQ ID NO: 2398 - DNA, 18 bp, Artificial sequence
  synthetic polynucleotide sequence
gccggcacctgacacaga

SEQ ID NO: 2399 - DNA, 18 bp, Artificial sequence
  synthetic polynucleotide sequence
ggacaagctgtgagacca

SEQ ID NO: 2400 - DNA, 18 bp, Artificial sequence
  synthetic polynucleotide sequence
agcaccaagaggatggca

SEQ ID NO: 2401 - DNA, 18 bp, Artificial sequence
  synthetic polynucleotide sequence
gagctgcaaatacccaca

SEQ ID NO: 2402 - DNA, 19 bp, Artificial sequence
  synthetic polynucleotide sequence
gccaaaggacgtgaagcca

SEQ ID NO: 2403 - DNA, 18 bp, Artificial sequence
  synthetic polynucleotide sequence
agtcacagacctgcccaa

SEQ ID NO: 2404 - DNA, 18 bp, Artificial sequence
  synthetic polynucleotide sequence
tggacatagcgggtgcca

SEQ ID NO: 2405 - DNA, 18 bp, Artificial sequence
  synthetic polynucleotide sequence
ggagcggtaagcccccaa

SEQ ID NO: 2406 - DNA, 18 bp, Artificial sequence
  synthetic polynucleotide sequence
tggagcagcacgactcca

SEQ ID NO: 2407 - DNA, 18 bp, Artificial sequence
  synthetic polynucleotide sequence
ccagagaaggtgaaacga

SEQ ID NO: 2408 - DNA, 18 bp, Artificial sequence
  synthetic polynucleotide sequence
ctcatccataccaccgga

SEQ ID NO: 2409 - DNA, 19 bp, Artificial sequence
  synthetic polynucleotide sequence
gaggacaacagcacctaca

SEQ ID NO: 2410 - DNA, 19 bp, Artificial sequence
  synthetic polynucleotide sequence
agactcgccaggtatcaca

SEQ ID NO: 2411 - DNA, 18 bp, Artificial sequence
  synthetic polynucleotide sequence
gcagcatctgtgaaggca

SEQ ID NO: 2412 - DNA, 19 bp, Artificial sequence
  synthetic polynucleotide sequence
cgtccagcactcgatagga

SEQ ID NO: 2413 - DNA, 19 bp, Artificial sequence
  synthetic polynucleotide sequence
gacaaaacgacaccagcca

SEQ ID NO: 2414 - DNA, 19 bp, Artificial sequence
  synthetic polynucleotide sequence
ctgaagcagaagaggtgga

SEQ ID NO: 2415 - DNA, 18 bp, Artificial sequence
  synthetic polynucleotide sequence
agcgtgggactccatcca

SEQ ID NO: 2416 - DNA, 18 bp, Artificial sequence
  synthetic polynucleotide sequence
tcgcatagcaaccctcca

SEQ ID NO: 2417 - DNA, 18 bp, Artificial sequence
  synthetic polynucleotide sequence
atgccctaatccgggaga

SEQ ID NO: 2418 - DNA, 18 bp, Artificial sequence
  synthetic polynucleotide sequence
gggtcactccactggaca

SEQ ID NO: 2419 - DNA, 18 bp, Artificial sequence
  synthetic polynucleotide sequence
gctgggcactcgcgcaga

SEQ ID NO: 2420 - DNA, 20 bp, Artificial sequence
  synthetic polynucleotide sequence
cattcccatacacaacacca

SEQ ID NO: 2421 - DNA, 18 bp, Artificial sequence
  synthetic polynucleotide sequence
acaacccgcttgagggaa

SEQ ID NO: 2422 - DNA, 18 bp, Artificial sequence
  synthetic polynucleotide sequence
aatggagtcaccagcaga

SEQ ID NO: 2423 - DNA, 18 bp, Artificial sequence
  synthetic polynucleotide sequence
cctccttcagagaccgga

SEQ ID NO: 2424 - DNA, 18 bp, Artificial sequence
  synthetic polynucleotide sequence
ctggcactgctccaggga

SEQ ID NO: 2425 - DNA, 18 bp, Artificial sequence
  synthetic polynucleotide sequence
ccacccttggaggaagga

SEQ ID NO: 2426 - DNA, 18 bp, Artificial sequence
  synthetic polynucleotide sequence
ggtgatactgagggccca

SEQ ID NO: 2427 - DNA, 18 bp, Artificial sequence
  synthetic polynucleotide sequence
caacgagaaggcgatcca

SEQ ID NO: 2428 - DNA, 18 bp, Artificial sequence
  synthetic polynucleotide sequence
ctgctgcagctaccacca

SEQ ID NO: 2429 - DNA, 18 bp, Artificial sequence
  synthetic polynucleotide sequence
cttcccccacgcagcaca

SEQ ID NO: 2430 - DNA, 18 bp, Artificial sequence
  synthetic polynucleotide sequence
accagggcgaggaggcca

SEQ ID NO: 2431 - DNA, 18 bp, Artificial sequence
  synthetic polynucleotide sequence
aatgccatcagacagcca

SEQ ID NO: 2432 - DNA, 18 bp, Artificial sequence
  synthetic polynucleotide sequence
acagcaagagtagcacca

SEQ ID NO: 2433 - DNA, 18 bp, Artificial sequence
  synthetic polynucleotide sequence
ctcagggtcccaggacaa

SEQ ID NO: 2434 - DNA, 18 bp, Artificial sequence
  synthetic polynucleotide sequence
cctctgtcaccaggacca

SEQ ID NO: 2435 - DNA, 18 bp, Artificial sequence
  synthetic polynucleotide sequence
atggaccagagctggaca

SEQ ID NO: 2436 - DNA, 18 bp, Artificial sequence
  synthetic polynucleotide sequence
agcagattcccacggcca

SEQ ID NO: 2437 - DNA, 18 bp, Artificial sequence
  synthetic polynucleotide sequence
catgcggctcagcagaca

SEQ ID NO: 2438 - DNA, 18 bp, Artificial sequence
  synthetic polynucleotide sequence
agagctgaggccagtcca

SEQ ID NO: 2439 - DNA, 18 bp, Artificial sequence
  synthetic polynucleotide sequence
ccccggagagcaagtgca

SEQ ID NO: 2440 - DNA, 18 bp, Artificial sequence
  synthetic polynucleotide sequence
cctggccagcgaggagca

SEQ ID NO: 2441 - DNA, 19 bp, Artificial sequence
  synthetic polynucleotide sequence
gcaacgagtcataccagca

SEQ ID NO: 2442 - DNA, 16 bp, Artificial sequence
  synthetic polynucleotide sequence
gcgcagaacaggagga

SEQ ID NO: 2443 - DNA, 18 bp, Artificial sequence
  synthetic polynucleotide sequence
ggacgagaatccccagca

SEQ ID NO: 2444 - DNA, 18 bp, Artificial sequence
  synthetic polynucleotide sequence
atggtgagggtggcgaga

SEQ ID NO: 2445 - DNA, 18 bp, Artificial sequence
  synthetic polynucleotide sequence
agctggcacaaactcgca

SEQ ID NO: 2446 - DNA, 18 bp, Artificial sequence
  synthetic polynucleotide sequence
cgcagagccaggatcaca

SEQ ID NO: 2447 - DNA, 18 bp, Artificial sequence
  synthetic polynucleotide sequence
ccgggaagctgtacctca

SEQ ID NO: 2448 - DNA, 18 bp, Artificial sequence
  synthetic polynucleotide sequence
gttccggatgccacagca

SEQ ID NO: 2449 - DNA, 18 bp, Artificial sequence
  synthetic polynucleotide sequence
tgcaggagaacctgggca

SEQ ID NO: 2450 - DNA, 18 bp, Artificial sequence
  synthetic polynucleotide sequence
ggaatggacgtgccggca

SEQ ID NO: 2451 - DNA, 16 bp, Artificial sequence
  synthetic polynucleotide sequence
ccggatgggcagagaa

SEQ ID NO: 2452 - DNA, 19 bp, Artificial sequence
  synthetic polynucleotide sequence
ataaccagagccagcagca

SEQ ID NO: 2453 - DNA, 18 bp, Artificial sequence
  synthetic polynucleotide sequence
acacgtgtacagcccaga

SEQ ID NO: 2454 - DNA, 18 bp, Artificial sequence
  synthetic polynucleotide sequence
acatagccagcacgctca

SEQ ID NO: 2455 - DNA, 18 bp, Artificial sequence
  synthetic polynucleotide sequence
acggttacccagaaccta

SEQ ID NO: 2456 - DNA, 18 bp, Artificial sequence
  synthetic polynucleotide sequence
gctcgtaacatcagggaa

SEQ ID NO: 2457 - DNA, 18 bp, Artificial sequence
  synthetic polynucleotide sequence
ccgagagaacgagggcta

SEQ ID NO: 2458 - DNA, 18 bp, Artificial sequence
  synthetic polynucleotide sequence
ctggcaggaagaccggca

SEQ ID NO: 2459 - DNA, 19 bp, Artificial sequence
  synthetic polynucleotide sequence
gaggtggaacaggagaaga

SEQ ID NO: 2460 - DNA, 19 bp, Artificial sequence
  synthetic polynucleotide sequence
tcccgacgatcatgcagaa

SEQ ID NO: 2461 - DNA, 18 bp, Artificial sequence
  synthetic polynucleotide sequence
aacgctgaaagccatcca

SEQ ID NO: 2462 - DNA, 18 bp, Artificial sequence
  synthetic polynucleotide sequence
gatggcatcaggacagga

SEQ ID NO: 2463 - DNA, 18 bp, Artificial sequence
  synthetic polynucleotide sequence
ccagcatccatcacgcca

SEQ ID NO: 2464 - DNA, 18 bp, Artificial sequence
  synthetic polynucleotide sequence
ggagtaggatggccacca

SEQ ID NO: 2465 - DNA, 18 bp, Artificial sequence
  synthetic polynucleotide sequence
cccacaactgccaatgga

SEQ ID NO: 2466 - DNA, 18 bp, Artificial sequence
  synthetic polynucleotide sequence
caatcactggccaggaca

SEQ ID NO: 2467 - DNA, 18 bp, Artificial sequence
  synthetic polynucleotide sequence
ggcagcaccacctgccaa

SEQ ID NO: 2468 - DNA, 18 bp, Artificial sequence
  synthetic polynucleotide sequence
ggagcccacgaagaggca

SEQ ID NO: 2469 - DNA, 18 bp, Artificial sequence
  synthetic polynucleotide sequence
agaaggggaagaggccga

SEQ ID NO: 2470 - DNA, 18 bp, Artificial sequence
  synthetic polynucleotide sequence
ctccagccacggcgacca

SEQ ID NO: 2471 - DNA, 18 bp, Artificial sequence
  synthetic polynucleotide sequence
atcgccagtgacatgcaa

SEQ ID NO: 2472 - DNA, 18 bp, Artificial sequence
  synthetic polynucleotide sequence
ggtcatgtacacgggcca

SEQ ID NO: 2473 - DNA, 18 bp, Artificial sequence
  synthetic polynucleotide sequence
gcagcatgaccggtcaga

SEQ ID NO: 2474 - DNA, 18 bp, Artificial sequence
  synthetic polynucleotide sequence
gctccatccagaggctga

SEQ ID NO: 2475 - DNA, 18 bp, Artificial sequence
  synthetic polynucleotide sequence
aggcaggcttcacagcca

SEQ ID NO: 2476 - DNA, 18 bp, Artificial sequence
  synthetic polynucleotide sequence
cggtgtaggagggtcgga

SEQ ID NO: 2477 - DNA, 18 bp, Artificial sequence
  synthetic polynucleotide sequence
gcacccctactgatgcca

SEQ ID NO: 2478 - DNA, 18 bp, Artificial sequence
  synthetic polynucleotide sequence
cagatcctgacccacgca

SEQ ID NO: 2479 - DNA, 18 bp, Artificial sequence
  synthetic polynucleotide sequence
ggagctcatctcaggcca

SEQ ID NO: 2480 - DNA, 18 bp, Artificial sequence
  synthetic polynucleotide sequence
gatgccactgtggcccca

SEQ ID NO: 2481 - DNA, 18 bp, Artificial sequence
  synthetic polynucleotide sequence
gagagtggagctcagcaa

SEQ ID NO: 2482 - DNA, 18 bp, Artificial sequence
  synthetic polynucleotide sequence
accaggctccccaatgca

SEQ ID NO: 2483 - DNA, 18 bp, Artificial sequence
  synthetic polynucleotide sequence
aatacgagggaggccaca

SEQ ID NO: 2484 - DNA, 18 bp, Artificial sequence
  synthetic polynucleotide sequence
ctctcacataccggcaca

SEQ ID NO: 2485 - DNA, 18 bp, Artificial sequence
  synthetic polynucleotide sequence
ggacagtgaccaccgaga

SEQ ID NO: 2486 - DNA, 18 bp, Artificial sequence
  synthetic polynucleotide sequence
tgcccgtcaatagggcca

SEQ ID NO: 2487 - DNA, 18 bp, Artificial sequence
  synthetic polynucleotide sequence
gtctgcgtgaagaggaca

SEQ ID NO: 2488 - DNA, 18 bp, Artificial sequence
  synthetic polynucleotide sequence
ggcttcgacacctcagca

SEQ ID NO: 2489 - DNA, 18 bp, Artificial sequence
  synthetic polynucleotide sequence
gagttgaaggcatggaga

SEQ ID NO: 2490 - DNA, 18 bp, Artificial sequence
  synthetic polynucleotide sequence
acaccaggcctctggcga

SEQ ID NO: 2491 - DNA, 18 bp, Artificial sequence
  synthetic polynucleotide sequence
gcgtgaaggtgcccacca

SEQ ID NO: 2492 - DNA, 18 bp, Artificial sequence
  synthetic polynucleotide sequence
ctcatcgtccccgaagca

SEQ ID NO: 2493 - DNA, 18 bp, Artificial sequence
  synthetic polynucleotide sequence
gcaggacgccatcagcaa

SEQ ID NO: 2494 - DNA, 18 bp, Artificial sequence
  synthetic polynucleotide sequence
tagagttggggacccaga

SEQ ID NO: 2495 - DNA, 18 bp, Artificial sequence
  synthetic polynucleotide sequence
agcctatcactccagaga

SEQ ID NO: 2496 - DNA, 18 bp, Artificial sequence
  synthetic polynucleotide sequence
agtgcagaacactccaca

SEQ ID NO: 2497 - DNA, 18 bp, Artificial sequence
  synthetic polynucleotide sequence
tcagcaaggtcatccgca

SEQ ID NO: 2498 - DNA, 18 bp, Artificial sequence
  synthetic polynucleotide sequence
agagccctctgacgggga

SEQ ID NO: 2499 - DNA, 18 bp, Artificial sequence
  synthetic polynucleotide sequence
tagttgcagccccaccca

SEQ ID NO: 2500 - DNA, 18 bp, Artificial sequence
  synthetic polynucleotide sequence
gaggctcgcagttgagga

SEQ ID NO: 2501 - DNA, 18 bp, Artificial sequence
  synthetic polynucleotide sequence
tgccatcctcgaccagga

SEQ ID NO: 2502 - DNA, 18 bp, Artificial sequence
  synthetic polynucleotide sequence
cacacagcacgaccagca

SEQ ID NO: 2503 - DNA, 18 bp, Artificial sequence
  synthetic polynucleotide sequence
ccgctcggaaaagccgca

SEQ ID NO: 2504 - DNA, 18 bp, Artificial sequence
  synthetic polynucleotide sequence
ctgaggagtgagggccca

SEQ ID NO: 2505 - DNA, 18 bp, Artificial sequence
  synthetic polynucleotide sequence
agggagggagtgtggaca

SEQ ID NO: 2506 - DNA, 18 bp, Artificial sequence
  synthetic polynucleotide sequence
tggaaggccccaggtcca

SEQ ID NO: 2507 - DNA, 18 bp, Artificial sequence
  synthetic polynucleotide sequence
ccccctcctcgatgagca

SEQ ID NO: 2508 - DNA, 18 bp, Artificial sequence
  synthetic polynucleotide sequence
caggtcgatgtggaagga

SEQ ID NO: 2509 - DNA, 18 bp, Artificial sequence
  synthetic polynucleotide sequence
gtggatacgaaggcggga

SEQ ID NO: 2510 - DNA, 20 bp, Artificial sequence
  synthetic polynucleotide sequence
cagctgaaggaaatgcagga

SEQ ID NO: 2511 - DNA, 18 bp, Artificial sequence
  synthetic polynucleotide sequence
agaagcagctgcgagcca

SEQ ID NO: 2512 - DNA, 18 bp, Artificial sequence
  synthetic polynucleotide sequence
ccggcctagagaacagca

SEQ ID NO: 2513 - DNA, 18 bp, Artificial sequence
  synthetic polynucleotide sequence
cgaggatggaatggcaga

SEQ ID NO: 2514 - DNA, 18 bp, Artificial sequence
  synthetic polynucleotide sequence
taggggcaggaaggccca

SEQ ID NO: 2515 - DNA, 18 bp, Artificial sequence
  synthetic polynucleotide sequence
caggatgaccttgagcca

SEQ ID NO: 2516 - DNA, 18 bp, Artificial sequence
  synthetic polynucleotide sequence
actgcctgatcaagagca

SEQ ID NO: 2517 - DNA, 18 bp, Artificial sequence
  synthetic polynucleotide sequence
agggcaggtacaccagga

SEQ ID NO: 2518 - DNA, 18 bp, Artificial sequence
  synthetic polynucleotide sequence
cctgcagaccacatgtca

SEQ ID NO: 2519 - DNA, 18 bp, Artificial sequence
  synthetic polynucleotide sequence
gaagaccagcagtggaga

SEQ ID NO: 2520 - DNA, 18 bp, Artificial sequence
  synthetic polynucleotide sequence
actgggtacccagaggca

SEQ ID NO: 2521 - DNA, 18 bp, Artificial sequence
  synthetic polynucleotide sequence
ctccaggcctgacaccca

SEQ ID NO: 2522 - DNA, 18 bp, Artificial sequence
  synthetic polynucleotide sequence
ctgcaagtcactggccaa

SEQ ID NO: 2523 - DNA, 18 bp, Artificial sequence
  synthetic polynucleotide sequence
ctaactgcagccccacga

SEQ ID NO: 2524 - DNA, 18 bp, Artificial sequence
  synthetic polynucleotide sequence
atgatgagcccgagggca

SEQ ID NO: 2525 - DNA, 18 bp, Artificial sequence
  synthetic polynucleotide sequence
ccgtgacctcaagccaca

SEQ ID NO: 2526 - DNA, 18 bp, Artificial sequence
  synthetic polynucleotide sequence
tcgccctcagtggaccca

SEQ ID NO: 2527 - DNA, 18 bp, Artificial sequence
  synthetic polynucleotide sequence
gatgcccccaatacccca

SEQ ID NO: 2528 - DNA, 18 bp, Artificial sequence
  synthetic polynucleotide sequence
ccagcacatccacggtga

SEQ ID NO: 2529 - DNA, 18 bp, Artificial sequence
  synthetic polynucleotide sequence
gcacaggcacactgacca

SEQ ID NO: 2530 - DNA, 18 bp, Artificial sequence
  synthetic polynucleotide sequence
tgcagaggaggatggcga

SEQ ID NO: 2531 - DNA, 18 bp, Artificial sequence
  synthetic polynucleotide sequence
gcaccaacaccctcacca

SEQ ID NO: 2532 - DNA, 18 bp, Artificial sequence
  synthetic polynucleotide sequence
tgcaggcgaggatggcga

SEQ ID NO: 2533 - DNA, 18 bp, Artificial sequence
  synthetic polynucleotide sequence
gcggggattgaaacccga

SEQ ID NO: 2534 - DNA, 18 bp, Artificial sequence
  synthetic polynucleotide sequence
atcaacgccccagtgcta

SEQ ID NO: 2535 - DNA, 18 bp, Artificial sequence
  synthetic polynucleotide sequence
cgcctacgacatcagcca

SEQ ID NO: 2536 - DNA, 18 bp, Artificial sequence
  synthetic polynucleotide sequence
gtgtcgtaaggcggcaca

SEQ ID NO: 2537 - DNA, 18 bp, Artificial sequence
  synthetic polynucleotide sequence
cctggattgggagccaga

SEQ ID NO: 2538 - DNA, 18 bp, Artificial sequence
  synthetic polynucleotide sequence
cccaccagcttcgccaca

SEQ ID NO: 2539 - DNA, 18 bp, Artificial sequence
  synthetic polynucleotide sequence
gtctaccaggcacacaga

SEQ ID NO: 2540 - DNA, 18 bp, Artificial sequence
  synthetic polynucleotide sequence
cccacagtgggtatccca

SEQ ID NO: 2541 - DNA, 18 bp, Artificial sequence
  synthetic polynucleotide sequence
catccaccctggaaagca

SEQ ID NO: 2542 - DNA, 18 bp, Artificial sequence
  synthetic polynucleotide sequence
agcgagctgatagaccca

SEQ ID NO: 2543 - DNA, 18 bp, Artificial sequence
  synthetic polynucleotide sequence
caagcgctgagatcagga

SEQ ID NO: 2544 - DNA, 18 bp, Artificial sequence
  synthetic polynucleotide sequence
agcgtaggtctggaggga

SEQ ID NO: 2545 - DNA, 18 bp, Artificial sequence
  synthetic polynucleotide sequence
cttgagccagctgcagca

SEQ ID NO: 2546 - DNA, 18 bp, Artificial sequence
  synthetic polynucleotide sequence
gctgcagatcggaccgga

SEQ ID NO: 2547 - DNA, 18 bp, Artificial sequence
  synthetic polynucleotide sequence
catcgtccgctacgacga

SEQ ID NO: 2548 - DNA, 18 bp, Artificial sequence
  synthetic polynucleotide sequence
agcacgtagctgtggaca

SEQ ID NO: 2549 - DNA, 18 bp, Artificial sequence
  synthetic polynucleotide sequence
cccatcttcagccagcca

SEQ ID NO: 2550 - DNA, 18 bp, Artificial sequence
  synthetic polynucleotide sequence
cctgcagtgaagcgggga

SEQ ID NO: 2551 - DNA, 18 bp, Artificial sequence
  synthetic polynucleotide sequence
ctgagcagcactgccaca

SEQ ID NO: 2552 - DNA, 18 bp, Artificial sequence
  synthetic polynucleotide sequence
gggccacgaagagcacca

SEQ ID NO: 2553 - DNA, 18 bp, Artificial sequence
  synthetic polynucleotide sequence
tgacggtgatcagggcca

SEQ ID NO: 2554 - DNA, 18 bp, Artificial sequence
  synthetic polynucleotide sequence
gcagcaccagcaggagga

SEQ ID NO: 2555 - DNA, 18 bp, Artificial sequence
  synthetic polynucleotide sequence
gctcattgaccccgagga

SEQ ID NO: 2556 - DNA, 18 bp, Artificial sequence
  synthetic polynucleotide sequence
gctcatccacgcgacgca

SEQ ID NO: 2557 - DNA, 18 bp, Artificial sequence
  synthetic polynucleotide sequence
ctccgagtccatagccga

SEQ ID NO: 2558 - DNA, 18 bp, Artificial sequence
  synthetic polynucleotide sequence
agccgtacagctcagcca

SEQ ID NO: 2559 - DNA, 18 bp, Artificial sequence
  synthetic polynucleotide sequence
ctccaacagctcgcgaca

SEQ ID NO: 2560 - DNA, 18 bp, Artificial sequence
  synthetic polynucleotide sequence
ggtcactgactccagcga

SEQ ID NO: 2561 - DNA, 18 bp, Artificial sequence
  synthetic polynucleotide sequence
atcctccactgagcagca

SEQ ID NO: 2562 - DNA, 18 bp, Artificial sequence
  synthetic polynucleotide sequence
ccacgatgactaacagca

SEQ ID NO: 2563 - DNA, 18 bp, Artificial sequence
  synthetic polynucleotide sequence
gacgcagacccaagtgca

SEQ ID NO: 2564 - DNA, 18 bp, Artificial sequence
  synthetic polynucleotide sequence
cccccagtcactgaggta

SEQ ID NO: 2565 - DNA, 19 bp, Artificial sequence
  synthetic polynucleotide sequence
gaggatgcagaggaaccca

SEQ ID NO: 2566 - DNA, 18 bp, Artificial sequence
  synthetic polynucleotide sequence
gggcatccagggagcgga

SEQ ID NO: 2567 - DNA, 18 bp, Artificial sequence
  synthetic polynucleotide sequence
tcaggactcgctgacgca

SEQ ID NO: 2568 - DNA, 18 bp, Artificial sequence
  synthetic polynucleotide sequence
gcacacacacgaaggcca

SEQ ID NO: 2569 - DNA, 18 bp, Artificial sequence
  synthetic polynucleotide sequence
gagtccagccaccaggga

SEQ ID NO: 2570 - DNA, 18 bp, Artificial sequence
  synthetic polynucleotide sequence
accagcatcctcagccca

SEQ ID NO: 2571 - DNA, 18 bp, Artificial sequence
  synthetic polynucleotide sequence
gatccctcaggagccaca

SEQ ID NO: 2572 - DNA, 18 bp, Artificial sequence
  synthetic polynucleotide sequence
ggtcactgtgcaccagga

SEQ ID NO: 2573 - DNA, 18 bp, Artificial sequence
  synthetic polynucleotide sequence
cctcccaccaaccaacca

SEQ ID NO: 2574 - DNA, 18 bp, Artificial sequence
  synthetic polynucleotide sequence
acaaggacggcgaggcca

SEQ ID NO: 2575 - DNA, 18 bp, Artificial sequence
  synthetic polynucleotide sequence
caggtcaagtggtagcca

SEQ ID NO: 2576 - DNA, 18 bp, Artificial sequence
  synthetic polynucleotide sequence
tgtactgaccaggaggga

SEQ ID NO: 2577 - DNA, 18 bp, Artificial sequence
  synthetic polynucleotide sequence
ccagcagttaccagggca

SEQ ID NO: 2578 - DNA, 18 bp, Artificial sequence
  synthetic polynucleotide sequence
ggaatggttgcccgacca

SEQ ID NO: 2579 - DNA, 18 bp, Artificial sequence
  synthetic polynucleotide sequence
cctgagctaccaggagga

SEQ ID NO: 2580 - DNA, 18 bp, Artificial sequence
  synthetic polynucleotide sequence
tcaccatagcgaggccca

SEQ ID NO: 2581 - DNA, 18 bp, Artificial sequence
  synthetic polynucleotide sequence
ggccatcaagctagcaga

SEQ ID NO: 2582 - DNA, 18 bp, Artificial sequence
  synthetic polynucleotide sequence
cctggccacaccacctca

SEQ ID NO: 2583 - DNA, 18 bp, Artificial sequence
  synthetic polynucleotide sequence
agccgaccagttgggcaa

SEQ ID NO: 2584 - DNA, 18 bp, Artificial sequence
  synthetic polynucleotide sequence
catctcaggtaccaccga

SEQ ID NO: 2585 - DNA, 18 bp, Artificial sequence
  synthetic polynucleotide sequence
ggggaaggcacctacgga

SEQ ID NO: 2586 - DNA, 18 bp, Artificial sequence
  synthetic polynucleotide sequence
agggcggaactcggcaca

SEQ ID NO: 2587 - DNA, 18 bp, Artificial sequence
  synthetic polynucleotide sequence
gtgctaccgcctgaagca

SEQ ID NO: 2588 - DNA, 18 bp, Artificial sequence
  synthetic polynucleotide sequence
ggtacaggcatgtcagca

SEQ ID NO: 2589 - DNA, 18 bp, Artificial sequence
  synthetic polynucleotide sequence
taccaggacagcccagga

SEQ ID NO: 2590 - DNA, 18 bp, Artificial sequence
  synthetic polynucleotide sequence
aaggtcatcaggtgggca

SEQ ID NO: 2591 - DNA, 18 bp, Artificial sequence
  synthetic polynucleotide sequence
ggtgaccagcagcggaca

SEQ ID NO: 2592 - DNA, 18 bp, Artificial sequence
  synthetic polynucleotide sequence
tatgcagccaacactcca

SEQ ID NO: 2593 - DNA, 18 bp, Artificial sequence
  synthetic polynucleotide sequence
cagtgcagcaggagacga

SEQ ID NO: 2594 - DNA, 18 bp, Artificial sequence
  synthetic polynucleotide sequence
ggccgtaattcgagcaca

SEQ ID NO: 2595 - DNA, 18 bp, Artificial sequence
  synthetic polynucleotide sequence
ggctatgcaggaccccta

SEQ ID NO: 2596 - DNA, 18 bp, Artificial sequence
  synthetic polynucleotide sequence
gggatttgacaaccggca

SEQ ID NO: 2597 - DNA, 18 bp, Artificial sequence
  synthetic polynucleotide sequence
caagggccagaagcggaa

SEQ ID NO: 2598 - DNA, 18 bp, Artificial sequence
  synthetic polynucleotide sequence
gcatggggtcggaccaga

SEQ ID NO: 2599 - DNA, 18 bp, Artificial sequence
  synthetic polynucleotide sequence
gctgagccgcgactgtga

SEQ ID NO: 2600 - DNA, 18 bp, Artificial sequence
  synthetic polynucleotide sequence
aagacagtgacaggtcca

SEQ ID NO: 2601 - DNA, 18 bp, Artificial sequence
  synthetic polynucleotide sequence
gcgacctgcaaccgacga

SEQ ID NO: 2602 - DNA, 18 bp, Artificial sequence
  synthetic polynucleotide sequence
agaaccggcatttgggga

SEQ ID NO: 2603 - DNA, 18 bp, Artificial sequence
  synthetic polynucleotide sequence
tgagaagtcgtcgggcga

SEQ ID NO: 2604 - DNA, 18 bp, Artificial sequence
  synthetic polynucleotide sequence
cggggtctgctccaccga

SEQ ID NO: 2605 - DNA, 18 bp, Artificial sequence
  synthetic polynucleotide sequence
gttacggtcggaggccga

SEQ ID NO: 2606 - DNA, 18 bp, Artificial sequence
  synthetic polynucleotide sequence
aatcgaagcgctacctga

SEQ ID NO: 2607 - DNA, 18 bp, Artificial sequence
  synthetic polynucleotide sequence
ccagccaaagcagcagca

SEQ ID NO: 2608 - DNA, 18 bp, Artificial sequence
  synthetic polynucleotide sequence
ccaacaagggcacctcga

SEQ ID NO: 2609 - DNA, 18 bp, Artificial sequence
  synthetic polynucleotide sequence
cctgccactctcacccga

SEQ ID NO: 2610 - DNA, 18 bp, Artificial sequence
  synthetic polynucleotide sequence
gccaagtccacgggcaga

SEQ ID NO: 2611 - DNA, 18 bp, Artificial sequence
  synthetic polynucleotide sequence
catgatgcggccagagca

SEQ ID NO: 2612 - DNA, 18 bp, Artificial sequence
  synthetic polynucleotide sequence
gcttcaccaggaactcca

SEQ ID NO: 2613 - DNA, 18 bp, Artificial sequence
  synthetic polynucleotide sequence
cggggcacttccaatcca

SEQ ID NO: 2614 - DNA, 18 bp, Artificial sequence
  synthetic polynucleotide sequence
ctgcagtgccagctccaa

SEQ ID NO: 2615 - DNA, 18 bp, Artificial sequence
  synthetic polynucleotide sequence
caatcgcagatggaggga

SEQ ID NO: 2616 - DNA, 18 bp, Artificial sequence
  synthetic polynucleotide sequence
cccaagtcctccatagca

SEQ ID NO: 2617 - DNA, 18 bp, Artificial sequence
  synthetic polynucleotide sequence
gcagccacaaagatccta

SEQ ID NO: 2618 - DNA, 18 bp, Artificial sequence
  synthetic polynucleotide sequence
caactgatgccaagtcca

SEQ ID NO: 2619 - DNA, 18 bp, Artificial sequence
  synthetic polynucleotide sequence
gaacatcagccatacgga

SEQ ID NO: 2620 - DNA, 18 bp, Artificial sequence
  synthetic polynucleotide sequence
gttctccagcgagcccga

SEQ ID NO: 2621 - DNA, 18 bp, Artificial sequence
  synthetic polynucleotide sequence
cggttcgagtcccaggaa

SEQ ID NO: 2622 - DNA, 18 bp, Artificial sequence
  synthetic polynucleotide sequence
gatgcccacgggtggaga

SEQ ID NO: 2623 - DNA, 18 bp, Artificial sequence
  synthetic polynucleotide sequence
ctgcatcaggagggccaa

SEQ ID NO: 2624 - DNA, 18 bp, Artificial sequence
  synthetic polynucleotide sequence
agttcccagccgctggca

SEQ ID NO: 2625 - DNA, 18 bp, Artificial sequence
  synthetic polynucleotide sequence
acgaaaccgagagcacca

SEQ ID NO: 2626 - DNA, 18 bp, Artificial sequence
  synthetic polynucleotide sequence
tcagcatgaaggatccca

SEQ ID NO: 2627 - DNA, 18 bp, Artificial sequence
  synthetic polynucleotide sequence
atccccagccagtcggca

SEQ ID NO: 2628 - DNA, 18 bp, Artificial sequence
  synthetic polynucleotide sequence
ccacagagctggacccca

SEQ ID NO: 2629 - DNA, 18 bp, Artificial sequence
  synthetic polynucleotide sequence
gcagagcaaaggagagga

SEQ ID NO: 2630 - DNA, 18 bp, Artificial sequence
  synthetic polynucleotide sequence
tgcagggaagacaccgga

SEQ ID NO: 2631 - DNA, 18 bp, Artificial sequence
  synthetic polynucleotide sequence
agggaaactcctccggga

SEQ ID NO: 2632 - DNA, 18 bp, Artificial sequence
  synthetic polynucleotide sequence
gaagcagtaactgagcca

SEQ ID NO: 2633 - DNA, 18 bp, Artificial sequence
  synthetic polynucleotide sequence
gcaggaggcgtgtggcaa

SEQ ID NO: 2634 - DNA, 18 bp, Artificial sequence
  synthetic polynucleotide sequence
gcgcacgagggctttgga

SEQ ID NO: 2635 - DNA, 18 bp, Artificial sequence
  synthetic polynucleotide sequence
tccagacgccctacgcca

SEQ ID NO: 2636 - DNA, 18 bp, Artificial sequence
  synthetic polynucleotide sequence
gctgaacgtggtgggcca

SEQ ID NO: 2637 - DNA, 18 bp, Artificial sequence
  synthetic polynucleotide sequence
gcaacaccaccctcagca

SEQ ID NO: 2638 - DNA, 18 bp, Artificial sequence
  synthetic polynucleotide sequence
accagggccactactcca

SEQ ID NO: 2639 - DNA, 18 bp, Artificial sequence
  synthetic polynucleotide sequence
gctgagatcggctcccaa

SEQ ID NO: 2640 - DNA, 18 bp, Artificial sequence
  synthetic polynucleotide sequence
tgcatcggtaacggccca

SEQ ID NO: 2641 - DNA, 18 bp, Artificial sequence
  synthetic polynucleotide sequence
gcacatggatggcgacca

SEQ ID NO: 2642 - DNA, 18 bp, Artificial sequence
  synthetic polynucleotide sequence
gacaccaggaggactgga

SEQ ID NO: 2643 - DNA, 18 bp, Artificial sequence
  synthetic polynucleotide sequence
ccccatcaggcaggagga

SEQ ID NO: 2644 - DNA, 18 bp, Artificial sequence
  synthetic polynucleotide sequence
gccaccagaagactccca

SEQ ID NO: 2645 - DNA, 18 bp, Artificial sequence
  synthetic polynucleotide sequence
tgacctcaaggagcagca

SEQ ID NO: 2646 - DNA, 18 bp, Artificial sequence
  synthetic polynucleotide sequence
ggcagtggagagagggga

SEQ ID NO: 2647 - DNA, 18 bp, Artificial sequence
  synthetic polynucleotide sequence
gcaaaccgcagtgaccca

SEQ ID NO: 2648 - DNA, 18 bp, Artificial sequence
  synthetic polynucleotide sequence
agaggccgagtggcagga

SEQ ID NO: 2649 - DNA, 18 bp, Artificial sequence
  synthetic polynucleotide sequence
ggcctcaataggaccaca

SEQ ID NO: 2650 - DNA, 18 bp, Artificial sequence
  synthetic polynucleotide sequence
gagccaccctggccagca

SEQ ID NO: 2651 - DNA, 18 bp, Artificial sequence
  synthetic polynucleotide sequence
agccacccaagccctcca

SEQ ID NO: 2652 - DNA, 18 bp, Artificial sequence
  synthetic polynucleotide sequence
gagagcagcagcctggga

SEQ ID NO: 2653 - DNA, 18 bp, Artificial sequence
  synthetic polynucleotide sequence
gcccagatgcccccacca

SEQ ID NO: 2654 - DNA, 18 bp, Artificial sequence
  synthetic polynucleotide sequence
ggtggattagaggccgca

SEQ ID NO: 2655 - DNA, 18 bp, Artificial sequence
  synthetic polynucleotide sequence
agaacgagcggctgcaga

SEQ ID NO: 2656 - DNA, 18 bp, Artificial sequence
  synthetic polynucleotide sequence
cgagcaggggctcgggca

SEQ ID NO: 2657 - DNA, 18 bp, Artificial sequence
  synthetic polynucleotide sequence
accaggagatgcagcaga

SEQ ID NO: 2658 - DNA, 18 bp, Artificial sequence
  synthetic polynucleotide sequence
cggccaggtcccgcgtga

SEQ ID NO: 2659 - DNA, 18 bp, Artificial sequence
  synthetic polynucleotide sequence
aacaccccgcagtcagga

SEQ ID NO: 2660 - DNA, 18 bp, Artificial sequence
  synthetic polynucleotide sequence
gacaagcctttggcacca

SEQ ID NO: 2661 - DNA, 18 bp, Artificial sequence
  synthetic polynucleotide sequence
gcgtctacaatcccagga

SEQ ID NO: 2662 - DNA, 18 bp, Artificial sequence
  synthetic polynucleotide sequence
accagctgcacagcctca

SEQ ID NO: 2663 - DNA, 18 bp, Artificial sequence
  synthetic polynucleotide sequence
acagcggctacctggaga

SEQ ID NO: 2664 - DNA, 18 bp, Artificial sequence
  synthetic polynucleotide sequence
tgagggtccagtagcgca

SEQ ID NO: 2665 - DNA, 18 bp, Artificial sequence
  synthetic polynucleotide sequence
cggcaccattctacccaa

SEQ ID NO: 2666 - DNA, 18 bp, Artificial sequence
  synthetic polynucleotide sequence
acgccatcacccccagca

SEQ ID NO: 2667 - DNA, 18 bp, Artificial sequence
  synthetic polynucleotide sequence
cagcaccgtgaagacgaa

SEQ ID NO: 2668 - DNA, 18 bp, Artificial sequence
  synthetic polynucleotide sequence
gtgaggctgccgatgcca

SEQ ID NO: 2669 - DNA, 18 bp, Artificial sequence
  synthetic polynucleotide sequence
aggtccacggtgtgacca

SEQ ID NO: 2670 - DNA, 18 bp, Artificial sequence
  synthetic polynucleotide sequence
ccagtcgatgaaggcgga

SEQ ID NO: 2671 - DNA, 18 bp, Artificial sequence
  synthetic polynucleotide sequence
cccagacaagctgcagga

SEQ ID NO: 2672 - DNA, 18 bp, Artificial sequence
  synthetic polynucleotide sequence
ggtcctccagagtcacca

SEQ ID NO: 2673 - DNA, 18 bp, Artificial sequence
  synthetic polynucleotide sequence
cgccacaggcttgacgaa

SEQ ID NO: 2674 - DNA, 18 bp, Artificial sequence
  synthetic polynucleotide sequence
ggctgtacagagtgggca

SEQ ID NO: 2675 - DNA, 18 bp, Artificial sequence
  synthetic polynucleotide sequence
acccctacccagcacaga

SEQ ID NO: 2676 - DNA, 18 bp, Artificial sequence
  synthetic polynucleotide sequence
attggaggcggctgagga

SEQ ID NO: 2677 - DNA, 18 bp, Artificial sequence
  synthetic polynucleotide sequence
gtccaggaaccggacaca

SEQ ID NO: 2678 - DNA, 18 bp, Artificial sequence
  synthetic polynucleotide sequence
tcaggaggacgaaggcca

SEQ ID NO: 2679 - DNA, 18 bp, Artificial sequence
  synthetic polynucleotide sequence
tgagcggctacagcggaa

SEQ ID NO: 2680 - DNA, 18 bp, Artificial sequence
  synthetic polynucleotide sequence
tgtgtggcagacagccca

SEQ ID NO: 2681 - DNA, 18 bp, Artificial sequence
  synthetic polynucleotide sequence
ggctaaaggagatccgaa

SEQ ID NO: 2682 - DNA, 18 bp, Artificial sequence
  synthetic polynucleotide sequence
ccaggcggctgaagggca

SEQ ID NO: 2683 - DNA, 18 bp, Artificial sequence
  synthetic polynucleotide sequence
gggagaaaagagcaggca

SEQ ID NO: 2684 - DNA, 18 bp, Artificial sequence
  synthetic polynucleotide sequence
ttgagccgcacacctgca

SEQ ID NO: 2685 - DNA, 18 bp, Artificial sequence
  synthetic polynucleotide sequence
gctgacatcccgacagga

SEQ ID NO: 2686 - DNA, 18 bp, Artificial sequence
  synthetic polynucleotide sequence
gccgagactcagtgggga

SEQ ID NO: 2687 - DNA, 18 bp, Artificial sequence
  synthetic polynucleotide sequence
gggcatcagcagcagaga

SEQ ID NO: 2688 - DNA, 18 bp, Artificial sequence
  synthetic polynucleotide sequence
gaggatctcgagggctca

SEQ ID NO: 2689 - DNA, 18 bp, Artificial sequence
  synthetic polynucleotide sequence
gtgaggaaaagcgtgcaa

SEQ ID NO: 2690 - DNA, 18 bp, Artificial sequence
  synthetic polynucleotide sequence
ccaggcaattcgaatcca

SEQ ID NO: 2691 - DNA, 18 bp, Artificial sequence
  synthetic polynucleotide sequence
ggccgagctctctaagga

SEQ ID NO: 2692 - DNA, 18 bp, Artificial sequence
  synthetic polynucleotide sequence
gcatggtgtccagcagca

SEQ ID NO: 2693 - DNA, 18 bp, Artificial sequence
  synthetic polynucleotide sequence
agcagcagagcctcccga

SEQ ID NO: 2694 - DNA, 18 bp, Artificial sequence
  synthetic polynucleotide sequence
agacggatgacagcagca

SEQ ID NO: 2695 - DNA, 18 bp, Artificial sequence
  synthetic polynucleotide sequence
cgcatgccactgtgccaa

SEQ ID NO: 2696 - DNA, 18 bp, Artificial sequence
  synthetic polynucleotide sequence
ctgctagccgagtgacca

SEQ ID NO: 2697 - DNA, 18 bp, Artificial sequence
  synthetic polynucleotide sequence
tggagcgagaacggagga

SEQ ID NO: 2698 - DNA, 18 bp, Artificial sequence
  synthetic polynucleotide sequence
gctgagcttgcagcagga

SEQ ID NO: 2699 - DNA, 18 bp, Artificial sequence
  synthetic polynucleotide sequence
ccatgccgtggtagccaa

SEQ ID NO: 2700 - DNA, 18 bp, Artificial sequence
  synthetic polynucleotide sequence
ataccgttggaggaggga

SEQ ID NO: 2701 - DNA, 18 bp, Artificial sequence
  synthetic polynucleotide sequence
ctgcacagcaacgaggca

SEQ ID NO: 2702 - DNA, 18 bp, Artificial sequence
  synthetic polynucleotide sequence
aaggcggctttgcaggga

SEQ ID NO: 2703 - DNA, 18 bp, Artificial sequence
  synthetic polynucleotide sequence
ctgccaagttcaccacga

SEQ ID NO: 2704 - DNA, 18 bp, Artificial sequence
  synthetic polynucleotide sequence
actggcactcctccacca

SEQ ID NO: 2705 - DNA, 18 bp, Artificial sequence
  synthetic polynucleotide sequence
ccagcaccccaacgagca

SEQ ID NO: 2706 - DNA, 18 bp, Artificial sequence
  synthetic polynucleotide sequence
gcatagtgggtaggggca

SEQ ID NO: 2707 - DNA, 18 bp, Artificial sequence
  synthetic polynucleotide sequence
acccaggctctgtgacca

SEQ ID NO: 2708 - DNA, 18 bp, Artificial sequence
  synthetic polynucleotide sequence
gaagtgagggccacgcca

SEQ ID NO: 2709 - DNA, 18 bp, Artificial sequence
  synthetic polynucleotide sequence
ctcggacgcacaagccaa

SEQ ID NO: 2710 - DNA, 18 bp, Artificial sequence
  synthetic polynucleotide sequence
tcagccttcacccaggca

SEQ ID NO: 2711 - DNA, 18 bp, Artificial sequence
  synthetic polynucleotide sequence
tggctggatgcaaccaca

SEQ ID NO: 2712 - DNA, 18 bp, Artificial sequence
  synthetic polynucleotide sequence
tcaccacaccatccacca

SEQ ID NO: 2713 - DNA, 18 bp, Artificial sequence
  synthetic polynucleotide sequence
cccttacctggaggccca

SEQ ID NO: 2714 - DNA, 18 bp, Artificial sequence
  synthetic polynucleotide sequence
tcctcaggcacctcagca

SEQ ID NO: 2715 - DNA, 18 bp, Artificial sequence
  synthetic polynucleotide sequence
gggcttcaacaccaacca

SEQ ID NO: 2716 - DNA, 18 bp, Artificial sequence
  synthetic polynucleotide sequence
ggcaggagatcttgggca

SEQ ID NO: 2717 - DNA, 18 bp, Artificial sequence
  synthetic polynucleotide sequence
gcaaccatggcaggccaa

SEQ ID NO: 2718 - DNA, 18 bp, Artificial sequence
  synthetic polynucleotide sequence
cagacaccacagccccca

SEQ ID NO: 2719 - DNA, 18 bp, Artificial sequence
  synthetic polynucleotide sequence
cactcagaagcaccgaca

SEQ ID NO: 2720 - DNA, 18 bp, Artificial sequence
  synthetic polynucleotide sequence
gaagctgcccagcacgca

SEQ ID NO: 2721 - DNA, 18 bp, Artificial sequence
  synthetic polynucleotide sequence
gacgcctgaccgctgtga

SEQ ID NO: 2722 - DNA, 18 bp, Artificial sequence
  synthetic polynucleotide sequence
gcaggagtgcgcagggca

SEQ ID NO: 2723 - DNA, 18 bp, Artificial sequence
  synthetic polynucleotide sequence
ggacagctgcaagggtga

SEQ ID NO: 2724 - DNA, 18 bp, Artificial sequence
  synthetic polynucleotide sequence
ctgtcgatccaggccgca

SEQ ID NO: 2725 - DNA, 18 bp, Artificial sequence
  synthetic polynucleotide sequence
aggcgggtgagcaagtga

SEQ ID NO: 2726 - DNA, 18 bp, Artificial sequence
  synthetic polynucleotide sequence
gggcggattcacacagga

SEQ ID NO: 2727 - DNA, 18 bp, Artificial sequence
  synthetic polynucleotide sequence
gatggtcaccaacaccaa

SEQ ID NO: 2728 - DNA, 18 bp, Artificial sequence
  synthetic polynucleotide sequence
gggcggattcacacagga

SEQ ID NO: 2729 - DNA, 18 bp, Artificial sequence
  synthetic polynucleotide sequence
tggtcaccagcagtacca

SEQ ID NO: 2730 - DNA, 18 bp, Artificial sequence
  synthetic polynucleotide sequence
gcatctgggagtaggaga

SEQ ID NO: 2731 - DNA, 18 bp, Artificial sequence
  synthetic polynucleotide sequence
gaaacaccacaggttcca

SEQ ID NO: 2732 - DNA, 18 bp, Artificial sequence
  synthetic polynucleotide sequence
ataggtggaggaggccca

SEQ ID NO: 2733 - DNA, 18 bp, Artificial sequence
  synthetic polynucleotide sequence
agggtcaacagtgacgta

SEQ ID NO: 2734 - DNA, 18 bp, Artificial sequence
  synthetic polynucleotide sequence
cacacatggatctaggca

SEQ ID NO: 2735 - DNA, 18 bp, Artificial sequence
  synthetic polynucleotide sequence
agactggatacaccccga

SEQ ID NO: 2736 - DNA, 18 bp, Artificial sequence
  synthetic polynucleotide sequence
atggaacgaggcagctca

SEQ ID NO: 2737 - DNA, 18 bp, Artificial sequence
  synthetic polynucleotide sequence
gggccagactgtcgacga

SEQ ID NO: 2738 - DNA, 18 bp, Artificial sequence
  synthetic polynucleotide sequence
atagagggcatagcggca

SEQ ID NO: 2739 - DNA, 18 bp, Artificial sequence
  synthetic polynucleotide sequence
aagcgagggctgtgcaca

SEQ ID NO: 2740 - DNA, 18 bp, Artificial sequence
  synthetic polynucleotide sequence
gcactgcaggtacaggga

SEQ ID NO: 2741 - DNA, 18 bp, Artificial sequence
  synthetic polynucleotide sequence
gctgccacggtgtgagga

SEQ ID NO: 2742 - DNA, 18 bp, Artificial sequence
  synthetic polynucleotide sequence
agcaggcacgtgtagaca

SEQ ID NO: 2743 - DNA, 18 bp, Artificial sequence
  synthetic polynucleotide sequence
gccttctgggaggaggga

SEQ ID NO: 2744 - DNA, 18 bp, Artificial sequence
  synthetic polynucleotide sequence
gctccagtggatccagca

SEQ ID NO: 2745 - DNA, 18 bp, Artificial sequence
  synthetic polynucleotide sequence
acgtcacctcagagtcca

SEQ ID NO: 2746 - DNA, 18 bp, Artificial sequence
  synthetic polynucleotide sequence
acaagtactgcagtggca

SEQ ID NO: 2747 - DNA, 18 bp, Artificial sequence
  synthetic polynucleotide sequence
ggtgtgcaactaccgcga

SEQ ID NO: 2748 - DNA, 18 bp, Artificial sequence
  synthetic polynucleotide sequence
ggaggggcctttgaggaa

SEQ ID NO: 2749 - DNA, 19 bp, Artificial sequence
  synthetic polynucleotide sequence
gccggctactgccccacca

SEQ ID NO: 2750 - DNA, 18 bp, Artificial sequence
  synthetic polynucleotide sequence
ccacggcgtaggagacca

SEQ ID NO: 2751 - DNA, 18 bp, Artificial sequence
  synthetic polynucleotide sequence
gctggaccagtgagagga

SEQ ID NO: 2752 - DNA, 18 bp, Artificial sequence
  synthetic polynucleotide sequence
gcagcagcaacagcagca

SEQ ID NO: 2753 - DNA, 18 bp, Artificial sequence
  synthetic polynucleotide sequence
gtgccggctactgcccca

SEQ ID NO: 2754 - DNA, 18 bp, Artificial sequence
  synthetic polynucleotide sequence
aggaagaggaggcctgga

SEQ ID NO: 2755 - DNA, 18 bp, Artificial sequence
  synthetic polynucleotide sequence
agtgctcgagacccagga

SEQ ID NO: 2756 - DNA, 18 bp, Artificial sequence
  synthetic polynucleotide sequence
tgagggctactcccggga

SEQ ID NO: 2757 - DNA, 18 bp, Artificial sequence
  synthetic polynucleotide sequence
tgaagctctgcagaagca

SEQ ID NO: 2758 - DNA, 18 bp, Artificial sequence
  synthetic polynucleotide sequence
gctaccaatggatagcga

SEQ ID NO: 2759 - DNA, 18 bp, Artificial sequence
  synthetic polynucleotide sequence
gccctcctgccccacgaa

SEQ ID NO: 2760 - DNA, 18 bp, Artificial sequence
  synthetic polynucleotide sequence
tgcggtacagccagggca

SEQ ID NO: 2761 - DNA, 18 bp, Artificial sequence
  synthetic polynucleotide sequence
gatgctcctgaccaacca

SEQ ID NO: 2762 - DNA, 18 bp, Artificial sequence
  synthetic polynucleotide sequence
tgaagtctgccagacgca

SEQ ID NO: 2763 - DNA, 18 bp, Artificial sequence
  synthetic polynucleotide sequence
ccttcgacagcctggaga

SEQ ID NO: 2764 - DNA, 18 bp, Artificial sequence
  synthetic polynucleotide sequence
aacttggcaggtgaggca

SEQ ID NO: 2765 - DNA, 18 bp, Artificial sequence
  synthetic polynucleotide sequence
gctgcacctggacaggaa

SEQ ID NO: 2766 - DNA, 18 bp, Artificial sequence
  synthetic polynucleotide sequence
gaagaggtgctgcagcga

SEQ ID NO: 2767 - DNA, 18 bp, Artificial sequence
  synthetic polynucleotide sequence
cttccaggcagacacgga

SEQ ID NO: 2768 - DNA, 18 bp, Artificial sequence
  synthetic polynucleotide sequence
tccggaagcggctccaca

SEQ ID NO: 2769 - DNA, 18 bp, Artificial sequence
  synthetic polynucleotide sequence
tcccaaaccccagaagca

SEQ ID NO: 2770 - DNA, 18 bp, Artificial sequence
  synthetic polynucleotide sequence
tggagatgcagctgggga

SEQ ID NO: 2771 - DNA, 18 bp, Artificial sequence
  synthetic polynucleotide sequence
ctacaacccccagccaga

SEQ ID NO: 2772 - DNA, 18 bp, Artificial sequence
  synthetic polynucleotide sequence
tctcagtaggcggcagca

SEQ ID NO: 2773 - DNA, 18 bp, Artificial sequence
  synthetic polynucleotide sequence
cgcctacgagatcaggca

SEQ ID NO: 2774 - DNA, 18 bp, Artificial sequence
  synthetic polynucleotide sequence
ggagctcagaccatggta

SEQ ID NO: 2775 - DNA, 18 bp, Artificial sequence
  synthetic polynucleotide sequence
gaacaagagccccaggaa

SEQ ID NO: 2776 - DNA, 18 bp, Artificial sequence
  synthetic polynucleotide sequence
ggcaaccttgaactggga

SEQ ID NO: 2777 - DNA, 18 bp, Artificial sequence
  synthetic polynucleotide sequence
agcgatccgctgagccaa

SEQ ID NO: 2778 - DNA, 18 bp, Artificial sequence
  synthetic polynucleotide sequence
gacaggacattggaacga

SEQ ID NO: 2779 - DNA, 18 bp, Artificial sequence
  synthetic polynucleotide sequence
tccaccatggggaagcga

SEQ ID NO: 2780 - DNA, 18 bp, Artificial sequence
  synthetic polynucleotide sequence
cttccggaacggtgggca

SEQ ID NO: 2781 - DNA, 18 bp, Artificial sequence
  synthetic polynucleotide sequence
gggagaggaagaagggga

SEQ ID NO: 2782 - DNA, 18 bp, Artificial sequence
  synthetic polynucleotide sequence
ggaatgtcaggcagggga

SEQ ID NO: 2783 - DNA, 18 bp, Artificial sequence
  synthetic polynucleotide sequence
ggcctccagaaacgccaa

SEQ ID NO: 2784 - DNA, 18 bp, Artificial sequence
  synthetic polynucleotide sequence
ccaggagaagcgcaacca

SEQ ID NO: 2785 - DNA, 18 bp, Artificial sequence
  synthetic polynucleotide sequence
gggcttcaatgcccgaca

SEQ ID NO: 2786 - DNA, 18 bp, Artificial sequence
  synthetic polynucleotide sequence
ctcgaaggtcccgcacca

SEQ ID NO: 2787 - DNA, 18 bp, Artificial sequence
  synthetic polynucleotide sequence
cacgtgggagctagagga

SEQ ID NO: 2788 - DNA, 18 bp, Artificial sequence
  synthetic polynucleotide sequence
ccagctggtactcccgga

SEQ ID NO: 2789 - DNA, 18 bp, Artificial sequence
  synthetic polynucleotide sequence
ggagcgagcagaagagga

SEQ ID NO: 2790 - DNA, 18 bp, Artificial sequence
  synthetic polynucleotide sequence
agctggagcgactggaga

SEQ ID NO: 2791 - DNA, 18 bp, Artificial sequence
  synthetic polynucleotide sequence
ctctgagtggcccaagga

SEQ ID NO: 2792 - DNA, 18 bp, Artificial sequence
  synthetic polynucleotide sequence
gggactggagagtcacca

SEQ ID NO: 2793 - DNA, 18 bp, Artificial sequence
  synthetic polynucleotide sequence
gcgtcgcgtcactgagca

SEQ ID NO: 2794 - DNA, 18 bp, Artificial sequence
  synthetic polynucleotide sequence
aatacgaggctgccagca

SEQ ID NO: 2795 - DNA, 18 bp, Artificial sequence
  synthetic polynucleotide sequence
gggaccaacccagtgaca

SEQ ID NO: 2796 - DNA, 18 bp, Artificial sequence
  synthetic polynucleotide sequence
ctctgacacaccacctga

SEQ ID NO: 2797 - DNA, 18 bp, Artificial sequence
  synthetic polynucleotide sequence
gcaagagaggcagaccca

SEQ ID NO: 2798 - DNA, 18 bp, Artificial sequence
  synthetic polynucleotide sequence
gaaggtactgcacagcca

SEQ ID NO: 2799 - DNA, 18 bp, Artificial sequence
  synthetic polynucleotide sequence
ccctctgcaaggaagcca

SEQ ID NO: 2800 - DNA, 18 bp, Artificial sequence
  synthetic polynucleotide sequence
cccagtacaggtggcaga

SEQ ID NO: 2801 - DNA, 18 bp, Artificial sequence
  synthetic polynucleotide sequence
gatggaccagctggccaa

SEQ ID NO: 2802 - DNA, 18 bp, Artificial sequence
  synthetic polynucleotide sequence
ccgggaggatggcctcca

SEQ ID NO: 2803 - DNA, 18 bp, Artificial sequence
  synthetic polynucleotide sequence
agggaagtggcagcagca

SEQ ID NO: 2804 - DNA, 18 bp, Artificial sequence
  synthetic polynucleotide sequence
ccactggagagggtcgta

SEQ ID NO: 2805 - DNA, 18 bp, Artificial sequence
  synthetic polynucleotide sequence
aggatacgacgaccagga

SEQ ID NO: 2806 - DNA, 18 bp, Artificial sequence
  synthetic polynucleotide sequence
tggtgagagggaagcgca

SEQ ID NO: 2807 - DNA, 18 bp, Artificial sequence
  synthetic polynucleotide sequence
gtcatgggcatccccaca

SEQ ID NO: 2808 - DNA, 18 bp, Artificial sequence
  synthetic polynucleotide sequence
ataggccaggaagcctga

SEQ ID NO: 2809 - DNA, 18 bp, Artificial sequence
  synthetic polynucleotide sequence
tgggccctatgccaagga

SEQ ID NO: 2810 - DNA, 18 bp, Artificial sequence
  synthetic polynucleotide sequence
ccagatcaatggcccaga

SEQ ID NO: 2811 - DNA, 18 bp, Artificial sequence
  synthetic polynucleotide sequence
ggaagaggaggacgagga

SEQ ID NO: 2812 - DNA, 18 bp, Artificial sequence
  synthetic polynucleotide sequence
tacggtgacgtgaccgga

SEQ ID NO: 2813 - DNA, 18 bp, Artificial sequence
  synthetic polynucleotide sequence
gccaggtacatccagaca

SEQ ID NO: 2814 - DNA, 18 bp, Artificial sequence
  synthetic polynucleotide sequence
tagagaccccaacgccca

SEQ ID NO: 2815 - DNA, 18 bp, Artificial sequence
  synthetic polynucleotide sequence
gccctctgaacctgagca

SEQ ID NO: 2816 - DNA, 18 bp, Artificial sequence
  synthetic polynucleotide sequence
ggattgggatagagccca

SEQ ID NO: 2817 - DNA, 18 bp, Artificial sequence
  synthetic polynucleotide sequence
ttcaaggggctgaggcca

SEQ ID NO: 2818 - DNA, 18 bp, Artificial sequence
  synthetic polynucleotide sequence
ccagtcggccttggggaa

SEQ ID NO: 2819 - DNA, 18 bp, Artificial sequence
  synthetic polynucleotide sequence
aagccacagggagcccca

SEQ ID NO: 2820 - DNA, 18 bp, Artificial sequence
  synthetic polynucleotide sequence
gactgagggtcaggccca

SEQ ID NO: 2821 - DNA, 18 bp, Artificial sequence
  synthetic polynucleotide sequence
cgcaggagcaggtggaca

SEQ ID NO: 2822 - DNA, 18 bp, Artificial sequence
  synthetic polynucleotide sequence
cggccaacctccgtgaca

SEQ ID NO: 2823 - DNA, 18 bp, Artificial sequence
  synthetic polynucleotide sequence
gcacaaactgacgggaca

SEQ ID NO: 2824 - DNA, 18 bp, Artificial sequence
  synthetic polynucleotide sequence
gcagcaagctccatggta

SEQ ID NO: 2825 - DNA, 18 bp, Artificial sequence
  synthetic polynucleotide sequence
cctccgaactccacagca

SEQ ID NO: 2826 - DNA, 17 bp, Artificial sequence
  synthetic polynucleotide sequence
ctcccgaagtcggacca

SEQ ID NO: 2827 - DNA, 18 bp, Artificial sequence
  synthetic polynucleotide sequence
gggagtgaaatgtgcaga

SEQ ID NO: 2828 - DNA, 18 bp, Artificial sequence
  synthetic polynucleotide sequence
acgagcgtcgtaaggtca

SEQ ID NO: 2829 - DNA, 18 bp, Artificial sequence
  synthetic polynucleotide sequence
agtgtgcagacagccgca

SEQ ID NO: 2830 - DNA, 18 bp, Artificial sequence
  synthetic polynucleotide sequence
ggaagtcaggcgtgagca

SEQ ID NO: 2831 - DNA, 18 bp, Artificial sequence
  synthetic polynucleotide sequence
ggccaggaagaggaggaa

SEQ ID NO: 2832 - DNA, 18 bp, Artificial sequence
  synthetic polynucleotide sequence
tgcagtctcgcagggaga

SEQ ID NO: 2833 - DNA, 18 bp, Artificial sequence
  synthetic polynucleotide sequence
ggcacctggcaaaaggca

SEQ ID NO: 2834 - DNA, 18 bp, Artificial sequence
  synthetic polynucleotide sequence
gggagaccaggcaccaca

SEQ ID NO: 2835 - DNA, 18 bp, Artificial sequence
  synthetic polynucleotide sequence
ccgggtatgcagaggaga

SEQ ID NO: 2836 - DNA, 18 bp, Artificial sequence
  synthetic polynucleotide sequence
aagcgggacagacctcca

SEQ ID NO: 2837 - DNA, 18 bp, Artificial sequence
  synthetic polynucleotide sequence
ctcgccacttcagaccca

SEQ ID NO: 2838 - DNA, 18 bp, Artificial sequence
  synthetic polynucleotide sequence
cttcccgccatgcacaca

SEQ ID NO: 2839 - DNA, 18 bp, Artificial sequence
  synthetic polynucleotide sequence
ctgccaggacgaaagcga

SEQ ID NO: 2840 - DNA, 18 bp, Artificial sequence
  synthetic polynucleotide sequence
ccgacatcaggatgccga

SEQ ID NO: 2841 - DNA, 18 bp, Artificial sequence
  synthetic polynucleotide sequence
gcagctggccaagcggaa

SEQ ID NO: 2842 - DNA, 18 bp, Artificial sequence
  synthetic polynucleotide sequence
agcacagccagtagccca

SEQ ID NO: 2843 - DNA, 18 bp, Artificial sequence
  synthetic polynucleotide sequence
ccagtcaagcggaccaca

SEQ ID NO: 2844 - DNA, 18 bp, Artificial sequence
  synthetic polynucleotide sequence
gctgcaatagccgtacca

SEQ ID NO: 2845 - DNA, 18 bp, Artificial sequence
  synthetic polynucleotide sequence
ctccgagcagatggacca

SEQ ID NO: 2846 - DNA, 18 bp, Artificial sequence
  synthetic polynucleotide sequence
gacccggaagcttgagca

SEQ ID NO: 2847 - DNA, 18 bp, Artificial sequence
  synthetic polynucleotide sequence
cagcatcgctcgcaacca

SEQ ID NO: 2848 - DNA, 18 bp, Artificial sequence
  synthetic polynucleotide sequence
accacaccgtgtcaggga

SEQ ID NO: 2849 - DNA, 18 bp, Artificial sequence
  synthetic polynucleotide sequence
caagcgccaattgggcca

SEQ ID NO: 2850 - DNA, 18 bp, Artificial sequence
  synthetic polynucleotide sequence
gagcagctgctggagaca

SEQ ID NO: 2851 - DNA, 18 bp, Artificial sequence
  synthetic polynucleotide sequence
aaagtgccatcgagggca

SEQ ID NO: 2852 - DNA, 18 bp, Artificial sequence
  synthetic polynucleotide sequence
acacggctagggttccga

SEQ ID NO: 2853 - DNA, 18 bp, Artificial sequence
  synthetic polynucleotide sequence
tgcaccacgtagccacca

SEQ ID NO: 2854 - DNA, 18 bp, Artificial sequence
  synthetic polynucleotide sequence
tgaccagggccatggaga

SEQ ID NO: 2855 - DNA, 18 bp, Artificial sequence
  synthetic polynucleotide sequence
gaggaggacagatgggca

SEQ ID NO: 2856 - DNA, 18 bp, Artificial sequence
  synthetic polynucleotide sequence
cagcatcctcagaccgca

SEQ ID NO: 2857 - DNA, 18 bp, Artificial sequence
  synthetic polynucleotide sequence
cgtccgtggtcaaggaca

SEQ ID NO: 2858 - DNA, 18 bp, Artificial sequence
  synthetic polynucleotide sequence
tccaggggctgctgagga

SEQ ID NO: 2859 - DNA, 18 bp, Artificial sequence
  synthetic polynucleotide sequence
ctgccaggacgaaagcga

SEQ ID NO: 2860 - DNA, 18 bp, Artificial sequence
  synthetic polynucleotide sequence
tggacacggcctccacga

SEQ ID NO: 2861 - DNA, 18 bp, Artificial sequence
  synthetic polynucleotide sequence
cggtgccacactgggcca

SEQ ID NO: 2862 - DNA, 18 bp, Artificial sequence
  synthetic polynucleotide sequence
gtggtgcgggctgaggca

SEQ ID NO: 2863 - DNA, 18 bp, Artificial sequence
  synthetic polynucleotide sequence
cgatgcgctgaaggagga

SEQ ID NO: 2864 - DNA, 18 bp, Artificial sequence
  synthetic polynucleotide sequence
ggtacgtggcgtccagga

SEQ ID NO: 2865 - DNA, 18 bp, Artificial sequence
  synthetic polynucleotide sequence
actggaagtacgtcgcca

SEQ ID NO: 2866 - DNA, 18 bp, Artificial sequence
  synthetic polynucleotide sequence
ggaagagaggctgcagga

SEQ ID NO: 2867 - DNA, 18 bp, Artificial sequence
  synthetic polynucleotide sequence
cccagcaagctctgagca

SEQ ID NO: 2868 - DNA, 18 bp, Artificial sequence
  synthetic polynucleotide sequence
ccatgacaggcgtcacca

SEQ ID NO: 2869 - DNA, 18 bp, Artificial sequence
  synthetic polynucleotide sequence
tgccccagctgctgagga

SEQ ID NO: 2870 - DNA, 18 bp, Artificial sequence
  synthetic polynucleotide sequence
gatcgaccatcccgagga

SEQ ID NO: 2871 - DNA, 18 bp, Artificial sequence
  synthetic polynucleotide sequence
tgggcatcccgctggaca

SEQ ID NO: 2872 - DNA, 18 bp, Artificial sequence
  synthetic polynucleotide sequence
tgtcgtaggagaggcgga

SEQ ID NO: 2873 - DNA, 18 bp, Artificial sequence
  synthetic polynucleotide sequence
cgactatccctccgggca

SEQ ID NO: 2874 - DNA, 18 bp, Artificial sequence
  synthetic polynucleotide sequence
gggcatacaggcgtcgga

SEQ ID NO: 2875 - DNA, 18 bp, Artificial sequence
  synthetic polynucleotide sequence
tccgggagcccttcgaga

SEQ ID NO: 2876 - DNA, 18 bp, Artificial sequence
  synthetic polynucleotide sequence
accgcttgtggaaggaga

SEQ ID NO: 2877 - DNA, 18 bp, Artificial sequence
  synthetic polynucleotide sequence
actccaggtggaccggca

SEQ ID NO: 2878 - DNA, 18 bp, Artificial sequence
  synthetic polynucleotide sequence
ccagggggatcttggcga

SEQ ID NO: 2879 - DNA, 18 bp, Artificial sequence
  synthetic polynucleotide sequence
ctacgacgtcgtgggcaa

SEQ ID NO: 2880 - DNA, 18 bp, Artificial sequence
  synthetic polynucleotide sequence
aggggctgatgtcccgga

SEQ ID NO: 2881 - DNA, 18 bp, Artificial sequence
  synthetic polynucleotide sequence
ggccagctctgcaaagga

SEQ ID NO: 2882 - DNA, 18 bp, Artificial sequence
  synthetic polynucleotide sequence
tagaagaacgtccaggca

SEQ ID NO: 2883 - DNA, 18 bp, Artificial sequence
  synthetic polynucleotide sequence
ccgtcaagacactacgga

SEQ ID NO: 2884 - DNA, 18 bp, Artificial sequence
  synthetic polynucleotide sequence
cttggaggaggagcccga

SEQ ID NO: 2885 - DNA, 18 bp, Artificial sequence
  synthetic polynucleotide sequence
ccgcgacgtgctcaagca

SEQ ID NO: 2886 - DNA, 18 bp, Artificial sequence
  synthetic polynucleotide sequence
tgacgaagggcgtacaga

SEQ ID NO: 2887 - DNA, 18 bp, Artificial sequence
  synthetic polynucleotide sequence
gccaaagccagctggaga

SEQ ID NO: 2888 - DNA, 18 bp, Artificial sequence
  synthetic polynucleotide sequence
ccaggtcctcatagcgca

SEQ ID NO: 2889 - DNA, 18 bp, Artificial sequence
  synthetic polynucleotide sequence
cggggatcggcaagccaa

SEQ ID NO: 2890 - DNA, 18 bp, Artificial sequence
  synthetic polynucleotide sequence
tggtccgcagagtacaca

SEQ ID NO: 2891 - DNA, 18 bp, Artificial sequence
  synthetic polynucleotide sequence
cgtccaggaatgcgctca

SEQ ID NO: 2892 - DNA, 18 bp, Artificial sequence
  synthetic polynucleotide sequence
tcaggcctcgtggcagca

SEQ ID NO: 2893 - DNA, 18 bp, Artificial sequence
  synthetic polynucleotide sequence
acaccgcctgcgagcgca

SEQ ID NO: 2894 - DNA, 18 bp, Artificial sequence
  synthetic polynucleotide sequence
gcaacaggggcaccagca

SEQ ID NO: 2895 - DNA, 18 bp, Artificial sequence
  synthetic polynucleotide sequence
catggaggacgatgccaa

SEQ ID NO: 2896 - DNA, 18 bp, Artificial sequence
  synthetic polynucleotide sequence
cgaagtactggtgggcga

SEQ ID NO: 2897 - DNA, 18 bp, Artificial sequence
  synthetic polynucleotide sequence
caggaggatggtgccaca

SEQ ID NO: 2898 - DNA, 18 bp, Artificial sequence
  synthetic polynucleotide sequence
acacactgagtcccacca

SEQ ID NO: 2899 - DNA, 18 bp, Artificial sequence
  synthetic polynucleotide sequence
tcgaggctcgctacagca

SEQ ID NO: 2900 - DNA, 18 bp, Artificial sequence
  synthetic polynucleotide sequence
cagtcctgatccccagga

SEQ ID NO: 2901 - DNA, 18 bp, Artificial sequence
  synthetic polynucleotide sequence
ggaccgtgtgctcaagga

SEQ ID NO: 2902 - DNA, 18 bp, Artificial sequence
  synthetic polynucleotide sequence
cctacaagggaccgggca

SEQ ID NO: 2903 - DNA, 18 bp, Artificial sequence
  synthetic polynucleotide sequence
gggcagaacggctacaca

SEQ ID NO: 2904 - DNA, 18 bp, Artificial sequence
  synthetic polynucleotide sequence
gagtacgatgcagggcca

SEQ ID NO: 2905 - DNA, 18 bp, Artificial sequence
  synthetic polynucleotide sequence
cgccgaagaggtcgggaa

SEQ ID NO: 2906 - DNA, 18 bp, Artificial sequence
  synthetic polynucleotide sequence
gcaccggatgtcgtagga

SEQ ID NO: 2907 - DNA, 18 bp, Artificial sequence
  synthetic polynucleotide sequence
gcagcacgtggtacagga

SEQ ID NO: 2908 - DNA, 18 bp, Artificial sequence
  synthetic polynucleotide sequence
cacagctgagtcccacga

SEQ ID NO: 2909 - DNA, 18 bp, Artificial sequence
  synthetic polynucleotide sequence
tggtgggcaacctggaga

SEQ ID NO: 2910 - DNA, 18 bp, Artificial sequence
  synthetic polynucleotide sequence
aggccctagggttggaca

SEQ ID NO: 2911 - DNA, 18 bp, Artificial sequence
  synthetic polynucleotide sequence
gtcactgaccagagccca

SEQ ID NO: 2912 - DNA, 18 bp, Artificial sequence
  synthetic polynucleotide sequence
ggagaagccgtcagagga

SEQ ID NO: 2913 - DNA, 18 bp, Artificial sequence
  synthetic polynucleotide sequence
tatgaagccccaccagga

SEQ ID NO: 2914 - DNA, 18 bp, Artificial sequence
  synthetic polynucleotide sequence
gccatcagtgggaaccga

SEQ ID NO: 2915 - DNA, 18 bp, Artificial sequence
  synthetic polynucleotide sequence
gtcatccggaggcgcaca

SEQ ID NO: 2916 - DNA, 18 bp, Artificial sequence
  synthetic polynucleotide sequence
ggtggtgggagctgagca

SEQ ID NO: 2917 - DNA, 18 bp, Artificial sequence
  synthetic polynucleotide sequence
gccccaccaatgtacgca

SEQ ID NO: 2918 - DNA, 18 bp, Artificial sequence
  synthetic polynucleotide sequence
ggtatcagcagtgcagga

SEQ ID NO: 2919 - DNA, 18 bp, Artificial sequence
  synthetic polynucleotide sequence
ggatgaaggtgcccagga

SEQ ID NO: 2920 - DNA, 18 bp, Artificial sequence
  synthetic polynucleotide sequence
gcgagttcggaagcacca

SEQ ID NO: 2921 - DNA, 18 bp, Artificial sequence
  synthetic polynucleotide sequence
ccggggactgtgaacgga

SEQ ID NO: 2922 - DNA, 18 bp, Artificial sequence
  synthetic polynucleotide sequence
gggacccatgaactggga

SEQ ID NO: 2923 - DNA, 18 bp, Artificial sequence
  synthetic polynucleotide sequence
cagtcaggaccaagccca

SEQ ID NO: 2924 - DNA, 18 bp, Artificial sequence
  synthetic polynucleotide sequence
ccacagcagtcctgagca

SEQ ID NO: 2925 - DNA, 18 bp, Artificial sequence
  synthetic polynucleotide sequence
agggaccagctgaggaca

SEQ ID NO: 2926 - DNA, 18 bp, Artificial sequence
  synthetic polynucleotide sequence
ggaattctcggcggacca

SEQ ID NO: 2927 - DNA, 18 bp, Artificial sequence
  synthetic polynucleotide sequence
gcacaggcggtgtggaca

SEQ ID NO: 2928 - DNA, 18 bp, Artificial sequence
  synthetic polynucleotide sequence
tcactccgtccaccacca

SEQ ID NO: 2929 - DNA, 18 bp, Artificial sequence
  synthetic polynucleotide sequence
gtgtgaaaggccacgtga

SEQ ID NO: 2930 - DNA, 18 bp, Artificial sequence
  synthetic polynucleotide sequence
tggtaaggaccgctggga

SEQ ID NO: 2931 - DNA, 18 bp, Artificial sequence
  synthetic polynucleotide sequence
acaggtggcgtggacaca

SEQ ID NO: 2932 - DNA, 18 bp, Artificial sequence
  synthetic polynucleotide sequence
gcttcacaccatccacca

SEQ ID NO: 2933 - DNA, 18 bp, Artificial sequence
  synthetic polynucleotide sequence
aagcgtggtactggagga

SEQ ID NO: 2934 - DNA, 18 bp, Artificial sequence
  synthetic polynucleotide sequence
cgatgaccagttgcacca

SEQ ID NO: 2935 - DNA, 18 bp, Artificial sequence
  synthetic polynucleotide sequence
actcgagcagagcgacga

SEQ ID NO: 2936 - DNA, 18 bp, Artificial sequence
  synthetic polynucleotide sequence
tgcagtcagcaacgggga

SEQ ID NO: 2937 - DNA, 18 bp, Artificial sequence
  synthetic polynucleotide sequence
ggatcccaaagctcagca

SEQ ID NO: 2938 - DNA, 18 bp, Artificial sequence
  synthetic polynucleotide sequence
gcggcagtgtccacacca

SEQ ID NO: 2939 - DNA, 18 bp, Artificial sequence
  synthetic polynucleotide sequence
gctggtccctaaaaccca

SEQ ID NO: 2940 - DNA, 18 bp, Artificial sequence
  synthetic polynucleotide sequence
cggaacagcaagatgtga

SEQ ID NO: 2941 - DNA, 18 bp, Artificial sequence
  synthetic polynucleotide sequence
agccgagaccttgaggaa

SEQ ID NO: 2942 - DNA, 18 bp, Artificial sequence
  synthetic polynucleotide sequence
tcatactcagcagcacca

SEQ ID NO: 2943 - DNA, 18 bp, Artificial sequence
  synthetic polynucleotide sequence
gagcaggaggtgatgcta

SEQ ID NO: 2944 - DNA, 18 bp, Artificial sequence
  synthetic polynucleotide sequence
tcgagagcgtggagagga

SEQ ID NO: 2945 - DNA, 18 bp, Artificial sequence
  synthetic polynucleotide sequence
gtgacaatcaaagggcga

SEQ ID NO: 2946 - DNA, 18 bp, Artificial sequence
  synthetic polynucleotide sequence
atgaccacacgacgacca

SEQ ID NO: 2947 - DNA, 18 bp, Artificial sequence
  synthetic polynucleotide sequence
gcaccgtgggaaaggaca

SEQ ID NO: 2948 - DNA, 18 bp, Artificial sequence
  synthetic polynucleotide sequence
agcattggacgcacggga

SEQ ID NO: 2949 - DNA, 18 bp, Artificial sequence
  synthetic polynucleotide sequence
cataagcaccccagccca

SEQ ID NO: 2950 - DNA, 18 bp, Artificial sequence
  synthetic polynucleotide sequence
ggccagctggaactccca

SEQ ID NO: 2951 - DNA, 18 bp, Artificial sequence
  synthetic polynucleotide sequence
ggattgaccccacagaca

SEQ ID NO: 2952 - DNA, 18 bp, Artificial sequence
  synthetic polynucleotide sequence
gcacatgacaagtcagga

SEQ ID NO: 2953 - DNA, 18 bp, Artificial sequence
  synthetic polynucleotide sequence
tcaaccgtcaggctgcca

SEQ ID NO: 2954 - DNA, 18 bp, Artificial sequence
  synthetic polynucleotide sequence
ccttggccgagcgccaca

SEQ ID NO: 2955 - DNA, 18 bp, Artificial sequence
  synthetic polynucleotide sequence
ggcactgcacaggaccaa

SEQ ID NO: 2956 - DNA, 18 bp, Artificial sequence
  synthetic polynucleotide sequence
cccccaacaatgccacca

SEQ ID NO: 2957 - DNA, 18 bp, Artificial sequence
  synthetic polynucleotide sequence
ctgatcgtccagcaggca

SEQ ID NO: 2958 - DNA, 18 bp, Artificial sequence
  synthetic polynucleotide sequence
gcaagctgctccaccgca

SEQ ID NO: 2959 - DNA, 18 bp, Artificial sequence
  synthetic polynucleotide sequence
gaacgccagacagaggca

SEQ ID NO: 2960 - DNA, 18 bp, Artificial sequence
  synthetic polynucleotide sequence
acgggctgaggttcagga

SEQ ID NO: 2961 - DNA, 18 bp, Artificial sequence
  synthetic polynucleotide sequence
gaagcgaaagaccaccca

SEQ ID NO: 2962 - DNA, 18 bp, Artificial sequence
  synthetic polynucleotide sequence
cagccggtctgtcaggca

SEQ ID NO: 2963 - DNA, 18 bp, Artificial sequence
  synthetic polynucleotide sequence
ccacactggccaaggaca

SEQ ID NO: 2964 - DNA, 18 bp, Artificial sequence
  synthetic polynucleotide sequence
gcacgatgcctaccagga

SEQ ID NO: 2965 - DNA, 18 bp, Artificial sequence
  synthetic polynucleotide sequence
cctgcgtgtcgcagagca

SEQ ID NO: 2966 - DNA, 18 bp, Artificial sequence
  synthetic polynucleotide sequence
atgccaacggtggccaca

SEQ ID NO: 2967 - DNA, 18 bp, Artificial sequence
  synthetic polynucleotide sequence
cccaccgtgagaccacca

SEQ ID NO: 2968 - DNA, 18 bp, Artificial sequence
  synthetic polynucleotide sequence
ggatgacacagccaccca

SEQ ID NO: 2969 - DNA, 18 bp, Artificial sequence
  synthetic polynucleotide sequence
gcatctaccagtgccaga

SEQ ID NO: 2970 - DNA, 18 bp, Artificial sequence
  synthetic polynucleotide sequence
agacggccaccatgcaca

SEQ ID NO: 2971 - DNA, 18 bp, Artificial sequence
  synthetic polynucleotide sequence
ccccggaaccaagtacga

SEQ ID NO: 2972 - DNA, 18 bp, Artificial sequence
  synthetic polynucleotide sequence
gtcctcgtcagagccgca

SEQ ID NO: 2973 - DNA, 18 bp, Artificial sequence
  synthetic polynucleotide sequence
gccacttaagtggggcca

SEQ ID NO: 2974 - DNA, 18 bp, Artificial sequence
  synthetic polynucleotide sequence
tgacgcattcccaccaga

SEQ ID NO: 2975 - DNA, 18 bp, Artificial sequence
  synthetic polynucleotide sequence
ccctgaaatgcatccgca

SEQ ID NO: 2976 - DNA, 18 bp, Artificial sequence
  synthetic polynucleotide sequence
cccacgaacagagccgca

SEQ ID NO: 2977 - DNA, 18 bp, Artificial sequence
  synthetic polynucleotide sequence
caccctggtgacccagga

SEQ ID NO: 2978 - DNA, 18 bp, Artificial sequence
  synthetic polynucleotide sequence
ctccgggcatgtgcagca

SEQ ID NO: 2979 - DNA, 18 bp, Artificial sequence
  synthetic polynucleotide sequence
ccaaggccaagatcacca

SEQ ID NO: 2980 - DNA, 18 bp, Artificial sequence
  synthetic polynucleotide sequence
tctgcgcctcgggcacca

SEQ ID NO: 2981 - DNA, 18 bp, Artificial sequence
  synthetic polynucleotide sequence
tggaggatgaaagcgcca

SEQ ID NO: 2982 - DNA, 18 bp, Artificial sequence
  synthetic polynucleotide sequence
tgtgggccgtccaggaca

SEQ ID NO: 2983 - DNA, 18 bp, Artificial sequence
  synthetic polynucleotide sequence
cgtgtggccctcacggga

SEQ ID NO: 2984 - DNA, 18 bp, Artificial sequence
  synthetic polynucleotide sequence
tgtacagcgctgcgccca

SEQ ID NO: 2985 - DNA, 18 bp, Artificial sequence
  synthetic polynucleotide sequence
caggacctgcaggctgca

SEQ ID NO: 2986 - DNA, 18 bp, Artificial sequence
  synthetic polynucleotide sequence
tcccagaggtgagcacca

SEQ ID NO: 2987 - DNA, 18 bp, Artificial sequence
  synthetic polynucleotide sequence
tagccatgggtggaggca

SEQ ID NO: 2988 - DNA, 18 bp, Artificial sequence
  synthetic polynucleotide sequence
agagcggggtacacggta

SEQ ID NO: 2989 - DNA, 18 bp, Artificial sequence
  synthetic polynucleotide sequence
aggcagccagaggactga

SEQ ID NO: 2990 - DNA, 18 bp, Artificial sequence
  synthetic polynucleotide sequence
gcaccaccatgcccgtga

SEQ ID NO: 2991 - DNA, 18 bp, Artificial sequence
  synthetic polynucleotide sequence
gcacgccatcatccagga

SEQ ID NO: 2992 - DNA, 18 bp, Artificial sequence
  synthetic polynucleotide sequence
atggagtagcccagccga

SEQ ID NO: 2993 - DNA, 18 bp, Artificial sequence
  synthetic polynucleotide sequence
ccaccattgccacgggca

SEQ ID NO: 2994 - DNA, 18 bp, Artificial sequence
  synthetic polynucleotide sequence
tgaagagagcagaagcca

SEQ ID NO: 2995 - DNA, 18 bp, Artificial sequence
  synthetic polynucleotide sequence
gaaggcacacctaggcca

SEQ ID NO: 2996 - DNA, 18 bp, Artificial sequence
  synthetic polynucleotide sequence
cagcctcggcccaggaca

SEQ ID NO: 2997 - DNA, 18 bp, Artificial sequence
  synthetic polynucleotide sequence
cgtggtcgagctgaccca

SEQ ID NO: 2998 - DNA, 18 bp, Artificial sequence
  synthetic polynucleotide sequence
agcttcgaagtcgcgcga

SEQ ID NO: 2999 - DNA, 18 bp, Artificial sequence
  synthetic polynucleotide sequence
ctccacctccactcagca

SEQ ID NO: 3000 - DNA, 18 bp, Artificial sequence
  synthetic polynucleotide sequence
cgagctggtgcctccaga

SEQ ID NO: 3001 - DNA, 18 bp, Artificial sequence
  synthetic polynucleotide sequence
cctgaggatcgacggaga

SEQ ID NO: 3002 - DNA, 18 bp, Artificial sequence
  synthetic polynucleotide sequence
ccagatagaaggcgagga

SEQ ID NO: 3003 - DNA, 18 bp, Artificial sequence
  synthetic polynucleotide sequence
ccccggaggcaactggga

SEQ ID NO: 3004 - DNA, 18 bp, Artificial sequence
  synthetic polynucleotide sequence
gccagggggacagtggca

SEQ ID NO: 3005 - DNA, 18 bp, Artificial sequence
  synthetic polynucleotide sequence
ctgtgaggtccccaggaa

SEQ ID NO: 3006 - DNA, 19 bp, Artificial sequence
  synthetic polynucleotide sequence
ccgtagccgatgtcacaga

SEQ ID NO: 3007 - DNA, 18 bp, Artificial sequence
  synthetic polynucleotide sequence
cctgtgacacaaactgga

SEQ ID NO: 3008 - DNA, 18 bp, Artificial sequence
  synthetic polynucleotide sequence
gcgagataatccgaccca

SEQ ID NO: 3009 - DNA, 18 bp, Artificial sequence
  synthetic polynucleotide sequence
catgcccagaaagctgga

SEQ ID NO: 3010 - DNA, 18 bp, Artificial sequence
  synthetic polynucleotide sequence
acctgagcaagatcagca

SEQ ID NO: 3011 - DNA, 18 bp, Artificial sequence
  synthetic polynucleotide sequence
cagctcagggcaagtgga

SEQ ID NO: 3012 - DNA, 18 bp, Artificial sequence
  synthetic polynucleotide sequence
agggatggtgaactcgca

SEQ ID NO: 3013 - DNA, 18 bp, Artificial sequence
  synthetic polynucleotide sequence
gatcaccgcgcaacccga

SEQ ID NO: 3014 - DNA, 18 bp, Artificial sequence
  synthetic polynucleotide sequence
actggcagatgtagggca

SEQ ID NO: 3015 - DNA, 18 bp, Artificial sequence
  synthetic polynucleotide sequence
tgagcccagtgatcccaa

SEQ ID NO: 3016 - DNA, 18 bp, Artificial sequence
  synthetic polynucleotide sequence
cctttgaggaccaagaca

SEQ ID NO: 3017 - DNA, 19 bp, Artificial sequence
  synthetic polynucleotide sequence
acaccagggaagaacagga

SEQ ID NO: 3018 - DNA, 19 bp, Artificial sequence
  synthetic polynucleotide sequence
atcgcacaacgctcatcaa

SEQ ID NO: 3019 - DNA, 20 bp, Artificial sequence
  synthetic polynucleotide sequence
cacaatgcacagagagagga

SEQ ID NO: 3020 - DNA, 21 bp, Artificial sequence
  synthetic polynucleotide sequence
gatgcgaaatgtcacaacaca

SEQ ID NO: 3021 - DNA, 18 bp, Artificial sequence
  synthetic polynucleotide sequence
acacgccagagaaactga

SEQ ID NO: 3022 - DNA, 18 bp, Artificial sequence
  synthetic polynucleotide sequence
taggccaatggtcgcaca

SEQ ID NO: 3023 - DNA, 18 bp, Artificial sequence
  synthetic polynucleotide sequence
ggggctttcagacccaca

SEQ ID NO: 3024 - DNA, 18 bp, Artificial sequence
  synthetic polynucleotide sequence
aacatcattccagcccca

SEQ ID NO: 3025 - DNA, 18 bp, Artificial sequence
  synthetic polynucleotide sequence
gctacccaagaaaaccca

SEQ ID NO: 3026 - DNA, 18 bp, Artificial sequence
  synthetic polynucleotide sequence
atgagggcacactacaca

SEQ ID NO: 3027 - DNA, 18 bp, Artificial sequence
  synthetic polynucleotide sequence
ctggaatgaagacacgga

SEQ ID NO: 3028 - DNA, 18 bp, Artificial sequence
  synthetic polynucleotide sequence
tcaccacacccaatccga

SEQ ID NO: 3029 - DNA, 18 bp, Artificial sequence
  synthetic polynucleotide sequence
cttagccccaggtaccaa

SEQ ID NO: 3030 - DNA, 18 bp, Artificial sequence
  synthetic polynucleotide sequence
aagaggttacagcccaca

SEQ ID NO: 3031 - DNA, 18 bp, Artificial sequence
  synthetic polynucleotide sequence
agacagacacgctgcaga

SEQ ID NO: 3032 - DNA, 18 bp, Artificial sequence
  synthetic polynucleotide sequence
agctgtccagcctggcga

SEQ ID NO: 3033 - DNA, 18 bp, Artificial sequence
  synthetic polynucleotide sequence
cagccaaagccaaggcca

SEQ ID NO: 3034 - DNA, 18 bp, Artificial sequence
  synthetic polynucleotide sequence
cctggcgtaacgggagga

SEQ ID NO: 3035 - DNA, 18 bp, Artificial sequence
  synthetic polynucleotide sequence
tggaggcagagctggaga

SEQ ID NO: 3036 - DNA, 18 bp, Artificial sequence
  synthetic polynucleotide sequence
gacgattggcctccagca

SEQ ID NO: 3037 - DNA, 18 bp, Artificial sequence
  synthetic polynucleotide sequence
ggaggtagacacggcaca

SEQ ID NO: 3038 - DNA, 18 bp, Artificial sequence
  synthetic polynucleotide sequence
actgggataggtgagcca

SEQ ID NO: 3039 - DNA, 18 bp, Artificial sequence
  synthetic polynucleotide sequence
tggtcaccgagggccaga

SEQ ID NO: 3040 - DNA, 18 bp, Artificial sequence
  synthetic polynucleotide sequence
acagccaggcgacccaga

SEQ ID NO: 3041 - DNA, 18 bp, Artificial sequence
  synthetic polynucleotide sequence
gggacggcctggtcagca

SEQ ID NO: 3042 - DNA, 18 bp, Artificial sequence
  synthetic polynucleotide sequence
aagttccagtccaccgga

SEQ ID NO: 3043 - DNA, 18 bp, Artificial sequence
  synthetic polynucleotide sequence
gcagcagccagacactga

SEQ ID NO: 3044 - DNA, 18 bp, Artificial sequence
  synthetic polynucleotide sequence
caagacaggcggctctca

SEQ ID NO: 3045 - DNA, 18 bp, Artificial sequence
  synthetic polynucleotide sequence
ctgacccagccaccgcaa

SEQ ID NO: 3046 - DNA, 18 bp, Artificial sequence
  synthetic polynucleotide sequence
gggtcgggcaagctgtca

SEQ ID NO: 3047 - DNA, 18 bp, Artificial sequence
  synthetic polynucleotide sequence
aagttggggcacccacca

SEQ ID NO: 3048 - DNA, 18 bp, Artificial sequence
  synthetic polynucleotide sequence
tctcgcccaggagtgaca

SEQ ID NO: 3049 - DNA, 18 bp, Artificial sequence
  synthetic polynucleotide sequence
cggtggaggactcagaca

SEQ ID NO: 3050 - DNA, 18 bp, Artificial sequence
  synthetic polynucleotide sequence
cgatgatctccagacgca

SEQ ID NO: 3051 - DNA, 18 bp, Artificial sequence
  synthetic polynucleotide sequence
ggccagcgagaacagcga

SEQ ID NO: 3052 - DNA, 18 bp, Artificial sequence
  synthetic polynucleotide sequence
gcgtcatggcagatgcca

SEQ ID NO: 3053 - DNA, 18 bp, Artificial sequence
  synthetic polynucleotide sequence
gaatcatcagcaggagga

SEQ ID NO: 3054 - DNA, 18 bp, Artificial sequence
  synthetic polynucleotide sequence
tgcaatggaaccaccaca

SEQ ID NO: 3055 - DNA, 18 bp, Artificial sequence
  synthetic polynucleotide sequence
ggtggaggaaggagcgaa

SEQ ID NO: 3056 - DNA, 18 bp, Artificial sequence
  synthetic polynucleotide sequence
accatagggcgactggca

SEQ ID NO: 3057 - DNA, 18 bp, Artificial sequence
  synthetic polynucleotide sequence
gcagctctgaactgggca

SEQ ID NO: 3058 - DNA, 18 bp, Artificial sequence
  synthetic polynucleotide sequence
gccagttccgatagcgca

SEQ ID NO: 3059 - DNA, 18 bp, Artificial sequence
  synthetic polynucleotide sequence
ctggtgtgagagccgaga

SEQ ID NO: 3060 - DNA, 18 bp, Artificial sequence
  synthetic polynucleotide sequence
aggcggcagttgtgcaca

SEQ ID NO: 3061 - DNA, 18 bp, Artificial sequence
  synthetic polynucleotide sequence
ctggacacagcctagcca

SEQ ID NO: 3062 - DNA, 18 bp, Artificial sequence
  synthetic polynucleotide sequence
ccaggacgaccatgagca

SEQ ID NO: 3063 - DNA, 18 bp, Artificial sequence
  synthetic polynucleotide sequence
gtcgtccccaggcactga

SEQ ID NO: 3064 - DNA, 18 bp, Artificial sequence
  synthetic polynucleotide sequence
agatgaggactgagcgca

SEQ ID NO: 3065 - DNA, 19 bp, Artificial sequence
  synthetic polynucleotide sequence
gaaactgcatggaggcaca

SEQ ID NO: 3066 - DNA, 18 bp, Artificial sequence
  synthetic polynucleotide sequence
tggggagggacggcaaca

SEQ ID NO: 3067 - DNA, 18 bp, Artificial sequence
  synthetic polynucleotide sequence
cgctgttacgaggaggga

SEQ ID NO: 3068 - DNA, 18 bp, Artificial sequence
  synthetic polynucleotide sequence
acagctgtgcgaagcgga

SEQ ID NO: 3069 - DNA, 18 bp, Artificial sequence
  synthetic polynucleotide sequence
catacgagaaggcgacga

SEQ ID NO: 3070 - DNA, 18 bp, Artificial sequence
  synthetic polynucleotide sequence
aggaggaggtgttgagca

SEQ ID NO: 3071 - DNA, 18 bp, Artificial sequence
  synthetic polynucleotide sequence
aaagctcctgaccacgga

SEQ ID NO: 3072 - DNA, 18 bp, Artificial sequence
  synthetic polynucleotide sequence
ggtcaagttccccacaca

SEQ ID NO: 3073 - DNA, 18 bp, Artificial sequence
  synthetic polynucleotide sequence
aggcagatgatcccggca

SEQ ID NO: 3074 - DNA, 18 bp, Artificial sequence
  synthetic polynucleotide sequence
aatgacagcaggatggca

SEQ ID NO: 3075 - DNA, 18 bp, Artificial sequence
  synthetic polynucleotide sequence
gagactcatggatcccca

SEQ ID NO: 3076 - DNA, 18 bp, Artificial sequence
  synthetic polynucleotide sequence
ccctgggccaccccagca

SEQ ID NO: 3077 - DNA, 18 bp, Artificial sequence
  synthetic polynucleotide sequence
cagttgcccaataccaga

SEQ ID NO: 3078 - DNA, 18 bp, Artificial sequence
  synthetic polynucleotide sequence
caccccagcagaatccca

SEQ ID NO: 3079 - DNA, 18 bp, Artificial sequence
  synthetic polynucleotide sequence
acagctgcatgaacccca

SEQ ID NO: 3080 - DNA, 18 bp, Artificial sequence
  synthetic polynucleotide sequence
agagcattgaccaggcga

SEQ ID NO: 3081 - DNA, 18 bp, Artificial sequence
  synthetic polynucleotide sequence
gaccagggaagaagcaga

SEQ ID NO: 3082 - DNA, 18 bp, Artificial sequence
  synthetic polynucleotide sequence
aggggctggcatcaacca

SEQ ID NO: 3083 - DNA, 18 bp, Artificial sequence
  synthetic polynucleotide sequence
cgtcagagtggctaccca

SEQ ID NO: 3084 - DNA, 18 bp, Artificial sequence
  synthetic polynucleotide sequence
cttcctccgggaaggaca

SEQ ID NO: 3085 - DNA, 18 bp, Artificial sequence
  synthetic polynucleotide sequence
aagagagagcgagagcaa

SEQ ID NO: 3086 - DNA, 18 bp, Artificial sequence
  synthetic polynucleotide sequence
gcatggtcgcagtcacga

SEQ ID NO: 3087 - DNA, 18 bp, Artificial sequence
  synthetic polynucleotide sequence
cccagtatctcgcagcaa

SEQ ID NO: 3088 - DNA, 18 bp, Artificial sequence
  synthetic polynucleotide sequence
ccagcggaattagcacca

SEQ ID NO: 3089 - DNA, 18 bp, Artificial sequence
  synthetic polynucleotide sequence
gccagacttgaccaggga

SEQ ID NO: 3090 - DNA, 18 bp, Artificial sequence
  synthetic polynucleotide sequence
ctgaccccacaggcagca

SEQ ID NO: 3091 - DNA, 18 bp, Artificial sequence
  synthetic polynucleotide sequence
ggcgcatgctgagaagca

SEQ ID NO: 3092 - DNA, 18 bp, Artificial sequence
  synthetic polynucleotide sequence
cctgtcatagcgagggca

SEQ ID NO: 3093 - DNA, 18 bp, Artificial sequence
  synthetic polynucleotide sequence
caagaaccccatcgacca

SEQ ID NO: 3094 - DNA, 18 bp, Artificial sequence
  synthetic polynucleotide sequence
catctgcaggacggtgga

SEQ ID NO: 3095 - DNA, 18 bp, Artificial sequence
  synthetic polynucleotide sequence
cgaccatcagcctccaga

SEQ ID NO: 3096 - DNA, 18 bp, Artificial sequence
  synthetic polynucleotide sequence
cgccctgcgtgtagccca

SEQ ID NO: 3097 - DNA, 18 bp, Artificial sequence
  synthetic polynucleotide sequence
ccggtggacaactcgaca

SEQ ID NO: 3098 - DNA, 18 bp, Artificial sequence
  synthetic polynucleotide sequence
acttgccgcccaagccca

SEQ ID NO: 3099 - DNA, 18 bp, Artificial sequence
  synthetic polynucleotide sequence
ctcggcagcagtaccaga

SEQ ID NO: 3100 - DNA, 18 bp, Artificial sequence
  synthetic polynucleotide sequence
tctcgtccaccacaggca

SEQ ID NO: 3101 - DNA, 18 bp, Artificial sequence
  synthetic polynucleotide sequence
gcccagcccatgaagcaa

SEQ ID NO: 3102 - DNA, 18 bp, Artificial sequence
  synthetic polynucleotide sequence
cgcagcagaaggtcagca

SEQ ID NO: 3103 - DNA, 18 bp, Artificial sequence
  synthetic polynucleotide sequence
cactcagttaccgagcca

SEQ ID NO: 3104 - DNA, 18 bp, Artificial sequence
  synthetic polynucleotide sequence
ggagatggaggcgtgtga

SEQ ID NO: 3105 - DNA, 18 bp, Artificial sequence
  synthetic polynucleotide sequence
aacgctgcacctgaccga

SEQ ID NO: 3106 - DNA, 18 bp, Artificial sequence
  synthetic polynucleotide sequence
agtcagaggggtgaggca

SEQ ID NO: 3107 - DNA, 18 bp, Artificial sequence
  synthetic polynucleotide sequence
accacacagcaaacccca

SEQ ID NO: 3108 - DNA, 18 bp, Artificial sequence
  synthetic polynucleotide sequence
tgtgagggcctgaaggga

SEQ ID NO: 3109 - DNA, 18 bp, Artificial sequence
  synthetic polynucleotide sequence
agctgaacaccttaggca

SEQ ID NO: 3110 - DNA, 18 bp, Artificial sequence
  synthetic polynucleotide sequence
aaggcagtaagagctcca

SEQ ID NO: 3111 - DNA, 18 bp, Artificial sequence
  synthetic polynucleotide sequence
aggccttcacgctgacca

SEQ ID NO: 3112 - DNA, 18 bp, Artificial sequence
  synthetic polynucleotide sequence
cgtcagctgcacagccga

SEQ ID NO: 3113 - DNA, 18 bp, Artificial sequence
  synthetic polynucleotide sequence
atgtgaccggatgaagga

SEQ ID NO: 3114 - DNA, 18 bp, Artificial sequence
  synthetic polynucleotide sequence
gcccactacacgtacgta

SEQ ID NO: 3115 - DNA, 18 bp, Artificial sequence
  synthetic polynucleotide sequence
gcctgcacaaggagagga

SEQ ID NO: 3116 - DNA, 18 bp, Artificial sequence
  synthetic polynucleotide sequence
aactcttccaccagcaca

SEQ ID NO: 3117 - DNA, 18 bp, Artificial sequence
  synthetic polynucleotide sequence
gttgaaggaggaggacga

SEQ ID NO: 3118 - DNA, 18 bp, Artificial sequence
  synthetic polynucleotide sequence
gcacctgccccagctcca

SEQ ID NO: 3119 - DNA, 18 bp, Artificial sequence
  synthetic polynucleotide sequence
ctggaaggctcacagcca

SEQ ID NO: 3120 - DNA, 18 bp, Artificial sequence
  synthetic polynucleotide sequence
tgcaagcagagggcccca

SEQ ID NO: 3121 - DNA, 18 bp, Artificial sequence
  synthetic polynucleotide sequence
cgctcagtgaccaggtca

SEQ ID NO: 3122 - DNA, 18 bp, Artificial sequence
  synthetic polynucleotide sequence
caggcagtgatgggcaga

SEQ ID NO: 3123 - DNA, 18 bp, Artificial sequence
  synthetic polynucleotide sequence
aacggcaacccatccaga

SEQ ID NO: 3124 - DNA, 18 bp, Artificial sequence
  synthetic polynucleotide sequence
ggggcttccccactggca

SEQ ID NO: 3125 - DNA, 18 bp, Artificial sequence
  synthetic polynucleotide sequence
gcaatgaggctgatggga

SEQ ID NO: 3126 - DNA, 18 bp, Artificial sequence
  synthetic polynucleotide sequence
acgaaggtcatggatgga

SEQ ID NO: 3127 - DNA, 18 bp, Artificial sequence
  synthetic polynucleotide sequence
agaccacgaccagcacca

SEQ ID NO: 3128 - DNA, 18 bp, Artificial sequence
  synthetic polynucleotide sequence
tgatggggacgctgacca

SEQ ID NO: 3129 - DNA, 18 bp, Artificial sequence
  synthetic polynucleotide sequence
ccgcgtggtagcaaccaa

SEQ ID NO: 3130 - DNA, 18 bp, Artificial sequence
  synthetic polynucleotide sequence
acatctgaaggagccaca

SEQ ID NO: 3131 - DNA, 18 bp, Artificial sequence
  synthetic polynucleotide sequence
tcaggactcagcggagga

SEQ ID NO: 3132 - DNA, 18 bp, Artificial sequence
  synthetic polynucleotide sequence
aggacagcaggtagccga

SEQ ID NO: 3133 - DNA, 18 bp, Artificial sequence
  synthetic polynucleotide sequence
gggggtggaaaggaggaa

SEQ ID NO: 3134 - DNA, 18 bp, Artificial sequence
  synthetic polynucleotide sequence
cagccgtgtaataggcca

SEQ ID NO: 3135 - DNA, 18 bp, Artificial sequence
  synthetic polynucleotide sequence
gaggagatggcagcagca

SEQ ID NO: 3136 - DNA, 18 bp, Artificial sequence
  synthetic polynucleotide sequence
ttcgaagtggaagcccca

SEQ ID NO: 3137 - DNA, 18 bp, Artificial sequence
  synthetic polynucleotide sequence
gaacctcaactggcccca

SEQ ID NO: 3138 - DNA, 18 bp, Artificial sequence
  synthetic polynucleotide sequence
agacctcatagcccagca

SEQ ID NO: 3139 - DNA, 17 bp, Artificial sequence
  synthetic polynucleotide sequence
tgagccggccagtgcca

SEQ ID NO: 3140 - DNA, 17 bp, Artificial sequence
  synthetic polynucleotide sequence
cgggcacaggccgacca

SEQ ID NO: 3141 - DNA, 18 bp, Artificial sequence
  synthetic polynucleotide sequence
cctggagctctacagcca

SEQ ID NO: 3142 - DNA, 18 bp, Artificial sequence
  synthetic polynucleotide sequence
gctggtgcaatggcccga

SEQ ID NO: 3143 - DNA, 18 bp, Artificial sequence
  synthetic polynucleotide sequence
cctgcggcatcacagaca

SEQ ID NO: 3144 - DNA, 18 bp, Artificial sequence
  synthetic polynucleotide sequence
ggagaaggtgtcccacga

SEQ ID NO: 3145 - DNA, 18 bp, Artificial sequence
  synthetic polynucleotide sequence
agctggcccgagaggaga

SEQ ID NO: 3146 - DNA, 18 bp, Artificial sequence
  synthetic polynucleotide sequence
gccagccggcttcaagca

SEQ ID NO: 3147 - DNA, 18 bp, Artificial sequence
  synthetic polynucleotide sequence
gcggttcgtggacagcaa

SEQ ID NO: 3148 - DNA, 18 bp, Artificial sequence
  synthetic polynucleotide sequence
tggcgaaggggtcacaca

SEQ ID NO: 3149 - DNA, 18 bp, Artificial sequence
  synthetic polynucleotide sequence
gatgtccaaggccctgca

SEQ ID NO: 3150 - DNA, 18 bp, Artificial sequence
  synthetic polynucleotide sequence
ccagaggtgcccaagcca

SEQ ID NO: 3151 - DNA, 18 bp, Artificial sequence
  synthetic polynucleotide sequence
gacagccaagggtgacga

SEQ ID NO: 3152 - DNA, 18 bp, Artificial sequence
  synthetic polynucleotide sequence
gttcgctgcaccaggcga

SEQ ID NO: 3153 - DNA, 18 bp, Artificial sequence
  synthetic polynucleotide sequence
ggacaagcttcaggagca

SEQ ID NO: 3154 - DNA, 18 bp, Artificial sequence
  synthetic polynucleotide sequence
ggagggcacacaggctga

SEQ ID NO: 3155 - DNA, 18 bp, Artificial sequence
  synthetic polynucleotide sequence
cctagaccacagaccaca

SEQ ID NO: 3156 - DNA, 18 bp, Artificial sequence
  synthetic polynucleotide sequence
tgacgctccaagtaagga

SEQ ID NO: 3157 - DNA, 18 bp, Artificial sequence
  synthetic polynucleotide sequence
gcagagtcagacgaccaa

SEQ ID NO: 3158 - DNA, 18 bp, Artificial sequence
  synthetic polynucleotide sequence
tgagccagaacgcctcca

SEQ ID NO: 3159 - DNA, 18 bp, Artificial sequence
  synthetic polynucleotide sequence
tgggaccccaaggaccaa

SEQ ID NO: 3160 - DNA, 18 bp, Artificial sequence
  synthetic polynucleotide sequence
acagggcctgggagacca

SEQ ID NO: 3161 - DNA, 18 bp, Artificial sequence
  synthetic polynucleotide sequence
gcaggccaagatggacca

SEQ ID NO: 3162 - DNA, 18 bp, Artificial sequence
  synthetic polynucleotide sequence
ccaggtggacctaaggga

SEQ ID NO: 3163 - DNA, 18 bp, Artificial sequence
  synthetic polynucleotide sequence
ggctgccagacacagcaa

SEQ ID NO: 3164 - DNA, 18 bp, Artificial sequence
  synthetic polynucleotide sequence
tgaagcagacaggcccca

SEQ ID NO: 3165 - DNA, 18 bp, Artificial sequence
  synthetic polynucleotide sequence
gaagcccctacagagcca

SEQ ID NO: 3166 - DNA, 18 bp, Artificial sequence
  synthetic polynucleotide sequence
gtccccaatgctccagga

SEQ ID NO: 3167 - DNA, 18 bp, Artificial sequence
  synthetic polynucleotide sequence
ccaggcgttggaacccaa

SEQ ID NO: 3168 - DNA, 18 bp, Artificial sequence
  synthetic polynucleotide sequence
ccaggctggccagaagga

SEQ ID NO: 3169 - DNA, 18 bp, Artificial sequence
  synthetic polynucleotide sequence
ggcaggagcagaagcaga

SEQ ID NO: 3170 - DNA, 18 bp, Artificial sequence
  synthetic polynucleotide sequence
ctggaggacctctcagca

SEQ ID NO: 3171 - DNA, 18 bp, Artificial sequence
  synthetic polynucleotide sequence
tgcaggacagaagggcca

SEQ ID NO: 3172 - DNA, 18 bp, Artificial sequence
  synthetic polynucleotide sequence
acaggccccatggaacca

SEQ ID NO: 3173 - DNA, 18 bp, Artificial sequence
  synthetic polynucleotide sequence
ctcagagctggcaagcca

SEQ ID NO: 3174 - DNA, 18 bp, Artificial sequence
  synthetic polynucleotide sequence
tcatcccgctgcagcaca

SEQ ID NO: 3175 - DNA, 18 bp, Artificial sequence
  synthetic polynucleotide sequence
ggaccctcaggaaagcca

SEQ ID NO: 3176 - DNA, 18 bp, Artificial sequence
  synthetic polynucleotide sequence
gtggacccataggaccga

SEQ ID NO: 3177 - DNA, 18 bp, Artificial sequence
  synthetic polynucleotide sequence
ctggcaaagaaggcggca

SEQ ID NO: 3178 - DNA, 18 bp, Artificial sequence
  synthetic polynucleotide sequence
ccagcaggaccatcagca

SEQ ID NO: 3179 - DNA, 18 bp, Artificial sequence
  synthetic polynucleotide sequence
aggtcctagtggcccaca

SEQ ID NO: 3180 - DNA, 18 bp, Artificial sequence
  synthetic polynucleotide sequence
gaccagcgataccaggca

SEQ ID NO: 3181 - DNA, 18 bp, Artificial sequence
  synthetic polynucleotide sequence
ccctacctccagagcaca

SEQ ID NO: 3182 - DNA, 18 bp, Artificial sequence
  synthetic polynucleotide sequence
gcatccagcagaacccca

SEQ ID NO: 3183 - DNA, 18 bp, Artificial sequence
  synthetic polynucleotide sequence
ggcaaagcaggagagcca

SEQ ID NO: 3184 - DNA, 18 bp, Artificial sequence
  synthetic polynucleotide sequence
cctgaccaggaagcccca

SEQ ID NO: 3185 - DNA, 18 bp, Artificial sequence
  synthetic polynucleotide sequence
ggtcctaagggtgccaga

SEQ ID NO: 3186 - DNA, 18 bp, Artificial sequence
  synthetic polynucleotide sequence
ggttcacctcgaggccca

SEQ ID NO: 3187 - DNA, 18 bp, Artificial sequence
  synthetic polynucleotide sequence
tggaatgccgggtccaca

SEQ ID NO: 3188 - DNA, 18 bp, Artificial sequence
  synthetic polynucleotide sequence
cgtggaccagggaagcca

SEQ ID NO: 3189 - DNA, 18 bp, Artificial sequence
  synthetic polynucleotide sequence
gggcctggaatggacaga

SEQ ID NO: 3190 - DNA, 18 bp, Artificial sequence
  synthetic polynucleotide sequence
ctgatgaggcaggaggga

SEQ ID NO: 3191 - DNA, 18 bp, Artificial sequence
  synthetic polynucleotide sequence
tcagaaagcgtggggcca

SEQ ID NO: 3192 - DNA, 18 bp, Artificial sequence
  synthetic polynucleotide sequence
gccgtggcaaggtccaga

SEQ ID NO: 3193 - DNA, 18 bp, Artificial sequence
  synthetic polynucleotide sequence
ggacgaagcagctggcaa

SEQ ID NO: 3194 - DNA, 18 bp, Artificial sequence
  synthetic polynucleotide sequence
cagccatccttcagggca

SEQ ID NO: 3195 - DNA, 18 bp, Artificial sequence
  synthetic polynucleotide sequence
ggtcttgcaggaccacca

SEQ ID NO: 3196 - DNA, 18 bp, Artificial sequence
  synthetic polynucleotide sequence
cgatcacccttgccacca

SEQ ID NO: 3197 - DNA, 18 bp, Artificial sequence
  synthetic polynucleotide sequence
gcctgcgcaagttcagca

SEQ ID NO: 3198 - DNA, 18 bp, Artificial sequence
  synthetic polynucleotide sequence
gtagccgatccacagcga

SEQ ID NO: 3199 - DNA, 18 bp, Artificial sequence
  synthetic polynucleotide sequence
gtacttcgagggccagga

SEQ ID NO: 3200 - DNA, 18 bp, Artificial sequence
  synthetic polynucleotide sequence
cgcagtggtagagagcca

SEQ ID NO: 3201 - DNA, 18 bp, Artificial sequence
  synthetic polynucleotide sequence
ggagacatgggaccacca

SEQ ID NO: 3202 - DNA, 18 bp, Artificial sequence
  synthetic polynucleotide sequence
gggtctccacgtacacca

SEQ ID NO: 3203 - DNA, 18 bp, Artificial sequence
  synthetic polynucleotide sequence
ggaccagggtgcaaagga

SEQ ID NO: 3204 - DNA, 18 bp, Artificial sequence
  synthetic polynucleotide sequence
aaccctttgggcccagga

SEQ ID NO: 3205 - DNA, 18 bp, Artificial sequence
  synthetic polynucleotide sequence
ggtccaaagggcgaacca

SEQ ID NO: 3206 - DNA, 18 bp, Artificial sequence
  synthetic polynucleotide sequence
agacctggtctcccagga

SEQ ID NO: 3207 - DNA, 18 bp, Artificial sequence
  synthetic polynucleotide sequence
gaatgcctggccagagca

SEQ ID NO: 3208 - DNA, 18 bp, Artificial sequence
  synthetic polynucleotide sequence
agctgtaccccacccaca

SEQ ID NO: 3209 - DNA, 18 bp, Artificial sequence
  synthetic polynucleotide sequence
ggccctactggtgaacca

SEQ ID NO: 3210 - DNA, 18 bp, Artificial sequence
  synthetic polynucleotide sequence
gggatccctcgaaggcca

SEQ ID NO: 3211 - DNA, 18 bp, Artificial sequence
  synthetic polynucleotide sequence
gggcaacgtggagagaga

SEQ ID NO: 3212 - DNA, 18 bp, Artificial sequence
  synthetic polynucleotide sequence
gggtctccacgatcacca

SEQ ID NO: 3213 - DNA, 18 bp, Artificial sequence
  synthetic polynucleotide sequence
agggggaaaagggccaca

SEQ ID NO: 3214 - DNA, 18 bp, Artificial sequence
  synthetic polynucleotide sequence
ccaatgggaccaggggga

SEQ ID NO: 3215 - DNA, 18 bp, Artificial sequence
  synthetic polynucleotide sequence
ccaggtgaatgagcccca

SEQ ID NO: 3216 - DNA, 18 bp, Artificial sequence
  synthetic polynucleotide sequence
ggtggaagacaccgcgga

SEQ ID NO: 3217 - DNA, 18 bp, Artificial sequence
  synthetic polynucleotide sequence
ggtgcagtacagccacga

SEQ ID NO: 3218 - DNA, 18 bp, Artificial sequence
  synthetic polynucleotide sequence
gcccgtccgtgatgacca

SEQ ID NO: 3219 - DNA, 18 bp, Artificial sequence
  synthetic polynucleotide sequence
acagcgctgagaccacca

SEQ ID NO: 3220 - DNA, 18 bp, Artificial sequence
  synthetic polynucleotide sequence
caactgccactctggcga

SEQ ID NO: 3221 - DNA, 18 bp, Artificial sequence
  synthetic polynucleotide sequence
gaatgcccagtgcaccca

SEQ ID NO: 3222 - DNA, 18 bp, Artificial sequence
  synthetic polynucleotide sequence
aggcgtctgagaagcgca

SEQ ID NO: 3223 - DNA, 18 bp, Artificial sequence
  synthetic polynucleotide sequence
tcgaggcgagaagggaga

SEQ ID NO: 3224 - DNA, 18 bp, Artificial sequence
  synthetic polynucleotide sequence
tgagagacgcggagcaca

SEQ ID NO: 3225 - DNA, 18 bp, Artificial sequence
  synthetic polynucleotide sequence
ggaccaataggtgcccca

SEQ ID NO: 3226 - DNA, 18 bp, Artificial sequence
  synthetic polynucleotide sequence
ggaggccctacttcacca

SEQ ID NO: 3227 - DNA, 18 bp, Artificial sequence
  synthetic polynucleotide sequence
cacagcggctacaaccca

SEQ ID NO: 3228 - DNA, 18 bp, Artificial sequence
  synthetic polynucleotide sequence
cttgtacagggccaccca

SEQ ID NO: 3229 - DNA, 18 bp, Artificial sequence
  synthetic polynucleotide sequence
ggtctcccaggtgaccca

SEQ ID NO: 3230 - DNA, 18 bp, Artificial sequence
  synthetic polynucleotide sequence
aggaggctggctcacaga

SEQ ID NO: 3231 - DNA, 18 bp, Artificial sequence
  synthetic polynucleotide sequence
cgtgggtcagatcggcaa

SEQ ID NO: 3232 - DNA, 18 bp, Artificial sequence
  synthetic polynucleotide sequence
ggccgaagctccaaggca

SEQ ID NO: 3233 - DNA, 18 bp, Artificial sequence
  synthetic polynucleotide sequence
ggtcggacccaaaggaga

SEQ ID NO: 3234 - DNA, 18 bp, Artificial sequence
  synthetic polynucleotide sequence
tgccaggaacacccggga

SEQ ID NO: 3235 - DNA, 18 bp, Artificial sequence
  synthetic polynucleotide sequence
gatgaagctgccaacaca

SEQ ID NO: 3236 - DNA, 18 bp, Artificial sequence
  synthetic polynucleotide sequence
acacagtcctcatgacca

SEQ ID NO: 3237 - DNA, 18 bp, Artificial sequence
  synthetic polynucleotide sequence
actctgaccactccccca

SEQ ID NO: 3238 - DNA, 18 bp, Artificial sequence
  synthetic polynucleotide sequence
ggccaccatctccacgca

SEQ ID NO: 3239 - DNA, 18 bp, Artificial sequence
  synthetic polynucleotide sequence
ggtagggagagagagcca

SEQ ID NO: 3240 - DNA, 18 bp, Artificial sequence
  synthetic polynucleotide sequence
cccatggccatgacccca

SEQ ID NO: 3241 - DNA, 18 bp, Artificial sequence
  synthetic polynucleotide sequence
ccttccgcagagaccaga

SEQ ID NO: 3242 - DNA, 18 bp, Artificial sequence
  synthetic polynucleotide sequence
ccatctccacagtaggca

SEQ ID NO: 3243 - DNA, 18 bp, Artificial sequence
  synthetic polynucleotide sequence
tgatgcctgcgacgacga

SEQ ID NO: 3244 - DNA, 18 bp, Artificial sequence
  synthetic polynucleotide sequence
cagcgttctccggacaca

SEQ ID NO: 3245 - DNA, 18 bp, Artificial sequence
  synthetic polynucleotide sequence
accggtacctgccggaca

SEQ ID NO: 3246 - DNA, 18 bp, Artificial sequence
  synthetic polynucleotide sequence
gctaggaagtctggcgca

SEQ ID NO: 3247 - DNA, 18 bp, Artificial sequence
  synthetic polynucleotide sequence
cccagcagctcatcacca

SEQ ID NO: 3248 - DNA, 18 bp, Artificial sequence
  synthetic polynucleotide sequence
tgagggctgtacgcagca

SEQ ID NO: 3249 - DNA, 18 bp, Artificial sequence
  synthetic polynucleotide sequence
gcagcagatcccctagca

SEQ ID NO: 3250 - DNA, 18 bp, Artificial sequence
  synthetic polynucleotide sequence
gcgaagtcatgaggagca

SEQ ID NO: 3251 - DNA, 18 bp, Artificial sequence
  synthetic polynucleotide sequence
gaggaccagagttgcaca

SEQ ID NO: 3252 - DNA, 18 bp, Artificial sequence
  synthetic polynucleotide sequence
cactcctgggctaggcca

SEQ ID NO: 3253 - DNA, 18 bp, Artificial sequence
  synthetic polynucleotide sequence
ctgacaagtgctcgccca

SEQ ID NO: 3254 - DNA, 18 bp, Artificial sequence
  synthetic polynucleotide sequence
ggacgatgaggttgacca

SEQ ID NO: 3255 - DNA, 18 bp, Artificial sequence
  synthetic polynucleotide sequence
acaggaggccaagccgta

SEQ ID NO: 3256 - DNA, 18 bp, Artificial sequence
  synthetic polynucleotide sequence
accagcaagctctccaca

SEQ ID NO: 3257 - DNA, 18 bp, Artificial sequence
  synthetic polynucleotide sequence
tcgggaggcaacttggaa

SEQ ID NO: 3258 - DNA, 18 bp, Artificial sequence
  synthetic polynucleotide sequence
tatgcagcagcctgagca

SEQ ID NO: 3259 - DNA, 18 bp, Artificial sequence
  synthetic polynucleotide sequence
ggcctctgaagcgggaga

SEQ ID NO: 3260 - DNA, 18 bp, Artificial sequence
  synthetic polynucleotide sequence
ggtaggccatgagcccca

SEQ ID NO: 3261 - DNA, 18 bp, Artificial sequence
  synthetic polynucleotide sequence
gcagcaggtagaagcaga

SEQ ID NO: 3262 - DNA, 18 bp, Artificial sequence
  synthetic polynucleotide sequence
tgctcagcgtgaggggga

SEQ ID NO: 3263 - DNA, 18 bp, Artificial sequence
  synthetic polynucleotide sequence
ggctcacaaatggtggga

SEQ ID NO: 3264 - DNA, 18 bp, Artificial sequence
  synthetic polynucleotide sequence
ccaccacagccaacgtca

SEQ ID NO: 3265 - DNA, 18 bp, Artificial sequence
  synthetic polynucleotide sequence
ggcactccaggaagctca

SEQ ID NO: 3266 - DNA, 18 bp, Artificial sequence
  synthetic polynucleotide sequence
ggacagggatgacctgga

SEQ ID NO: 3267 - DNA, 18 bp, Artificial sequence
  synthetic polynucleotide sequence
gtggatgccaaaagccga

SEQ ID NO: 3268 - DNA, 18 bp, Artificial sequence
  synthetic polynucleotide sequence
ccctgtcctgcaagcgga

SEQ ID NO: 3269 - DNA, 18 bp, Artificial sequence
  synthetic polynucleotide sequence
gcggagaagaggaagaca

SEQ ID NO: 3270 - DNA, 18 bp, Artificial sequence
  synthetic polynucleotide sequence
gtccccagcgtaatgcca

SEQ ID NO: 3271 - DNA, 18 bp, Artificial sequence
  synthetic polynucleotide sequence
ccccgctacagtcgagca

SEQ ID NO: 3272 - DNA, 18 bp, Artificial sequence
  synthetic polynucleotide sequence
ctccgggttgggcaagca

SEQ ID NO: 3273 - DNA, 18 bp, Artificial sequence
  synthetic polynucleotide sequence
tgagaaggaccgtcccca

SEQ ID NO: 3274 - DNA, 18 bp, Artificial sequence
  synthetic polynucleotide sequence
aaggggcctcggaagtga

SEQ ID NO: 3275 - DNA, 18 bp, Artificial sequence
  synthetic polynucleotide sequence
ggtgggagagaagctcca

SEQ ID NO: 3276 - DNA, 18 bp, Artificial sequence
  synthetic polynucleotide sequence
ggccaccctccaggggca

SEQ ID NO: 3277 - DNA, 18 bp, Artificial sequence
  synthetic polynucleotide sequence
ccacatggaccttcccca

SEQ ID NO: 3278 - DNA, 18 bp, Artificial sequence
  synthetic polynucleotide sequence
ggtgccacaggctgcaga

SEQ ID NO: 3279 - DNA, 18 bp, Artificial sequence
  synthetic polynucleotide sequence
ccgctgtcgccgtgggca

SEQ ID NO: 3280 - DNA, 18 bp, Artificial sequence
  synthetic polynucleotide sequence
ctgaggcatgacctgcaa

SEQ ID NO: 3281 - DNA, 18 bp, Artificial sequence
  synthetic polynucleotide sequence
agccgtggcatgaaagga

SEQ ID NO: 3282 - DNA, 18 bp, Artificial sequence
  synthetic polynucleotide sequence
gcaacttgtgcggaggga

SEQ ID NO: 3283 - DNA, 18 bp, Artificial sequence
  synthetic polynucleotide sequence
gaccaagaaggcgcgcga

SEQ ID NO: 3284 - DNA, 18 bp, Artificial sequence
  synthetic polynucleotide sequence
tcacacagcagaccacca

SEQ ID NO: 3285 - DNA, 18 bp, Artificial sequence
  synthetic polynucleotide sequence
tagttggcaagcgagcaa

SEQ ID NO: 3286 - DNA, 18 bp, Artificial sequence
  synthetic polynucleotide sequence
gcagacaggtgcttgaca

SEQ ID NO: 3287 - DNA, 18 bp, Artificial sequence
  synthetic polynucleotide sequence
gcgctgtggccgcaacca

SEQ ID NO: 3288 - DNA, 18 bp, Artificial sequence
  synthetic polynucleotide sequence
tgacccatgggaatagca

SEQ ID NO: 3289 - DNA, 18 bp, Artificial sequence
  synthetic polynucleotide sequence
ttggctgcacaaaggcga

SEQ ID NO: 3290 - DNA, 18 bp, Artificial sequence
  synthetic polynucleotide sequence
ccagctgctggggcacca

SEQ ID NO: 3291 - DNA, 18 bp, Artificial sequence
  synthetic polynucleotide sequence
ccggggtggcagtcagca

SEQ ID NO: 3292 - DNA, 18 bp, Artificial sequence
  synthetic polynucleotide sequence
ggagatgggggtaggcga

SEQ ID NO: 3293 - DNA, 18 bp, Artificial sequence
  synthetic polynucleotide sequence
gccagcgctgccaaagga

SEQ ID NO: 3294 - DNA, 18 bp, Artificial sequence
  synthetic polynucleotide sequence
tgaaggtgcagagggcca

SEQ ID NO: 3295 - DNA, 18 bp, Artificial sequence
  synthetic polynucleotide sequence
ctggcagaactacctgga

SEQ ID NO: 3296 - DNA, 18 bp, Artificial sequence
  synthetic polynucleotide sequence
gtacacacgctggtacca

SEQ ID NO: 3297 - DNA, 19 bp, Artificial sequence
  synthetic polynucleotide sequence
gttttgccaaaacctcgga

SEQ ID NO: 3298 - DNA, 18 bp, Artificial sequence
  synthetic polynucleotide sequence
ctttgatcagccacacga

SEQ ID NO: 3299 - DNA, 18 bp, Artificial sequence
  synthetic polynucleotide sequence
agaaccgagtgcgcgaga

SEQ ID NO: 3300 - DNA, 18 bp, Artificial sequence
  synthetic polynucleotide sequence
cctggggaaggaggccca

SEQ ID NO: 3301 - DNA, 18 bp, Artificial sequence
  synthetic polynucleotide sequence
gtcagattgggcagagga

SEQ ID NO: 3302 - DNA, 18 bp, Artificial sequence
  synthetic polynucleotide sequence
agggcatcagctacccca

SEQ ID NO: 3303 - DNA, 18 bp, Artificial sequence
  synthetic polynucleotide sequence
agagccaccagaaacgta

SEQ ID NO: 3304 - DNA, 18 bp, Artificial sequence
  synthetic polynucleotide sequence
ctctgccaacaggggaca

SEQ ID NO: 3305 - DNA, 18 bp, Artificial sequence
  synthetic polynucleotide sequence
cgccggaaatgaggccga

SEQ ID NO: 3306 - DNA, 18 bp, Artificial sequence
  synthetic polynucleotide sequence
ggccacatgtggagcgta

SEQ ID NO: 3307 - DNA, 18 bp, Artificial sequence
  synthetic polynucleotide sequence
ggacctacagccagggca

SEQ ID NO: 3308 - DNA, 18 bp, Artificial sequence
  synthetic polynucleotide sequence
tgatggtcagaagcgcca

SEQ ID NO: 3309 - DNA, 18 bp, Artificial sequence
  synthetic polynucleotide sequence
aagccagtggaggaagca

SEQ ID NO: 3310 - DNA, 18 bp, Artificial sequence
  synthetic polynucleotide sequence
cctcggctgtgggcagga

SEQ ID NO: 3311 - DNA, 18 bp, Artificial sequence
  synthetic polynucleotide sequence
gccacctaaccatgagga

SEQ ID NO: 3312 - DNA, 18 bp, Artificial sequence
  synthetic polynucleotide sequence
gcccaggtcataagccca

SEQ ID NO: 3313 - DNA, 18 bp, Artificial sequence
  synthetic polynucleotide sequence
cagctagcgggagcagca

SEQ ID NO: 3314 - DNA, 18 bp, Artificial sequence
  synthetic polynucleotide sequence
gctggcaggaggaagcca

SEQ ID NO: 3315 - DNA, 18 bp, Artificial sequence
  synthetic polynucleotide sequence
tgagggttcccgaggaga

SEQ ID NO: 3316 - DNA, 18 bp, Artificial sequence
  synthetic polynucleotide sequence
agaccctgcatgcagcca

SEQ ID NO: 3317 - DNA, 18 bp, Artificial sequence
  synthetic polynucleotide sequence
ctcactgcacggcaccaa

SEQ ID NO: 3318 - DNA, 18 bp, Artificial sequence
  synthetic polynucleotide sequence
cctcgcaggtagcccgga

SEQ ID NO: 3319 - DNA, 18 bp, Artificial sequence
  synthetic polynucleotide sequence
gaggtggggacgattgga

SEQ ID NO: 3320 - DNA, 18 bp, Artificial sequence
  synthetic polynucleotide sequence
tgtaacgctccggcagca

SEQ ID NO: 3321 - DNA, 18 bp, Artificial sequence
  synthetic polynucleotide sequence
cctgggcagcatgaagga

SEQ ID NO: 3322 - DNA, 18 bp, Artificial sequence
  synthetic polynucleotide sequence
ctgcccacaaggaaggga

SEQ ID NO: 3323 - DNA, 18 bp, Artificial sequence
  synthetic polynucleotide sequence
aggagaccttgtggccaa

SEQ ID NO: 3324 - DNA, 18 bp, Artificial sequence
  synthetic polynucleotide sequence
agagtatgcccgggccaa

SEQ ID NO: 3325 - DNA, 18 bp, Artificial sequence
  synthetic polynucleotide sequence
ggcttgaccccagcagga

SEQ ID NO: 3326 - DNA, 18 bp, Artificial sequence
  synthetic polynucleotide sequence
caatcccggcatacacca

SEQ ID NO: 3327 - DNA, 18 bp, Artificial sequence
  synthetic polynucleotide sequence
gatgaatgccagggcgca

SEQ ID NO: 3328 - DNA, 18 bp, Artificial sequence
  synthetic polynucleotide sequence
tggaactcacgtccagca

SEQ ID NO: 3329 - DNA, 18 bp, Artificial sequence
  synthetic polynucleotide sequence
cacacgctgtggtgggaa

SEQ ID NO: 3330 - DNA, 18 bp, Artificial sequence
  synthetic polynucleotide sequence
cggaacgggacgtgacga

SEQ ID NO: 3331 - DNA, 18 bp, Artificial sequence
  synthetic polynucleotide sequence
agccgtcaaaaagcctga

SEQ ID NO: 3332 - DNA, 18 bp, Artificial sequence
  synthetic polynucleotide sequence
ggaggtttgcagagagga

SEQ ID NO: 3333 - DNA, 18 bp, Artificial sequence
  synthetic polynucleotide sequence
cgagcccttggaaccaga

SEQ ID NO: 3334 - DNA, 18 bp, Artificial sequence
  synthetic polynucleotide sequence
tccggaactcctcgcaca

SEQ ID NO: 3335 - DNA, 18 bp, Artificial sequence
  synthetic polynucleotide sequence
ccggacgaaagcaaggca

SEQ ID NO: 3336 - DNA, 18 bp, Artificial sequence
  synthetic polynucleotide sequence
gagctggacgttcagcca

SEQ ID NO: 3337 - DNA, 18 bp, Artificial sequence
  synthetic polynucleotide sequence
aggctgcacatcagggga

SEQ ID NO: 3338 - DNA, 18 bp, Artificial sequence
  synthetic polynucleotide sequence
aagtcagcaccacccaca

SEQ ID NO: 3339 - DNA, 18 bp, Artificial sequence
  synthetic polynucleotide sequence
cacaacagcggacggcca

SEQ ID NO: 3340 - DNA, 18 bp, Artificial sequence
  synthetic polynucleotide sequence
ggaactccatggcagcga

SEQ ID NO: 3341 - DNA, 18 bp, Artificial sequence
  synthetic polynucleotide sequence
aagctcagatccagccca

SEQ ID NO: 3342 - DNA, 18 bp, Artificial sequence
  synthetic polynucleotide sequence
cccagcagcatagtggca

SEQ ID NO: 3343 - DNA, 18 bp, Artificial sequence
  synthetic polynucleotide sequence
tgaccagcatggtccaga

SEQ ID NO: 3344 - DNA, 18 bp, Artificial sequence
  synthetic polynucleotide sequence
ggaactacagccctggca

SEQ ID NO: 3345 - DNA, 18 bp, Artificial sequence
  synthetic polynucleotide sequence
ctgaaggtggctcaggca

SEQ ID NO: 3346 - DNA, 18 bp, Artificial sequence
  synthetic polynucleotide sequence
ggaaggcctcaacaagca

SEQ ID NO: 3347 - DNA, 18 bp, Artificial sequence
  synthetic polynucleotide sequence
cccagacggtggaacaga

SEQ ID NO: 3348 - DNA, 18 bp, Artificial sequence
  synthetic polynucleotide sequence
aggcagaagaggtgacga

SEQ ID NO: 3349 - DNA, 18 bp, Artificial sequence
  synthetic polynucleotide sequence
ccatggccagctgaccaa

SEQ ID NO: 3350 - DNA, 18 bp, Artificial sequence
  synthetic polynucleotide sequence
ccaggtagagctcaggca

SEQ ID NO: 3351 - DNA, 18 bp, Artificial sequence
  synthetic polynucleotide sequence
ggcatggactggaaagga

SEQ ID NO: 3352 - DNA, 18 bp, Artificial sequence
  synthetic polynucleotide sequence
gccggatgtaaccagcca

SEQ ID NO: 3353 - DNA, 18 bp, Artificial sequence
  synthetic polynucleotide sequence
caggagtggtgagggaca

SEQ ID NO: 3354 - DNA, 18 bp, Artificial sequence
  synthetic polynucleotide sequence
cggcactggcagtcacca

SEQ ID NO: 3355 - DNA, 18 bp, Artificial sequence
  synthetic polynucleotide sequence
gctgccgagaccagagca

SEQ ID NO: 3356 - DNA, 18 bp, Artificial sequence
  synthetic polynucleotide sequence
ataggagtaggccagcca

SEQ ID NO: 3357 - DNA, 18 bp, Artificial sequence
  synthetic polynucleotide sequence
acagcttcacgggaggca

SEQ ID NO: 3358 - DNA, 18 bp, Artificial sequence
  synthetic polynucleotide sequence
ggtgcaccgtctccacga

SEQ ID NO: 3359 - DNA, 18 bp, Artificial sequence
  synthetic polynucleotide sequence
atgtgacccccacccaga

SEQ ID NO: 3360 - DNA, 18 bp, Artificial sequence
  synthetic polynucleotide sequence
agttcacagcgaggggca

SEQ ID NO: 3361 - DNA, 18 bp, Artificial sequence
  synthetic polynucleotide sequence
cccacccagacagaggga

SEQ ID NO: 3362 - DNA, 18 bp, Artificial sequence
  synthetic polynucleotide sequence
agttcacagcgaggggca

SEQ ID NO: 3363 - DNA, 18 bp, Artificial sequence
  synthetic polynucleotide sequence
cactgtcaccctccacca

SEQ ID NO: 3364 - DNA, 18 bp, Artificial sequence
  synthetic polynucleotide sequence
gggcagcgagtcacagga

SEQ ID NO: 3365 - DNA, 18 bp, Artificial sequence
  synthetic polynucleotide sequence
acggacgcaagtgcagga

SEQ ID NO: 3366 - DNA, 18 bp, Artificial sequence
  synthetic polynucleotide sequence
ggccagctcacgggtcca

SEQ ID NO: 3367 - DNA, 18 bp, Artificial sequence
  synthetic polynucleotide sequence
ccaagacctcgtggacca

SEQ ID NO: 3368 - DNA, 18 bp, Artificial sequence
  synthetic polynucleotide sequence
cgtagaccctggtgcaca

SEQ ID NO: 3369 - DNA, 18 bp, Artificial sequence
  synthetic polynucleotide sequence
tggacacctcctacgcca

SEQ ID NO: 3370 - DNA, 18 bp, Artificial sequence
  synthetic polynucleotide sequence
gttgtaggccgacaggga

SEQ ID NO: 3371 - DNA, 18 bp, Artificial sequence
  synthetic polynucleotide sequence
gggctgtacccatcagca

SEQ ID NO: 3372 - DNA, 18 bp, Artificial sequence
  synthetic polynucleotide sequence
agggacccggtgtagcca

SEQ ID NO: 3373 - DNA, 18 bp, Artificial sequence
  synthetic polynucleotide sequence
tgcctcgatggcagccca

SEQ ID NO: 3374 - DNA, 18 bp, Artificial sequence
  synthetic polynucleotide sequence
ggtgcccccattcaagca

SEQ ID NO: 3375 - DNA, 18 bp, Artificial sequence
  synthetic polynucleotide sequence
cagaagccatcactgcta

SEQ ID NO: 3376 - DNA, 18 bp, Artificial sequence
  synthetic polynucleotide sequence
cccgaagcttccgcacca

SEQ ID NO: 3377 - DNA, 19 bp, Artificial sequence
  synthetic polynucleotide sequence
ccagcagagtggagatgca

SEQ ID NO: 3378 - DNA, 19 bp, Artificial sequence
  synthetic polynucleotide sequence
gagttacggtgggagcaga

SEQ ID NO: 3379 - DNA, 18 bp, Artificial sequence
  synthetic polynucleotide sequence
acccacagcccctccaga

SEQ ID NO: 3380 - DNA, 18 bp, Artificial sequence
  synthetic polynucleotide sequence
gggatgggatagccctca

SEQ ID NO: 3381 - DNA, 18 bp, Artificial sequence
  synthetic polynucleotide sequence
ccagcttgctcccagcaa

SEQ ID NO: 3382 - DNA, 18 bp, Artificial sequence
  synthetic polynucleotide sequence
taccacctcgctgaccga

SEQ ID NO: 3383 - DNA, 18 bp, Artificial sequence
  synthetic polynucleotide sequence
cagatcagcagcccccaa

SEQ ID NO: 3384 - DNA, 18 bp, Artificial sequence
  synthetic polynucleotide sequence
ccggtgctagaaggagga

SEQ ID NO: 3385 - DNA, 18 bp, Artificial sequence
  synthetic polynucleotide sequence
caccatctccacgctgga

SEQ ID NO: 3386 - DNA, 18 bp, Artificial sequence
  synthetic polynucleotide sequence
gcaggttgctcacggaga

SEQ ID NO: 3387 - DNA, 18 bp, Artificial sequence
  synthetic polynucleotide sequence
gccagaatcagaagggga

SEQ ID NO: 3388 - DNA, 18 bp, Artificial sequence
  synthetic polynucleotide sequence
gagcgttaactggacaca

SEQ ID NO: 3389 - DNA, 18 bp, Artificial sequence
  synthetic polynucleotide sequence
gctggctgctaagggcga

SEQ ID NO: 3390 - DNA, 18 bp, Artificial sequence
  synthetic polynucleotide sequence
atgaagccctccagcaca

SEQ ID NO: 3391 - DNA, 18 bp, Artificial sequence
  synthetic polynucleotide sequence
ctgcacagcctgtgacga

SEQ ID NO: 3392 - DNA, 18 bp, Artificial sequence
  synthetic polynucleotide sequence
gccgcacactcgtccaca

SEQ ID NO: 3393 - DNA, 18 bp, Artificial sequence
  synthetic polynucleotide sequence
agcaacacgcaaacgaga

SEQ ID NO: 3394 - DNA, 18 bp, Artificial sequence
  synthetic polynucleotide sequence
tcaagcacagccacacga

SEQ ID NO: 3395 - DNA, 18 bp, Artificial sequence
  synthetic polynucleotide sequence
ctcggcgctcgctcgaca

SEQ ID NO: 3396 - DNA, 18 bp, Artificial sequence
  synthetic polynucleotide sequence
cttcccggaggaggtgga

SEQ ID NO: 3397 - DNA, 18 bp, Artificial sequence
  synthetic polynucleotide sequence
ggtagttccacaccagca

SEQ ID NO: 3398 - DNA, 18 bp, Artificial sequence
  synthetic polynucleotide sequence
ctcgcaacctgctgagga

SEQ ID NO: 3399 - DNA, 18 bp, Artificial sequence
  synthetic polynucleotide sequence
aaggctgctacctgcaca

SEQ ID NO: 3400 - DNA, 18 bp, Artificial sequence
  synthetic polynucleotide sequence
aggcgacgatgatgggga

SEQ ID NO: 3401 - DNA, 18 bp, Artificial sequence
  synthetic polynucleotide sequence
gagcgctgcgggaagaca

SEQ ID NO: 3402 - DNA, 18 bp, Artificial sequence
  synthetic polynucleotide sequence
ccttgggtccgaagagga

SEQ ID NO: 3403 - DNA, 18 bp, Artificial sequence
  synthetic polynucleotide sequence
caacaaggatcacctcga

SEQ ID NO: 3404 - DNA, 18 bp, Artificial sequence
  synthetic polynucleotide sequence
ggcaggcttcacatggga

SEQ ID NO: 3405 - DNA, 18 bp, Artificial sequence
  synthetic polynucleotide sequence
ggtgggcaaacaagtgca

SEQ ID NO: 3406 - DNA, 18 bp, Artificial sequence
  synthetic polynucleotide sequence
aggcaattccacagccta

SEQ ID NO: 3407 - DNA, 18 bp, Artificial sequence
  synthetic polynucleotide sequence
ccaaagactcccaacgca

SEQ ID NO: 3408 - DNA, 18 bp, Artificial sequence
  synthetic polynucleotide sequence
gcccaattaccagcagga

SEQ ID NO: 3409 - DNA, 18 bp, Artificial sequence
  synthetic polynucleotide sequence
cgtgcagtccctcagcaa

SEQ ID NO: 3410 - DNA, 18 bp, Artificial sequence
  synthetic polynucleotide sequence
aacgggcacagctgagca

SEQ ID NO: 3411 - DNA, 18 bp, Artificial sequence
  synthetic polynucleotide sequence
gcgaaggcaagagaggga

SEQ ID NO: 3412 - DNA, 18 bp, Artificial sequence
  synthetic polynucleotide sequence
ggttgggcatagggccca

SEQ ID NO: 3413 - DNA, 19 bp, Artificial sequence
  synthetic polynucleotide sequence
ccacacggaaagcatggaa

SEQ ID NO: 3414 - DNA, 17 bp, Artificial sequence
  synthetic polynucleotide sequence
ccccaggagaaccggaa

SEQ ID NO: 3415 - DNA, 18 bp, Artificial sequence
  synthetic polynucleotide sequence
gctaccgagtggaggaca

SEQ ID NO: 3416 - DNA, 18 bp, Artificial sequence
  synthetic polynucleotide sequence
tgcagcgcacttgcacga

SEQ ID NO: 3417 - DNA, 18 bp, Artificial sequence
  synthetic polynucleotide sequence
ccagcaccaatgcagcca

SEQ ID NO: 3418 - DNA, 18 bp, Artificial sequence
  synthetic polynucleotide sequence
cggggtcccagatgacca

SEQ ID NO: 3419 - DNA, 18 bp, Artificial sequence
  synthetic polynucleotide sequence
tgaggagcaagcctggca

SEQ ID NO: 3420 - DNA, 18 bp, Artificial sequence
  synthetic polynucleotide sequence
catcagggtgcacgagga

SEQ ID NO: 3421 - DNA, 18 bp, Artificial sequence
  synthetic polynucleotide sequence
tcaacagcacccgggaca

SEQ ID NO: 3422 - DNA, 18 bp, Artificial sequence
  synthetic polynucleotide sequence
gcagttccaggtcagcca

SEQ ID NO: 3423 - DNA, 18 bp, Artificial sequence
  synthetic polynucleotide sequence
atctcacgcgggaaggaa

SEQ ID NO: 3424 - DNA, 18 bp, Artificial sequence
  synthetic polynucleotide sequence
tgagctgcaggacccgca

SEQ ID NO: 3425 - DNA, 18 bp, Artificial sequence
  synthetic polynucleotide sequence
catcttggggcaggagca

SEQ ID NO: 3426 - DNA, 18 bp, Artificial sequence
  synthetic polynucleotide sequence
ggactgaagggcccgcca

SEQ ID NO: 3427 - DNA, 18 bp, Artificial sequence
  synthetic polynucleotide sequence
ctggagtgtggccaagga

SEQ ID NO: 3428 - DNA, 18 bp, Artificial sequence
  synthetic polynucleotide sequence
tgtctcgagggcacacga

SEQ ID NO: 3429 - DNA, 19 bp, Artificial sequence
  synthetic polynucleotide sequence
gcctaacgtaaccctgcaa

SEQ ID NO: 3430 - DNA, 19 bp, Artificial sequence
  synthetic polynucleotide sequence
ggtggagcacatgagtaca

SEQ ID NO: 3431 - DNA, 18 bp, Artificial sequence
  synthetic polynucleotide sequence
gcgagggttccagggaga

SEQ ID NO: 3432 - DNA, 18 bp, Artificial sequence
  synthetic polynucleotide sequence
cagatagctgactgcaca

SEQ ID NO: 3433 - DNA, 18 bp, Artificial sequence
  synthetic polynucleotide sequence
cttcgactccgacagcca

SEQ ID NO: 3434 - DNA, 18 bp, Artificial sequence
  synthetic polynucleotide sequence
ctgggtcggccagaacca

SEQ ID NO: 3435 - DNA, 18 bp, Artificial sequence
  synthetic polynucleotide sequence
cccagctgctatgaccca

SEQ ID NO: 3436 - DNA, 18 bp, Artificial sequence
  synthetic polynucleotide sequence
gtgagagggctgacggga

SEQ ID NO: 3437 - DNA, 18 bp, Artificial sequence
  synthetic polynucleotide sequence
tcagcgtgaacgcaggca

SEQ ID NO: 3438 - DNA, 18 bp, Artificial sequence
  synthetic polynucleotide sequence
ggccgtgggtagtccaca

SEQ ID NO: 3439 - DNA, 18 bp, Artificial sequence
  synthetic polynucleotide sequence
ccatccaccacccctgga

SEQ ID NO: 3440 - DNA, 18 bp, Artificial sequence
  synthetic polynucleotide sequence
ccaggcgcatctctgaga

SEQ ID NO: 3441 - DNA, 18 bp, Artificial sequence
  synthetic polynucleotide sequence
atccagggggacgacgca

SEQ ID NO: 3442 - DNA, 18 bp, Artificial sequence
  synthetic polynucleotide sequence
tgtcacgcaggcgacgca

SEQ ID NO: 3443 - DNA, 18 bp, Artificial sequence
  synthetic polynucleotide sequence
gtggccgcaagatggaga

SEQ ID NO: 3444 - DNA, 18 bp, Artificial sequence
  synthetic polynucleotide sequence
ccggggaactcatagcca

SEQ ID NO: 3445 - DNA, 18 bp, Artificial sequence
  synthetic polynucleotide sequence
aaggagctgccatcggca

SEQ ID NO: 3446 - DNA, 18 bp, Artificial sequence
  synthetic polynucleotide sequence
cacttgccccatgaacca

SEQ ID NO: 3447 - DNA, 18 bp, Artificial sequence
  synthetic polynucleotide sequence
gcagcggtattggggcca

SEQ ID NO: 3448 - DNA, 18 bp, Artificial sequence
  synthetic polynucleotide sequence
ggacaggtaagggtcgga

SEQ ID NO: 3449 - DNA, 18 bp, Artificial sequence
  synthetic polynucleotide sequence
ggagcgcatggtgaagga

SEQ ID NO: 3450 - DNA, 18 bp, Artificial sequence
  synthetic polynucleotide sequence
tggccacaaccacacgga

SEQ ID NO: 3451 - DNA, 18 bp, Artificial sequence
  synthetic polynucleotide sequence
cttcgtcagccaagggga

SEQ ID NO: 3452 - DNA, 18 bp, Artificial sequence
  synthetic polynucleotide sequence
tgacaccagcttgacgga

SEQ ID NO: 3453 - DNA, 18 bp, Artificial sequence
  synthetic polynucleotide sequence
gaacgcggttcaaacaca

SEQ ID NO: 3454 - DNA, 18 bp, Artificial sequence
  synthetic polynucleotide sequence
caactgattcaggaggca

SEQ ID NO: 3455 - DNA, 17 bp, Artificial sequence
  synthetic polynucleotide sequence
gagcaccagggatcgga

SEQ ID NO: 3456 - DNA, 19 bp, Artificial sequence
  synthetic polynucleotide sequence
cagcaagaccaggatgaca

SEQ ID NO: 3457 - DNA, 19 bp, Artificial sequence
  synthetic polynucleotide sequence
tgatggccagccactacaa

SEQ ID NO: 3458 - DNA, 19 bp, Artificial sequence
  synthetic polynucleotide sequence
aaggggatgacaagcagaa

SEQ ID NO: 3459 - DNA, 18 bp, Artificial sequence
  synthetic polynucleotide sequence
gctcctggagtgaagcca

SEQ ID NO: 3460 - DNA, 18 bp, Artificial sequence
  synthetic polynucleotide sequence
gccgaggacgatgccaca

SEQ ID NO: 3461 - DNA, 18 bp, Artificial sequence
  synthetic polynucleotide sequence
tccagaacgcccacagca

SEQ ID NO: 3462 - DNA, 18 bp, Artificial sequence
  synthetic polynucleotide sequence
cacagaagcggagggcca

SEQ ID NO: 3463 - DNA, 18 bp, Artificial sequence
  synthetic polynucleotide sequence
caccttggacacactgca

SEQ ID NO: 3464 - DNA, 17 bp, Artificial sequence
  synthetic polynucleotide sequence
gcggtacgacacctcca

SEQ ID NO: 3465 - DNA, 18 bp, Artificial sequence
  synthetic polynucleotide sequence
cacgccacccatcaccaa

SEQ ID NO: 3466 - DNA, 18 bp, Artificial sequence
  synthetic polynucleotide sequence
accagagtggggaggcca

SEQ ID NO: 3467 - DNA, 18 bp, Artificial sequence
  synthetic polynucleotide sequence
gactggccttacccgcca

SEQ ID NO: 3468 - DNA, 18 bp, Artificial sequence
  synthetic polynucleotide sequence
gccgtgtaaggacggtga

SEQ ID NO: 3469 - DNA, 18 bp, Artificial sequence
  synthetic polynucleotide sequence
ggcagatcctcaagcaga

SEQ ID NO: 3470 - DNA, 18 bp, Artificial sequence
  synthetic polynucleotide sequence
gcagtagagcagcccgta

SEQ ID NO: 3471 - DNA, 18 bp, Artificial sequence
  synthetic polynucleotide sequence
gaccacgctatgctccaa

SEQ ID NO: 3472 - DNA, 18 bp, Artificial sequence
  synthetic polynucleotide sequence
gctccagccacgactcga

SEQ ID NO: 3473 - DNA, 18 bp, Artificial sequence
  synthetic polynucleotide sequence
ggcagaccctcaagcaga

SEQ ID NO: 3474 - DNA, 18 bp, Artificial sequence
  synthetic polynucleotide sequence
gcagtggagcagcccgta

SEQ ID NO: 3475 - DNA, 18 bp, Artificial sequence
  synthetic polynucleotide sequence
cgtggccaaggtcagcga

SEQ ID NO: 3476 - DNA, 18 bp, Artificial sequence
  synthetic polynucleotide sequence
ccttctccacccgaggga

SEQ ID NO: 3477 - DNA, 18 bp, Artificial sequence
  synthetic polynucleotide sequence
gttctccccagccacaca

SEQ ID NO: 3478 - DNA, 18 bp, Artificial sequence
  synthetic polynucleotide sequence
ccctccaggaagaagcca

SEQ ID NO: 3479 - DNA, 18 bp, Artificial sequence
  synthetic polynucleotide sequence
cgcaaaggggaaagccga

SEQ ID NO: 3480 - DNA, 18 bp, Artificial sequence
  synthetic polynucleotide sequence
gcggccacatttagcgca

SEQ ID NO: 3481 - DNA, 18 bp, Artificial sequence
  synthetic polynucleotide sequence
ttccagcagctcaaccaa

SEQ ID NO: 3482 - DNA, 18 bp, Artificial sequence
  synthetic polynucleotide sequence
gagcagtgggattggaga

SEQ ID NO: 3483 - DNA, 18 bp, Artificial sequence
  synthetic polynucleotide sequence
agcaggtccctcagccta

SEQ ID NO: 3484 - DNA, 18 bp, Artificial sequence
  synthetic polynucleotide sequence
tctgagggtagggcacca

SEQ ID NO: 3485 - DNA, 18 bp, Artificial sequence
  synthetic polynucleotide sequence
ctccggcatggagagaga

SEQ ID NO: 3486 - DNA, 18 bp, Artificial sequence
  synthetic polynucleotide sequence
tgaggtggacatgcgaga

SEQ ID NO: 3487 - DNA, 18 bp, Artificial sequence
  synthetic polynucleotide sequence
caaaacgggctacaccaa

SEQ ID NO: 3488 - DNA, 18 bp, Artificial sequence
  synthetic polynucleotide sequence
tgaactgcacccactgga

SEQ ID NO: 3489 - DNA, 18 bp, Artificial sequence
  synthetic polynucleotide sequence
tgaaggaccaggctcgaa

SEQ ID NO: 3490 - DNA, 18 bp, Artificial sequence
  synthetic polynucleotide sequence
atcccaagggggttggca

SEQ ID NO: 3491 - DNA, 18 bp, Artificial sequence
  synthetic polynucleotide sequence
aggtacttcaagggacca

SEQ ID NO: 3492 - DNA, 18 bp, Artificial sequence
  synthetic polynucleotide sequence
gtacccagaaccttggca

SEQ ID NO: 3493 - DNA, 18 bp, Artificial sequence
  synthetic polynucleotide sequence
caagagacctgccaacca

SEQ ID NO: 3494 - DNA, 18 bp, Artificial sequence
  synthetic polynucleotide sequence
gctgcagctggtaggcca

SEQ ID NO: 3495 - DNA, 18 bp, Artificial sequence
  synthetic polynucleotide sequence
tccgtgcagaagaggaga

SEQ ID NO: 3496 - DNA, 18 bp, Artificial sequence
  synthetic polynucleotide sequence
acaggagcttgcaaccga

SEQ ID NO: 3497 - DNA, 18 bp, Artificial sequence
  synthetic polynucleotide sequence
cctgcagagtgcagagga

SEQ ID NO: 3498 - DNA, 18 bp, Artificial sequence
  synthetic polynucleotide sequence
ggcacagctcttcgggga

SEQ ID NO: 3499 - DNA, 18 bp, Artificial sequence
  synthetic polynucleotide sequence
ggttcagtgcgaaggcaa

SEQ ID NO: 3500 - DNA, 18 bp, Artificial sequence
  synthetic polynucleotide sequence
gccgtagcaggacttgca

SEQ ID NO: 3501 - DNA, 18 bp, Artificial sequence
  synthetic polynucleotide sequence
ccacgcagaagaggtgca

SEQ ID NO: 3502 - DNA, 18 bp, Artificial sequence
  synthetic polynucleotide sequence
gccctggccataaccgta

SEQ ID NO: 3503 - DNA, 18 bp, Artificial sequence
  synthetic polynucleotide sequence
cagtccccaaagccggca

SEQ ID NO: 3504 - DNA, 18 bp, Artificial sequence
  synthetic polynucleotide sequence
cacagatggcacagcgga

SEQ ID NO: 3505 - DNA, 18 bp, Artificial sequence
  synthetic polynucleotide sequence
ggataatcccgggtggca

SEQ ID NO: 3506 - DNA, 18 bp, Artificial sequence
  synthetic polynucleotide sequence
cttagtacccgcagcgga

SEQ ID NO: 3507 - DNA, 18 bp, Artificial sequence
  synthetic polynucleotide sequence
gccgaaccatatgtacca

SEQ ID NO: 3508 - DNA, 18 bp, Artificial sequence
  synthetic polynucleotide sequence
gacacctggaattcacca

SEQ ID NO: 3509 - DNA, 18 bp, Artificial sequence
  synthetic polynucleotide sequence
acgtggagctgggccgaa

SEQ ID NO: 3510 - DNA, 18 bp, Artificial sequence
  synthetic polynucleotide sequence
ctggtcatggaaggggca

SEQ ID NO: 3511 - DNA, 18 bp, Artificial sequence
  synthetic polynucleotide sequence
ccacagacctcaatgaca

SEQ ID NO: 3512 - DNA, 18 bp, Artificial sequence
  synthetic polynucleotide sequence
aggcagccatcacctgca

SEQ ID NO: 3513 - DNA, 18 bp, Artificial sequence
  synthetic polynucleotide sequence
acttgccccctggcagca

SEQ ID NO: 3514 - DNA, 18 bp, Artificial sequence
  synthetic polynucleotide sequence
gaggagttctgccaggga

SEQ ID NO: 3515 - DNA, 18 bp, Artificial sequence
  synthetic polynucleotide sequence
accacaccttgaagcaga

SEQ ID NO: 3516 - DNA, 18 bp, Artificial sequence
  synthetic polynucleotide sequence
ggagaacaggcacctcga

SEQ ID NO: 3517 - DNA, 18 bp, Artificial sequence
  synthetic polynucleotide sequence
cgcagaggaggaaggcta

SEQ ID NO: 3518 - DNA, 18 bp, Artificial sequence
  synthetic polynucleotide sequence
atgaactcaggacgcgca

SEQ ID NO: 3519 - DNA, 18 bp, Artificial sequence
  synthetic polynucleotide sequence
cctacagactggggcaca

SEQ ID NO: 3520 - DNA, 18 bp, Artificial sequence
  synthetic polynucleotide sequence
tccccagcagtagctcca

SEQ ID NO: 3521 - DNA, 18 bp, Artificial sequence
  synthetic polynucleotide sequence
tcccggacaaaatgagga

SEQ ID NO: 3522 - DNA, 20 bp, Artificial sequence
  synthetic polynucleotide sequence
agccagttgaaggaatcaga

SEQ ID NO: 3523 - DNA, 18 bp, Artificial sequence
  synthetic polynucleotide sequence
acatcgccgaccaggtga

SEQ ID NO: 3524 - DNA, 18 bp, Artificial sequence
  synthetic polynucleotide sequence
cctcgtcgccgacgtgca

SEQ ID NO: 3525 - DNA, 18 bp, Artificial sequence
  synthetic polynucleotide sequence
atgatccacggggaggca

SEQ ID NO: 3526 - DNA, 18 bp, Artificial sequence
  synthetic polynucleotide sequence
ggctctcatggccaggga

SEQ ID NO: 3527 - DNA, 18 bp, Artificial sequence
  synthetic polynucleotide sequence
ttcgcgacacccatggaa

SEQ ID NO: 3528 - DNA, 18 bp, Artificial sequence
  synthetic polynucleotide sequence
gacaggagctgatggaga

SEQ ID NO: 3529 - DNA, 18 bp, Artificial sequence
  synthetic polynucleotide sequence
ctccagaggcccagggaa

SEQ ID NO: 3530 - DNA, 18 bp, Artificial sequence
  synthetic polynucleotide sequence
aaggcattgacccatcca

SEQ ID NO: 3531 - DNA, 18 bp, Artificial sequence
  synthetic polynucleotide sequence
gggagatccgcagagcca

SEQ ID NO: 3532 - DNA, 18 bp, Artificial sequence
  synthetic polynucleotide sequence
cttccacagcagctggga

SEQ ID NO: 3533 - DNA, 18 bp, Artificial sequence
  synthetic polynucleotide sequence
ggcaggatacgaggggca

SEQ ID NO: 3534 - DNA, 18 bp, Artificial sequence
  synthetic polynucleotide sequence
taccaggcagtgtgagga

SEQ ID NO: 3535 - DNA, 18 bp, Artificial sequence
  synthetic polynucleotide sequence
tgacgctgcaggacgtca

SEQ ID NO: 3536 - DNA, 18 bp, Artificial sequence
  synthetic polynucleotide sequence
acatgccaatgccccgta

SEQ ID NO: 3537 - DNA, 18 bp, Artificial sequence
  synthetic polynucleotide sequence
agtgcccagactgcgaca

SEQ ID NO: 3538 - DNA, 18 bp, Artificial sequence
  synthetic polynucleotide sequence
cactggcgtaatcgcaca

SEQ ID NO: 3539 - DNA, 18 bp, Artificial sequence
  synthetic polynucleotide sequence
gccgcgaacggagacgaa

SEQ ID NO: 3540 - DNA, 18 bp, Artificial sequence
  synthetic polynucleotide sequence
tctctgcaggcgacagga

SEQ ID NO: 3541 - DNA, 18 bp, Artificial sequence
  synthetic polynucleotide sequence
gccatccagacaatgcca

SEQ ID NO: 3542 - DNA, 18 bp, Artificial sequence
  synthetic polynucleotide sequence
acctgagggcatccagca

SEQ ID NO: 3543 - DNA, 18 bp, Artificial sequence
  synthetic polynucleotide sequence
caccaaatacgctgagca

SEQ ID NO: 3544 - DNA, 18 bp, Artificial sequence
  synthetic polynucleotide sequence
gccgctcgtgcactggca

SEQ ID NO: 3545 - DNA, 18 bp, Artificial sequence
  synthetic polynucleotide sequence
cgggaaatgctgcgagga

SEQ ID NO: 3546 - DNA, 18 bp, Artificial sequence
  synthetic polynucleotide sequence
cttggaacaggcgctcca

SEQ ID NO: 3547 - DNA, 18 bp, Artificial sequence
  synthetic polynucleotide sequence
gccgagagcttgggagga

SEQ ID NO: 3548 - DNA, 18 bp, Artificial sequence
  synthetic polynucleotide sequence
atcctctaagcccacaga

SEQ ID NO: 3549 - DNA, 18 bp, Artificial sequence
  synthetic polynucleotide sequence
tgcctggtcgagacggga

SEQ ID NO: 3550 - DNA, 18 bp, Artificial sequence
  synthetic polynucleotide sequence
atccatcccgacctggga

SEQ ID NO: 3551 - DNA, 19 bp, Artificial sequence
  synthetic polynucleotide sequence
ctgaacctggctaccagga

SEQ ID NO: 3552 - DNA, 16 bp, Artificial sequence
  synthetic polynucleotide sequence
ctgtcagcctgccgaa

SEQ ID NO: 3553 - DNA, 18 bp, Artificial sequence
  synthetic polynucleotide sequence
cctgatccaggcagccaa

SEQ ID NO: 3554 - DNA, 18 bp, Artificial sequence
  synthetic polynucleotide sequence
agcaggaaggttgaggga

SEQ ID NO: 3555 - DNA, 18 bp, Artificial sequence
  synthetic polynucleotide sequence
atgggacgacagcggcaa

SEQ ID NO: 3556 - DNA, 18 bp, Artificial sequence
  synthetic polynucleotide sequence
caggacactgatcagcca

SEQ ID NO: 3557 - DNA, 18 bp, Artificial sequence
  synthetic polynucleotide sequence
cagaacctcaggcagcaa

SEQ ID NO: 3558 - DNA, 18 bp, Artificial sequence
  synthetic polynucleotide sequence
atgaagaatccgccagca

SEQ ID NO: 3559 - DNA, 18 bp, Artificial sequence
  synthetic polynucleotide sequence
cgggatgttcacaaccga

SEQ ID NO: 3560 - DNA, 18 bp, Artificial sequence
  synthetic polynucleotide sequence
tcacagaggacccctgca

SEQ ID NO: 3561 - DNA, 17 bp, Artificial sequence
  synthetic polynucleotide sequence
gcggaagctcaagggca

SEQ ID NO: 3562 - DNA, 18 bp, Artificial sequence
  synthetic polynucleotide sequence
acaagggcaggcacacca

SEQ ID NO: 3563 - DNA, 18 bp, Artificial sequence
  synthetic polynucleotide sequence
gtcctacaacaacgacca

SEQ ID NO: 3564 - DNA, 18 bp, Artificial sequence
  synthetic polynucleotide sequence
cgtcgaagacgatggaga

SEQ ID NO: 3565 - DNA, 18 bp, Artificial sequence
  synthetic polynucleotide sequence
cccgtgcgctaccacgaa

SEQ ID NO: 3566 - DNA, 18 bp, Artificial sequence
  synthetic polynucleotide sequence
caactgcatccctaagca

SEQ ID NO: 3567 - DNA, 18 bp, Artificial sequence
  synthetic polynucleotide sequence
gtctgccaaaaggatgga

SEQ ID NO: 3568 - DNA, 18 bp, Artificial sequence
  synthetic polynucleotide sequence
gtacacgccagggctgga

SEQ ID NO: 3569 - DNA, 18 bp, Artificial sequence
  synthetic polynucleotide sequence
gggcaggaggatcaccga

SEQ ID NO: 3570 - DNA, 18 bp, Artificial sequence
  synthetic polynucleotide sequence
aggacacaatgcccacca

SEQ ID NO: 3571 - DNA, 18 bp, Artificial sequence
  synthetic polynucleotide sequence
ccgtggtggatcacgcca

SEQ ID NO: 3572 - DNA, 18 bp, Artificial sequence
  synthetic polynucleotide sequence
ccccattgcaggctgaga

SEQ ID NO: 3573 - DNA, 18 bp, Artificial sequence
  synthetic polynucleotide sequence
cctcagtggcgtgggcaa

SEQ ID NO: 3574 - DNA, 18 bp, Artificial sequence
  synthetic polynucleotide sequence
acctgcgccacctgcaca

SEQ ID NO: 3575 - DNA, 19 bp, Artificial sequence
  synthetic polynucleotide sequence
ccctcaaccagaagatgga

SEQ ID NO: 3576 - DNA, 19 bp, Artificial sequence
  synthetic polynucleotide sequence
ggagaacatggtgaaggca

SEQ ID NO: 3577 - DNA, 18 bp, Artificial sequence
  synthetic polynucleotide sequence
ggatctgcatccacacca

SEQ ID NO: 3578 - DNA, 18 bp, Artificial sequence
  synthetic polynucleotide sequence
gcttcagcaggatagcca

SEQ ID NO: 3579 - DNA, 19 bp, Artificial sequence
  synthetic polynucleotide sequence
ccaccacactggtctaaga

SEQ ID NO: 3580 - DNA, 18 bp, Artificial sequence
  synthetic polynucleotide sequence
cggatccggaagtagcca

SEQ ID NO: 3581 - DNA, 18 bp, Artificial sequence
  synthetic polynucleotide sequence
gaggccattgtggacaca

SEQ ID NO: 3582 - DNA, 18 bp, Artificial sequence
  synthetic polynucleotide sequence
cgccctgaatcagcggca

SEQ ID NO: 3583 - DNA, 18 bp, Artificial sequence
  synthetic polynucleotide sequence
aaccgtggttggccagca

SEQ ID NO: 3584 - DNA, 18 bp, Artificial sequence
  synthetic polynucleotide sequence
acatcggcaagtccacca

SEQ ID NO: 3585 - DNA, 18 bp, Artificial sequence
  synthetic polynucleotide sequence
gcctggctggccaagaga

SEQ ID NO: 3586 - DNA, 18 bp, Artificial sequence
  synthetic polynucleotide sequence
cccacaagcaacaccgca

SEQ ID NO: 3587 - DNA, 18 bp, Artificial sequence
  synthetic polynucleotide sequence
gcaggggagatcatcgga

SEQ ID NO: 3588 - DNA, 18 bp, Artificial sequence
  synthetic polynucleotide sequence
cgcaccaggaaccctcca

SEQ ID NO: 3589 - DNA, 18 bp, Artificial sequence
  synthetic polynucleotide sequence
tctatgacgaggaagcga

SEQ ID NO: 3590 - DNA, 18 bp, Artificial sequence
  synthetic polynucleotide sequence
gggtaggaggcgcaggca

SEQ ID NO: 3591 - DNA, 18 bp, Artificial sequence
  synthetic polynucleotide sequence
agggggctacatgaccaa

SEQ ID NO: 3592 - DNA, 18 bp, Artificial sequence
  synthetic polynucleotide sequence
cccacatatgggtaggca

SEQ ID NO: 3593 - DNA, 18 bp, Artificial sequence
  synthetic polynucleotide sequence
aaggccctgatgaaggca

SEQ ID NO: 3594 - DNA, 18 bp, Artificial sequence
  synthetic polynucleotide sequence
tagccaaccaccagcaca

SEQ ID NO: 3595 - DNA, 18 bp, Artificial sequence
  synthetic polynucleotide sequence
agcaggagaaggccctga

SEQ ID NO: 3596 - DNA, 18 bp, Artificial sequence
  synthetic polynucleotide sequence
atccgtagccaaccacca

SEQ ID NO: 3597 - DNA, 18 bp, Artificial sequence
  synthetic polynucleotide sequence
gttccggaaaactgggaa

SEQ ID NO: 3598 - DNA, 18 bp, Artificial sequence
  synthetic polynucleotide sequence
gcgaccactgtgaagcca

SEQ ID NO: 3599 - DNA, 18 bp, Artificial sequence
  synthetic polynucleotide sequence
tgactggagggacaagca

SEQ ID NO: 3600 - DNA, 18 bp, Artificial sequence
  synthetic polynucleotide sequence
ctgcccccaccacgctga

SEQ ID NO: 3601 - DNA, 19 bp, Artificial sequence
  synthetic polynucleotide sequence
acaagggcatcgactcaga

SEQ ID NO: 3602 - DNA, 19 bp, Artificial sequence
  synthetic polynucleotide sequence
gccaaccacaagtacacca

SEQ ID NO: 3603 - DNA, 19 bp, Artificial sequence
  synthetic polynucleotide sequence
gaaaggctacgtgacgcca

SEQ ID NO: 3604 - DNA, 18 bp, Artificial sequence
  synthetic polynucleotide sequence
cgcgaacagtccaccaga

SEQ ID NO: 3605 - DNA, 18 bp, Artificial sequence
  synthetic polynucleotide sequence
catggcagcggcaggcaa

SEQ ID NO: 3606 - DNA, 18 bp, Artificial sequence
  synthetic polynucleotide sequence
tgaacgcgtcccagacga

SEQ ID NO: 3607 - DNA, 19 bp, Artificial sequence
  synthetic polynucleotide sequence
ccgtgcagaacgtcatcga

SEQ ID NO: 3608 - DNA, 17 bp, Artificial sequence
  synthetic polynucleotide sequence
gcaggtctcgtcaggga

SEQ ID NO: 3609 - DNA, 18 bp, Artificial sequence
  synthetic polynucleotide sequence
ggagcaagccagagccaa

SEQ ID NO: 3610 - DNA, 18 bp, Artificial sequence
  synthetic polynucleotide sequence
gccttgaaggaagccgca

SEQ ID NO: 3611 - DNA, 18 bp, Artificial sequence
  synthetic polynucleotide sequence
gcttcaggactcaccgca

SEQ ID NO: 3612 - DNA, 18 bp, Artificial sequence
  synthetic polynucleotide sequence
actggcacagccgaagca

SEQ ID NO: 3613 - DNA, 18 bp, Artificial sequence
  synthetic polynucleotide sequence
catcgaggaagaccgcaa

SEQ ID NO: 3614 - DNA, 18 bp, Artificial sequence
  synthetic polynucleotide sequence
aacctggaggacagctga

SEQ ID NO: 3615 - DNA, 18 bp, Artificial sequence
  synthetic polynucleotide sequence
ccagcaagctacatcgga

SEQ ID NO: 3616 - DNA, 18 bp, Artificial sequence
  synthetic polynucleotide sequence
agcctgagtaagaggcca

SEQ ID NO: 3617 - DNA, 18 bp, Artificial sequence
  synthetic polynucleotide sequence
cccaccagcaccaagaca

SEQ ID NO: 3618 - DNA, 18 bp, Artificial sequence
  synthetic polynucleotide sequence
gtgcacctccaacaccaa

SEQ ID NO: 3619 - DNA, 18 bp, Artificial sequence
  synthetic polynucleotide sequence
acgaggagctggagcgga

SEQ ID NO: 3620 - DNA, 18 bp, Artificial sequence
  synthetic polynucleotide sequence
tcagcatcgactgaggca

SEQ ID NO: 3621 - DNA, 18 bp, Artificial sequence
  synthetic polynucleotide sequence
aacacaagcaccctcgta

SEQ ID NO: 3622 - DNA, 18 bp, Artificial sequence
  synthetic polynucleotide sequence
aatgatgtcaccagggca

SEQ ID NO: 3623 - DNA, 18 bp, Artificial sequence
  synthetic polynucleotide sequence
gccacgctactgtgagca

SEQ ID NO: 3624 - DNA, 18 bp, Artificial sequence
  synthetic polynucleotide sequence
ttcagcaaggctcccgca

SEQ ID NO: 3625 - DNA, 18 bp, Artificial sequence
  synthetic polynucleotide sequence
gtggaaagggaagatcga

SEQ ID NO: 3626 - DNA, 18 bp, Artificial sequence
  synthetic polynucleotide sequence
taagggtgcacagaacga

SEQ ID NO: 3627 - DNA, 18 bp, Artificial sequence
  synthetic polynucleotide sequence
cgagagcatggagaggga

SEQ ID NO: 3628 - DNA, 18 bp, Artificial sequence
  synthetic polynucleotide sequence
cacaagtcaccagccgca

SEQ ID NO: 3629 - DNA, 18 bp, Artificial sequence
  synthetic polynucleotide sequence
cacctaccagagcctcca

SEQ ID NO: 3630 - DNA, 19 bp, Artificial sequence
  synthetic polynucleotide sequence
gggcaccaggacatatgaa

SEQ ID NO: 3631 - DNA, 18 bp, Artificial sequence
  synthetic polynucleotide sequence
actccatgaacaaccgga

SEQ ID NO: 3632 - DNA, 18 bp, Artificial sequence
  synthetic polynucleotide sequence
attgcggagcacgggcca

SEQ ID NO: 3633 - DNA, 18 bp, Artificial sequence
  synthetic polynucleotide sequence
caaagagccgtacgtcca

SEQ ID NO: 3634 - DNA, 18 bp, Artificial sequence
  synthetic polynucleotide sequence
gggagagtcggactctga

SEQ ID NO: 3635 - DNA, 18 bp, Artificial sequence
  synthetic polynucleotide sequence
ggaccccactgcgcccaa

SEQ ID NO: 3636 - DNA, 18 bp, Artificial sequence
  synthetic polynucleotide sequence
ggatgcaggattgaggca

SEQ ID NO: 3637 - DNA, 19 bp, Artificial sequence
  synthetic polynucleotide sequence
ctgagcctacagcagagga

SEQ ID NO: 3638 - DNA, 20 bp, Artificial sequence
  synthetic polynucleotide sequence
gaggtactccttgaatgcca

SEQ ID NO: 3639 - DNA, 18 bp, Artificial sequence
  synthetic polynucleotide sequence
gcaccagcagcaacagca

SEQ ID NO: 3640 - DNA, 19 bp, Artificial sequence
  synthetic polynucleotide sequence
cagggcctatgcaaagaca

SEQ ID NO: 3641 - DNA, 19 bp, Artificial sequence
  synthetic polynucleotide sequence
cgtcagcctgagctacaga

SEQ ID NO: 3642 - DNA, 19 bp, Artificial sequence
  synthetic polynucleotide sequence
ggctacaatctgaagggca

SEQ ID NO: 3643 - DNA, 22 bp, Artificial sequence
  synthetic polynucleotide sequence
atcatagtctggaagaagaaca

SEQ ID NO: 3644 - DNA, 19 bp, Artificial sequence
  synthetic polynucleotide sequence
gagcagggataagggaaga

SEQ ID NO: 3645 - DNA, 18 bp, Artificial sequence
  synthetic polynucleotide sequence
gaagccaaagtacccgca

SEQ ID NO: 3646 - DNA, 18 bp, Artificial sequence
  synthetic polynucleotide sequence
gacctcggtacctggaca

SEQ ID NO: 3647 - DNA, 19 bp, Artificial sequence
  synthetic polynucleotide sequence
ggacccatgggttcaggaa

SEQ ID NO: 3648 - DNA, 19 bp, Artificial sequence
  synthetic polynucleotide sequence
gagtggactgcaaggtgga

SEQ ID NO: 3649 - DNA, 18 bp, Artificial sequence
  synthetic polynucleotide sequence
gacaccaaaggcaccaca

SEQ ID NO: 3650 - DNA, 18 bp, Artificial sequence
  synthetic polynucleotide sequence
gaagagtgggcgctcaga

SEQ ID NO: 3651 - DNA, 18 bp, Artificial sequence
  synthetic polynucleotide sequence
ccactgcgcccaaaccga

SEQ ID NO: 3652 - DNA, 18 bp, Artificial sequence
  synthetic polynucleotide sequence
cgatgcggggttgagaca

SEQ ID NO: 3653 - DNA, 18 bp, Artificial sequence
  synthetic polynucleotide sequence
gctgagccccatggccca

SEQ ID NO: 3654 - DNA, 18 bp, Artificial sequence
  synthetic polynucleotide sequence
gcaagcactggcagcgca

SEQ ID NO: 3655 - DNA, 18 bp, Artificial sequence
  synthetic polynucleotide sequence
tgacgcagccagggccca

SEQ ID NO: 3656 - DNA, 18 bp, Artificial sequence
  synthetic polynucleotide sequence
atggcgaacacttgcaga

SEQ ID NO: 3657 - DNA, 18 bp, Artificial sequence
  synthetic polynucleotide sequence
gctgagagtaaaccccaa

SEQ ID NO: 3658 - DNA, 18 bp, Artificial sequence
  synthetic polynucleotide sequence
ggcttccgggtccagaca

SEQ ID NO: 3659 - DNA, 18 bp, Artificial sequence
  synthetic polynucleotide sequence
acactgcgccaacacaga

SEQ ID NO: 3660 - DNA, 18 bp, Artificial sequence
  synthetic polynucleotide sequence
cacaaccctctgcaccca

SEQ ID NO: 3661 - DNA, 18 bp, Artificial sequence
  synthetic polynucleotide sequence
tcagcaccaaccaaggga

SEQ ID NO: 3662 - DNA, 18 bp, Artificial sequence
  synthetic polynucleotide sequence
aggaagggcttggggcaa

SEQ ID NO: 3663 - DNA, 18 bp, Artificial sequence
  synthetic polynucleotide sequence
acacagcaaaatggcgga

SEQ ID NO: 3664 - DNA, 18 bp, Artificial sequence
  synthetic polynucleotide sequence
ttgtagggcagccagcaa

SEQ ID NO: 3665 - DNA, 18 bp, Artificial sequence
  synthetic polynucleotide sequence
atacagcaaactggcgga

SEQ ID NO: 3666 - DNA, 18 bp, Artificial sequence
  synthetic polynucleotide sequence
ggaccaggttgtagggca

SEQ ID NO: 3667 - DNA, 19 bp, Artificial sequence
  synthetic polynucleotide sequence
gccgagaaagcagggtaga

SEQ ID NO: 3668 - DNA, 16 bp, Artificial sequence
  synthetic polynucleotide sequence
gcaagagcagcatcca

SEQ ID NO: 3669 - DNA, 18 bp, Artificial sequence
  synthetic polynucleotide sequence
caacgtcagtgaggcaga

SEQ ID NO: 3670 - DNA, 18 bp, Artificial sequence
  synthetic polynucleotide sequence
ggatgacaataccaggca

SEQ ID NO: 3671 - DNA, 18 bp, Artificial sequence
  synthetic polynucleotide sequence
gaaccaagcagaaacgca

SEQ ID NO: 3672 - DNA, 18 bp, Artificial sequence
  synthetic polynucleotide sequence
gtggtagggtgaccagca

SEQ ID NO: 3673 - DNA, 18 bp, Artificial sequence
  synthetic polynucleotide sequence
cgcagcacacactgggaa

SEQ ID NO: 3674 - DNA, 18 bp, Artificial sequence
  synthetic polynucleotide sequence
gagcacagggttaaggca

SEQ ID NO: 3675 - DNA, 18 bp, Artificial sequence
  synthetic polynucleotide sequence
aggagtggctgatcggca

SEQ ID NO: 3676 - DNA, 18 bp, Artificial sequence
  synthetic polynucleotide sequence
tgtccagcagcaccgcca

SEQ ID NO: 3677 - DNA, 18 bp, Artificial sequence
  synthetic polynucleotide sequence
cgggaggggtgatccgaa

SEQ ID NO: 3678 - DNA, 18 bp, Artificial sequence
  synthetic polynucleotide sequence
tacaggcaccacctccga

SEQ ID NO: 3679 - DNA, 17 bp, Artificial sequence
  synthetic polynucleotide sequence
cgcctgcccaagcgcca

SEQ ID NO: 3680 - DNA, 18 bp, Artificial sequence
  synthetic polynucleotide sequence
gcagcatcagggccagca

SEQ ID NO: 3681 - DNA, 18 bp, Artificial sequence
  synthetic polynucleotide sequence
agctccatccagatgaca

SEQ ID NO: 3682 - DNA, 18 bp, Artificial sequence
  synthetic polynucleotide sequence
acatcaaggcgacggcca

SEQ ID NO: 3683 - DNA, 18 bp, Artificial sequence
  synthetic polynucleotide sequence
ggaggtggcaaagcgcaa

SEQ ID NO: 3684 - DNA, 18 bp, Artificial sequence
  synthetic polynucleotide sequence
gaagcgggtgacatcgta

SEQ ID NO: 3685 - DNA, 18 bp, Artificial sequence
  synthetic polynucleotide sequence
cggagtggagctcagcca

SEQ ID NO: 3686 - DNA, 18 bp, Artificial sequence
  synthetic polynucleotide sequence
agcttcctggggacgcca

SEQ ID NO: 3687 - DNA, 18 bp, Artificial sequence
  synthetic polynucleotide sequence
ggacaggaatcaccccaa

SEQ ID NO: 3688 - DNA, 18 bp, Artificial sequence
  synthetic polynucleotide sequence
catcccctggagcgggca

SEQ ID NO: 3689 - DNA, 18 bp, Artificial sequence
  synthetic polynucleotide sequence
cgacctgagctggaggaa

SEQ ID NO: 3690 - DNA, 18 bp, Artificial sequence
  synthetic polynucleotide sequence
gtggaaggtggtcccgga

SEQ ID NO: 3691 - DNA, 18 bp, Artificial sequence
  synthetic polynucleotide sequence
gagagcagcaggatcaga

SEQ ID NO: 3692 - DNA, 18 bp, Artificial sequence
  synthetic polynucleotide sequence
cattctgccaaccaggca

SEQ ID NO: 3693 - DNA, 17 bp, Artificial sequence
  synthetic polynucleotide sequence
ggacggcccaactggga

SEQ ID NO: 3694 - DNA, 18 bp, Artificial sequence
  synthetic polynucleotide sequence
cactccccgagggccaga

SEQ ID NO: 3695 - DNA, 18 bp, Artificial sequence
  synthetic polynucleotide sequence
ccagagcacgaccatcga

SEQ ID NO: 3696 - DNA, 18 bp, Artificial sequence
  synthetic polynucleotide sequence
tggtgtagaccaggggca

SEQ ID NO: 3697 - DNA, 18 bp, Artificial sequence
  synthetic polynucleotide sequence
cctgcggaagatggcaga

SEQ ID NO: 3698 - DNA, 18 bp, Artificial sequence
  synthetic polynucleotide sequence
tgacaatgtcagccagca

SEQ ID NO: 3699 - DNA, 18 bp, Artificial sequence
  synthetic polynucleotide sequence
ccttgtggggaaagccca

SEQ ID NO: 3700 - DNA, 18 bp, Artificial sequence
  synthetic polynucleotide sequence
ggtgggaagtcactggca

SEQ ID NO: 3701 - DNA, 18 bp, Artificial sequence
  synthetic polynucleotide sequence
ctcggagcgtaaccccaa

SEQ ID NO: 3702 - DNA, 18 bp, Artificial sequence
  synthetic polynucleotide sequence
ggcccttgagcagcagga

SEQ ID NO: 3703 - DNA, 18 bp, Artificial sequence
  synthetic polynucleotide sequence
ctgcacccgtccaagaga

SEQ ID NO: 3704 - DNA, 18 bp, Artificial sequence
  synthetic polynucleotide sequence
gtacagcctgcacactca

SEQ ID NO: 3705 - DNA, 18 bp, Artificial sequence
  synthetic polynucleotide sequence
cacctccaggtggagaca

SEQ ID NO: 3706 - DNA, 18 bp, Artificial sequence
  synthetic polynucleotide sequence
tgaaggtgaggaggggga

SEQ ID NO: 3707 - DNA, 18 bp, Artificial sequence
  synthetic polynucleotide sequence
cggcaggaacttccacca

SEQ ID NO: 3708 - DNA, 18 bp, Artificial sequence
  synthetic polynucleotide sequence
tcagcacgtggtgcagca

SEQ ID NO: 3709 - DNA, 18 bp, Artificial sequence
  synthetic polynucleotide sequence
gaatccagcggggaccca

SEQ ID NO: 3710 - DNA, 18 bp, Artificial sequence
  synthetic polynucleotide sequence
ggggatgccttccaggga

SEQ ID NO: 3711 - DNA, 18 bp, Artificial sequence
  synthetic polynucleotide sequence
cctgctgccaccatgcca

SEQ ID NO: 3712 - DNA, 18 bp, Artificial sequence
  synthetic polynucleotide sequence
agttgcaggcactgccga

SEQ ID NO: 3713 - DNA, 18 bp, Artificial sequence
  synthetic polynucleotide sequence
cctggagaccttccgaca

SEQ ID NO: 3714 - DNA, 18 bp, Artificial sequence
  synthetic polynucleotide sequence
cacaacgccccttgggga

SEQ ID NO: 3715 - DNA, 18 bp, Artificial sequence
  synthetic polynucleotide sequence
ctaaccctgccctgcaga

SEQ ID NO: 3716 - DNA, 18 bp, Artificial sequence
  synthetic polynucleotide sequence
cccgtgatgtcccggaca

SEQ ID NO: 3717 - DNA, 18 bp, Artificial sequence
  synthetic polynucleotide sequence
gactcgagtgcaggcaga

SEQ ID NO: 3718 - DNA, 18 bp, Artificial sequence
  synthetic polynucleotide sequence
aggccaggacatagggca

SEQ ID NO: 3719 - DNA, 18 bp, Artificial sequence
  synthetic polynucleotide sequence
ggaggagctagaccacga

SEQ ID NO: 3720 - DNA, 18 bp, Artificial sequence
  synthetic polynucleotide sequence
ggggcaaggctaagggca

SEQ ID NO: 3721 - DNA, 18 bp, Artificial sequence
  synthetic polynucleotide sequence
agtggagctggccaggca

SEQ ID NO: 3722 - DNA, 18 bp, Artificial sequence
  synthetic polynucleotide sequence
gcagggagattgtccaca

SEQ ID NO: 3723 - DNA, 18 bp, Artificial sequence
  synthetic polynucleotide sequence
cgggacacccatgacaca

SEQ ID NO: 3724 - DNA, 18 bp, Artificial sequence
  synthetic polynucleotide sequence
agcggctggtgctagcca

SEQ ID NO: 3725 - DNA, 18 bp, Artificial sequence
  synthetic polynucleotide sequence
agcctgctacccccagga

SEQ ID NO: 3726 - DNA, 18 bp, Artificial sequence
  synthetic polynucleotide sequence
ggatcagccttgcgagga

SEQ ID NO: 3727 - DNA, 18 bp, Artificial sequence
  synthetic polynucleotide sequence
cccgaagtccagacagca

SEQ ID NO: 3728 - DNA, 18 bp, Artificial sequence
  synthetic polynucleotide sequence
tgaccaccgccttcagca

SEQ ID NO: 3729 - DNA, 18 bp, Artificial sequence
  synthetic polynucleotide sequence
ggaggcagtgatccacga

SEQ ID NO: 3730 - DNA, 18 bp, Artificial sequence
  synthetic polynucleotide sequence
ggggtctctcagcacaga

SEQ ID NO: 3731 - DNA, 18 bp, Artificial sequence
  synthetic polynucleotide sequence
caagaaccggcagcccaa

SEQ ID NO: 3732 - DNA, 18 bp, Artificial sequence
  synthetic polynucleotide sequence
ctctcagcacggagccca

SEQ ID NO: 3733 - DNA, 18 bp, Artificial sequence
  synthetic polynucleotide sequence
cccacatcgccctccaga

SEQ ID NO: 3734 - DNA, 18 bp, Artificial sequence
  synthetic polynucleotide sequence
gggtgacaatgtggggca

SEQ ID NO: 3735 - DNA, 18 bp, Artificial sequence
  synthetic polynucleotide sequence
cctgtatgcaggacagga

SEQ ID NO: 3736 - DNA, 18 bp, Artificial sequence
  synthetic polynucleotide sequence
ggggcaggttggtgggga

SEQ ID NO: 3737 - DNA, 18 bp, Artificial sequence
  synthetic polynucleotide sequence
ccacatgccctacacaga

SEQ ID NO: 3738 - DNA, 18 bp, Artificial sequence
  synthetic polynucleotide sequence
acgtcacaggtcactgca

SEQ ID NO: 3739 - DNA, 18 bp, Artificial sequence
  synthetic polynucleotide sequence
gacacaggagcccctgca

SEQ ID NO: 3740 - DNA, 18 bp, Artificial sequence
  synthetic polynucleotide sequence
ccggtggggacaaggtca

SEQ ID NO: 3741 - DNA, 18 bp, Artificial sequence
  synthetic polynucleotide sequence
tgattggcagaaaccgga

SEQ ID NO: 3742 - DNA, 18 bp, Artificial sequence
  synthetic polynucleotide sequence
tggacctcgtgcaccaca

SEQ ID NO: 3743 - DNA, 18 bp, Artificial sequence
  synthetic polynucleotide sequence
tgattgggccaagccgaa

SEQ ID NO: 3744 - DNA, 18 bp, Artificial sequence
  synthetic polynucleotide sequence
gcaggttggagggcacga

SEQ ID NO: 3745 - DNA, 18 bp, Artificial sequence
  synthetic polynucleotide sequence
ccactacgaccccagcca

SEQ ID NO: 3746 - DNA, 18 bp, Artificial sequence
  synthetic polynucleotide sequence
gcccagctgagaagggca

SEQ ID NO: 3747 - DNA, 18 bp, Artificial sequence
  synthetic polynucleotide sequence
ggtgcagagaatgggcaa

SEQ ID NO: 3748 - DNA, 18 bp, Artificial sequence
  synthetic polynucleotide sequence
gcaggtggtacccagcca

SEQ ID NO: 3749 - DNA, 18 bp, Artificial sequence
  synthetic polynucleotide sequence
gccagctgctgaagcaga

SEQ ID NO: 3750 - DNA, 18 bp, Artificial sequence
  synthetic polynucleotide sequence
gacatggggaagctcgga

SEQ ID NO: 3751 - DNA, 18 bp, Artificial sequence
  synthetic polynucleotide sequence
ccatgggaataccccgca

SEQ ID NO: 3752 - DNA, 18 bp, Artificial sequence
  synthetic polynucleotide sequence
tggagccaaggaggggga

SEQ ID NO: 3753 - DNA, 18 bp, Artificial sequence
  synthetic polynucleotide sequence
acacagtggcagacccca

SEQ ID NO: 3754 - DNA, 18 bp, Artificial sequence
  synthetic polynucleotide sequence
caggcgctccccaacaca

SEQ ID NO: 3755 - DNA, 18 bp, Artificial sequence
  synthetic polynucleotide sequence
aggccattatggaaggca

SEQ ID NO: 3756 - DNA, 18 bp, Artificial sequence
  synthetic polynucleotide sequence
ccaggtcatcctcagaca

SEQ ID NO: 3757 - DNA, 18 bp, Artificial sequence
  synthetic polynucleotide sequence
gagaaacttgaggcggga

SEQ ID NO: 3758 - DNA, 18 bp, Artificial sequence
  synthetic polynucleotide sequence
ccatgctgtaggccccaa

SEQ ID NO: 3759 - DNA, 18 bp, Artificial sequence
  synthetic polynucleotide sequence
aggaggttcctgccgaca

SEQ ID NO: 3760 - DNA, 18 bp, Artificial sequence
  synthetic polynucleotide sequence
gcagaggtctcgtgacca

SEQ ID NO: 3761 - DNA, 18 bp, Artificial sequence
  synthetic polynucleotide sequence
agtgtggcccaacccaga

SEQ ID NO: 3762 - DNA, 18 bp, Artificial sequence
  synthetic polynucleotide sequence
tggtgggatcaggcagca

SEQ ID NO: 3763 - DNA, 18 bp, Artificial sequence
  synthetic polynucleotide sequence
ggaaccacctggaccaga

SEQ ID NO: 3764 - DNA, 18 bp, Artificial sequence
  synthetic polynucleotide sequence
tcagggaaggtgacggga

SEQ ID NO: 3765 - DNA, 18 bp, Artificial sequence
  synthetic polynucleotide sequence
gagaggaggtccgcgaga

SEQ ID NO: 3766 - DNA, 18 bp, Artificial sequence
  synthetic polynucleotide sequence
gcaggtagagaccggcca

SEQ ID NO: 3767 - DNA, 18 bp, Artificial sequence
  synthetic polynucleotide sequence
gccatgacactacagcca

SEQ ID NO: 3768 - DNA, 18 bp, Artificial sequence
  synthetic polynucleotide sequence
atgaccgggactggggga

SEQ ID NO: 3769 - DNA, 18 bp, Artificial sequence
  synthetic polynucleotide sequence
gggtcatccccaaaggca

SEQ ID NO: 3770 - DNA, 18 bp, Artificial sequence
  synthetic polynucleotide sequence
tcagggtccggccacaca

SEQ ID NO: 3771 - DNA, 18 bp, Artificial sequence
  synthetic polynucleotide sequence
cccggacaacccacagca

SEQ ID NO: 3772 - DNA, 18 bp, Artificial sequence
  synthetic polynucleotide sequence
gtgccacaaccacgcgca

SEQ ID NO: 3773 - DNA, 18 bp, Artificial sequence
  synthetic polynucleotide sequence
cgttcgcgatggcggaga

SEQ ID NO: 3774 - DNA, 18 bp, Artificial sequence
  synthetic polynucleotide sequence
cggtgtggtcaggcagga

SEQ ID NO: 3775 - DNA, 18 bp, Artificial sequence
  synthetic polynucleotide sequence
gggaggaggtcaggggca

SEQ ID NO: 3776 - DNA, 18 bp, Artificial sequence
  synthetic polynucleotide sequence
atggacgggactgcagga

SEQ ID NO: 3777 - DNA, 18 bp, Artificial sequence
  synthetic polynucleotide sequence
cctgggtgacagaaggga

SEQ ID NO: 3778 - DNA, 18 bp, Artificial sequence
  synthetic polynucleotide sequence
cctgctaccagggctgga

SEQ ID NO: 3779 - DNA, 18 bp, Artificial sequence
  synthetic polynucleotide sequence
gatgcaaggatggtcaga

SEQ ID NO: 3780 - DNA, 18 bp, Artificial sequence
  synthetic polynucleotide sequence
gtttgccacagaggccca

SEQ ID NO: 3781 - DNA, 18 bp, Artificial sequence
  synthetic polynucleotide sequence
acatccaccctgagccca

SEQ ID NO: 3782 - DNA, 18 bp, Artificial sequence
  synthetic polynucleotide sequence
agaacctcccagggcaga

SEQ ID NO: 3783 - DNA, 18 bp, Artificial sequence
  synthetic polynucleotide sequence
cggccttgtggacagcca

SEQ ID NO: 3784 - DNA, 18 bp, Artificial sequence
  synthetic polynucleotide sequence
gcatcggccgtccacgca

SEQ ID NO: 3785 - DNA, 18 bp, Artificial sequence
  synthetic polynucleotide sequence
ctgccacatgccatgaca

SEQ ID NO: 3786 - DNA, 18 bp, Artificial sequence
  synthetic polynucleotide sequence
agaccacacggagaggca

SEQ ID NO: 3787 - DNA, 18 bp, Artificial sequence
  synthetic polynucleotide sequence
ccccaacaacaaggggca

SEQ ID NO: 3788 - DNA, 18 bp, Artificial sequence
  synthetic polynucleotide sequence
aaggggtccacactcaca

SEQ ID NO: 3789 - DNA, 18 bp, Artificial sequence
  synthetic polynucleotide sequence
accgcatctcagccacca

SEQ ID NO: 3790 - DNA, 18 bp, Artificial sequence
  synthetic polynucleotide sequence
agaaggggacacgggtga

SEQ ID NO: 3791 - DNA, 19 bp, Artificial sequence
  synthetic polynucleotide sequence
gtcggcagacgagtacaga

SEQ ID NO: 3792 - DNA, 19 bp, Artificial sequence
  synthetic polynucleotide sequence
cccacaagggagacatgga

SEQ ID NO: 3793 - DNA, 18 bp, Artificial sequence
  synthetic polynucleotide sequence
gaaggacaaagcacggaa

SEQ ID NO: 3794 - DNA, 18 bp, Artificial sequence
  synthetic polynucleotide sequence
ggaccgtagtcactggga

SEQ ID NO: 3795 - DNA, 18 bp, Artificial sequence
  synthetic polynucleotide sequence
tcagcacctgcaagggga

SEQ ID NO: 3796 - DNA, 18 bp, Artificial sequence
  synthetic polynucleotide sequence
atcggtcaccaggccgga

SEQ ID NO: 3797 - DNA, 18 bp, Artificial sequence
  synthetic polynucleotide sequence
ctccctcaggcaggacca

SEQ ID NO: 3798 - DNA, 18 bp, Artificial sequence
  synthetic polynucleotide sequence
caagcattgggtgccaca

SEQ ID NO: 3799 - DNA, 18 bp, Artificial sequence
  synthetic polynucleotide sequence
tactcaaccccgtcccca

SEQ ID NO: 3800 - DNA, 18 bp, Artificial sequence
  synthetic polynucleotide sequence
tgcacaccaccggcgtga

SEQ ID NO: 3801 - DNA, 18 bp, Artificial sequence
  synthetic polynucleotide sequence
aggagcggatcccagaga

SEQ ID NO: 3802 - DNA, 18 bp, Artificial sequence
  synthetic polynucleotide sequence
gagagggagagctggaca

SEQ ID NO: 3803 - DNA, 18 bp, Artificial sequence
  synthetic polynucleotide sequence
cccacagaacaaagcgga

SEQ ID NO: 3804 - DNA, 18 bp, Artificial sequence
  synthetic polynucleotide sequence
gcaggatggtgctggcaa

SEQ ID NO: 3805 - DNA, 18 bp, Artificial sequence
  synthetic polynucleotide sequence
gcaagaagcggaagggca

SEQ ID NO: 3806 - DNA, 18 bp, Artificial sequence
  synthetic polynucleotide sequence
ggagtggtctcgggcaca

SEQ ID NO: 3807 - DNA, 18 bp, Artificial sequence
  synthetic polynucleotide sequence
ccgaccacatgccagaca

SEQ ID NO: 3808 - DNA, 18 bp, Artificial sequence
  synthetic polynucleotide sequence
tgctggacaggagacgca

SEQ ID NO: 3809 - DNA, 18 bp, Artificial sequence
  synthetic polynucleotide sequence
ggccagagcaatccagga

SEQ ID NO: 3810 - DNA, 18 bp, Artificial sequence
  synthetic polynucleotide sequence
gcagtcaggaacaggcca

SEQ ID NO: 3811 - DNA, 16 bp, Artificial sequence
  synthetic polynucleotide sequence
acatccctggctcgga

SEQ ID NO: 3812 - DNA, 18 bp, Artificial sequence
  synthetic polynucleotide sequence
gacacccctcgatcagca

SEQ ID NO: 3813 - DNA, 18 bp, Artificial sequence
  synthetic polynucleotide sequence
cgaactggcttccggcca

SEQ ID NO: 3814 - DNA, 18 bp, Artificial sequence
  synthetic polynucleotide sequence
ggctgcctccagggcaca

SEQ ID NO: 3815 - DNA, 18 bp, Artificial sequence
  synthetic polynucleotide sequence
gacaaggatgaccaggaa

SEQ ID NO: 3816 - DNA, 18 bp, Artificial sequence
  synthetic polynucleotide sequence
gggcgatgaccccagaga

SEQ ID NO: 3817 - DNA, 18 bp, Artificial sequence
  synthetic polynucleotide sequence
ggctgatgaggaggacga

SEQ ID NO: 3818 - DNA, 18 bp, Artificial sequence
  synthetic polynucleotide sequence
cattcacccacaggcgga

SEQ ID NO: 3819 - DNA, 18 bp, Artificial sequence
  synthetic polynucleotide sequence
ccggtggacaaccagcaa

SEQ ID NO: 3820 - DNA, 18 bp, Artificial sequence
  synthetic polynucleotide sequence
tcatcagcgagcgggtga

SEQ ID NO: 3821 - DNA, 18 bp, Artificial sequence
  synthetic polynucleotide sequence
ctctgtgcaaagaccgga

SEQ ID NO: 3822 - DNA, 18 bp, Artificial sequence
  synthetic polynucleotide sequence
tgaacgaccgagatcgga

SEQ ID NO: 3823 - DNA, 18 bp, Artificial sequence
  synthetic polynucleotide sequence
tggcagaagccctggcaa

SEQ ID NO: 3824 - DNA, 18 bp, Artificial sequence
  synthetic polynucleotide sequence
atccttcagggaggggca

SEQ ID NO: 3825 - DNA, 18 bp, Artificial sequence
  synthetic polynucleotide sequence
agtcctacgtcagcagca

SEQ ID NO: 3826 - DNA, 18 bp, Artificial sequence
  synthetic polynucleotide sequence
catccagctgcaggggca

SEQ ID NO: 3827 - DNA, 18 bp, Artificial sequence
  synthetic polynucleotide sequence
gagctcggctccaaggca

SEQ ID NO: 3828 - DNA, 18 bp, Artificial sequence
  synthetic polynucleotide sequence
tctggaggcagaagggca

SEQ ID NO: 3829 - DNA, 18 bp, Artificial sequence
  synthetic polynucleotide sequence
cacccaggggctgccaca

SEQ ID NO: 3830 - DNA, 18 bp, Artificial sequence
  synthetic polynucleotide sequence
accagcactgtggagcca

SEQ ID NO: 3831 - DNA, 18 bp, Artificial sequence
  synthetic polynucleotide sequence
cgtgcactactaccccca

SEQ ID NO: 3832 - DNA, 18 bp, Artificial sequence
  synthetic polynucleotide sequence
cctgagggcaggtgcaga

SEQ ID NO: 3833 - DNA, 18 bp, Artificial sequence
  synthetic polynucleotide sequence
tgagaaagctgcagagga

SEQ ID NO: 3834 - DNA, 18 bp, Artificial sequence
  synthetic polynucleotide sequence
ggccatagatgaacagca

SEQ ID NO: 3835 - DNA, 18 bp, Artificial sequence
  synthetic polynucleotide sequence
ctgccactgctgacacca

SEQ ID NO: 3836 - DNA, 18 bp, Artificial sequence
  synthetic polynucleotide sequence
gttgagaagggtggcaca

SEQ ID NO: 3837 - DNA, 18 bp, Artificial sequence
  synthetic polynucleotide sequence
cagccgacgacacagaga

SEQ ID NO: 3838 - DNA, 18 bp, Artificial sequence
  synthetic polynucleotide sequence
ccacgtagttggcaggga

SEQ ID NO: 3839 - DNA, 18 bp, Artificial sequence
  synthetic polynucleotide sequence
gaacaacgaggcagccaa

SEQ ID NO: 3840 - DNA, 18 bp, Artificial sequence
  synthetic polynucleotide sequence
gctcctggcgcacggcca

SEQ ID NO: 3841 - DNA, 18 bp, Artificial sequence
  synthetic polynucleotide sequence
aggcggatctacgctgca

SEQ ID NO: 3842 - DNA, 18 bp, Artificial sequence
  synthetic polynucleotide sequence
ggtgccacccagccacca

SEQ ID NO: 3843 - DNA, 18 bp, Artificial sequence
  synthetic polynucleotide sequence
gcctatgtggggaagcca

SEQ ID NO: 3844 - DNA, 18 bp, Artificial sequence
  synthetic polynucleotide sequence
tccattgccagacggcga

SEQ ID NO: 3845 - DNA, 18 bp, Artificial sequence
  synthetic polynucleotide sequence
gcttgcccaaagaagcca

SEQ ID NO: 3846 - DNA, 18 bp, Artificial sequence
  synthetic polynucleotide sequence
aacccgtccactaaggca

SEQ ID NO: 3847 - DNA, 18 bp, Artificial sequence
  synthetic polynucleotide sequence
cagttcgtgggacgggaa

SEQ ID NO: 3848 - DNA, 18 bp, Artificial sequence
  synthetic polynucleotide sequence
gattggggcactggggca

SEQ ID NO: 3849 - DNA, 18 bp, Artificial sequence
  synthetic polynucleotide sequence
cccgtgcatgtgaacgaa

SEQ ID NO: 3850 - DNA, 18 bp, Artificial sequence
  synthetic polynucleotide sequence
gcaggtggccatgacgga

SEQ ID NO: 3851 - DNA, 18 bp, Artificial sequence
  synthetic polynucleotide sequence
atgtcagggcaccccaca

SEQ ID NO: 3852 - DNA, 18 bp, Artificial sequence
  synthetic polynucleotide sequence
ggcctgggctgaggagca

SEQ ID NO: 3853 - DNA, 18 bp, Artificial sequence
  synthetic polynucleotide sequence
cctcacaccagtcagcca

SEQ ID NO: 3854 - DNA, 18 bp, Artificial sequence
  synthetic polynucleotide sequence
gggatggcgctcacgaca

SEQ ID NO: 3855 - DNA, 18 bp, Artificial sequence
  synthetic polynucleotide sequence
gtccatgcaggaggcaca

SEQ ID NO: 3856 - DNA, 18 bp, Artificial sequence
  synthetic polynucleotide sequence
agggtcagggtcagcaca

SEQ ID NO: 3857 - DNA, 18 bp, Artificial sequence
  synthetic polynucleotide sequence
ggaatcactgctggagca

SEQ ID NO: 3858 - DNA, 18 bp, Artificial sequence
  synthetic polynucleotide sequence
actgcatggatgcggcca

SEQ ID NO: 3859 - DNA, 18 bp, Artificial sequence
  synthetic polynucleotide sequence
tctggccaacacgcctca

SEQ ID NO: 3860 - DNA, 18 bp, Artificial sequence
  synthetic polynucleotide sequence
ccaggtgggcagaagtca

SEQ ID NO: 3861 - DNA, 18 bp, Artificial sequence
  synthetic polynucleotide sequence
caggttgaccccacagca

SEQ ID NO: 3862 - DNA, 18 bp, Artificial sequence
  synthetic polynucleotide sequence
aacaccttaggctgcaca

SEQ ID NO: 3863 - DNA, 18 bp, Artificial sequence
  synthetic polynucleotide sequence
ccggatgaagggagacca

SEQ ID NO: 3864 - DNA, 18 bp, Artificial sequence
  synthetic polynucleotide sequence
gcctagggtcacactcca

SEQ ID NO: 3865 - DNA, 18 bp, Artificial sequence
  synthetic polynucleotide sequence
gatggcaacaaccacaga

SEQ ID NO: 3866 - DNA, 18 bp, Artificial sequence
  synthetic polynucleotide sequence
tccaaccacaagggccca

SEQ ID NO: 3867 - DNA, 18 bp, Artificial sequence
  synthetic polynucleotide sequence
gccacattcagccgccaa

SEQ ID NO: 3868 - DNA, 18 bp, Artificial sequence
  synthetic polynucleotide sequence
tgtgaccaataggggcca

SEQ ID NO: 3869 - DNA, 18 bp, Artificial sequence
  synthetic polynucleotide sequence
gcgaatgccagggacaga

SEQ ID NO: 3870 - DNA, 18 bp, Artificial sequence
  synthetic polynucleotide sequence
gccagttcctccagagca

SEQ ID NO: 3871 - DNA, 18 bp, Artificial sequence
  synthetic polynucleotide sequence
acccagccaagaccacca

SEQ ID NO: 3872 - DNA, 18 bp, Artificial sequence
  synthetic polynucleotide sequence
ggttcctgccaaccgcca

SEQ ID NO: 3873 - DNA, 18 bp, Artificial sequence
  synthetic polynucleotide sequence
tcccccagggaacgggca

SEQ ID NO: 3874 - DNA, 18 bp, Artificial sequence
  synthetic polynucleotide sequence
agagcactgctagcggca

SEQ ID NO: 3875 - DNA, 18 bp, Artificial sequence
  synthetic polynucleotide sequence
ccagctctctacccccaa

SEQ ID NO: 3876 - DNA, 18 bp, Artificial sequence
  synthetic polynucleotide sequence
catccaaggacagaggca

SEQ ID NO: 3877 - DNA, 18 bp, Artificial sequence
  synthetic polynucleotide sequence
ccaagggtgccctggaca

SEQ ID NO: 3878 - DNA, 18 bp, Artificial sequence
  synthetic polynucleotide sequence
cctggcccatggacgtca

SEQ ID NO: 3879 - DNA, 18 bp, Artificial sequence
  synthetic polynucleotide sequence
accgctacgacaaactca

SEQ ID NO: 3880 - DNA, 18 bp, Artificial sequence
  synthetic polynucleotide sequence
ccggggttcggtgcagca

SEQ ID NO: 3881 - DNA, 18 bp, Artificial sequence
  synthetic polynucleotide sequence
caaaaggctgtccgggca

SEQ ID NO: 3882 - DNA, 18 bp, Artificial sequence
  synthetic polynucleotide sequence
ggcacaccaggcaaccca

SEQ ID NO: 3883 - DNA, 18 bp, Artificial sequence
  synthetic polynucleotide sequence
aggatagcgctgccacca

SEQ ID NO: 3884 - DNA, 18 bp, Artificial sequence
  synthetic polynucleotide sequence
gggtggaagtctcaccca

SEQ ID NO: 3885 - DNA, 18 bp, Artificial sequence
  synthetic polynucleotide sequence
tgtgggccgatacccaga

SEQ ID NO: 3886 - DNA, 18 bp, Artificial sequence
  synthetic polynucleotide sequence
aacccattgcagaggcca

SEQ ID NO: 3887 - DNA, 18 bp, Artificial sequence
  synthetic polynucleotide sequence
ttgccaccctggggacca

SEQ ID NO: 3888 - DNA, 18 bp, Artificial sequence
  synthetic polynucleotide sequence
gtgccggaactcagggca

SEQ ID NO: 3889 - DNA, 18 bp, Artificial sequence
  synthetic polynucleotide sequence
ggagccagaaccagcaga

SEQ ID NO: 3890 - DNA, 18 bp, Artificial sequence
  synthetic polynucleotide sequence
tgagccagggagctctga

SEQ ID NO: 3891 - DNA, 18 bp, Artificial sequence
  synthetic polynucleotide sequence
agctggcactcgacccca

SEQ ID NO: 3892 - DNA, 18 bp, Artificial sequence
  synthetic polynucleotide sequence
gaagggagagttggcgga

SEQ ID NO: 3893 - DNA, 18 bp, Artificial sequence
  synthetic polynucleotide sequence
ccggctaggctacacaca

SEQ ID NO: 3894 - DNA, 18 bp, Artificial sequence
  synthetic polynucleotide sequence
gtagtaggggtaggccga

SEQ ID NO: 3895 - DNA, 18 bp, Artificial sequence
  synthetic polynucleotide sequence
tgggcagctcaccgacga

SEQ ID NO: 3896 - DNA, 18 bp, Artificial sequence
  synthetic polynucleotide sequence
tcctctgccaggaaccga

SEQ ID NO: 3897 - DNA, 18 bp, Artificial sequence
  synthetic polynucleotide sequence
cgagatctggccacacga

SEQ ID NO: 3898 - DNA, 18 bp, Artificial sequence
  synthetic polynucleotide sequence
cccaagacatccagcgga

SEQ ID NO: 3899 - DNA, 18 bp, Artificial sequence
  synthetic polynucleotide sequence
aggacaaccgcagccaca

SEQ ID NO: 3900 - DNA, 18 bp, Artificial sequence
  synthetic polynucleotide sequence
gccaggactccaagggga

SEQ ID NO: 3901 - DNA, 18 bp, Artificial sequence
  synthetic polynucleotide sequence
cctgaggatgccaacaca

SEQ ID NO: 3902 - DNA, 18 bp, Artificial sequence
  synthetic polynucleotide sequence
gaagaagctgctgcacca

SEQ ID NO: 3903 - DNA, 18 bp, Artificial sequence
  synthetic polynucleotide sequence
ggaaggctctggtggaga

SEQ ID NO: 3904 - DNA, 18 bp, Artificial sequence
  synthetic polynucleotide sequence
atcgctggtccaggagca

SEQ ID NO: 3905 - DNA, 18 bp, Artificial sequence
  synthetic polynucleotide sequence
ggagcacaagcaggccaa

SEQ ID NO: 3906 - DNA, 18 bp, Artificial sequence
  synthetic polynucleotide sequence
gctccataagtgccagca

SEQ ID NO: 3907 - DNA, 18 bp, Artificial sequence
  synthetic polynucleotide sequence
aagtcagcccaggaagca

SEQ ID NO: 3908 - DNA, 18 bp, Artificial sequence
  synthetic polynucleotide sequence
gatcaacgaagggaggca

SEQ ID NO: 3909 - DNA, 18 bp, Artificial sequence
  synthetic polynucleotide sequence
ctgggctgtgacaggcaa

SEQ ID NO: 3910 - DNA, 18 bp, Artificial sequence
  synthetic polynucleotide sequence
atctgggggagtgacaca

SEQ ID NO: 3911 - DNA, 18 bp, Artificial sequence
  synthetic polynucleotide sequence
tgccacgtccgtagacca

SEQ ID NO: 3912 - DNA, 18 bp, Artificial sequence
  synthetic polynucleotide sequence
ggccacagagagctgcca

SEQ ID NO: 3913 - DNA, 18 bp, Artificial sequence
  synthetic polynucleotide sequence
ctgaccgtggagcagcga

SEQ ID NO: 3914 - DNA, 18 bp, Artificial sequence
  synthetic polynucleotide sequence
acatcaatccctcgggca

SEQ ID NO: 3915 - DNA, 18 bp, Artificial sequence
  synthetic polynucleotide sequence
ggactggtccctcaggaa

SEQ ID NO: 3916 - DNA, 18 bp, Artificial sequence
  synthetic polynucleotide sequence
acaaccagctccacacca

SEQ ID NO: 3917 - DNA, 18 bp, Artificial sequence
  synthetic polynucleotide sequence
cagcaagaggactggaca

SEQ ID NO: 3918 - DNA, 18 bp, Artificial sequence
  synthetic polynucleotide sequence
aatgaggttgccaggcca

SEQ ID NO: 3919 - DNA, 18 bp, Artificial sequence
  synthetic polynucleotide sequence
cagagagagcgggagcaa

SEQ ID NO: 3920 - DNA, 18 bp, Artificial sequence
  synthetic polynucleotide sequence
caacgaccagtacgccca

SEQ ID NO: 3921 - DNA, 18 bp, Artificial sequence
  synthetic polynucleotide sequence
gctcgggaaacacaggca

SEQ ID NO: 3922 - DNA, 18 bp, Artificial sequence
  synthetic polynucleotide sequence
aatgcagcacctgcagca

SEQ ID NO: 3923 - DNA, 18 bp, Artificial sequence
  synthetic polynucleotide sequence
gcagtaccaaaacaggca

SEQ ID NO: 3924 - DNA, 18 bp, Artificial sequence
  synthetic polynucleotide sequence
acccctggaacgacctga

SEQ ID NO: 3925 - DNA, 18 bp, Artificial sequence
  synthetic polynucleotide sequence
ggaggatcttcaggccca

SEQ ID NO: 3926 - DNA, 18 bp, Artificial sequence
  synthetic polynucleotide sequence
cactgacgcatcaagaga

SEQ ID NO: 3927 - DNA, 18 bp, Artificial sequence
  synthetic polynucleotide sequence
ctcagcagcaagcacaga

SEQ ID NO: 3928 - DNA, 18 bp, Artificial sequence
  synthetic polynucleotide sequence
gtggaggtcacatccgaa

SEQ ID NO: 3929 - DNA, 18 bp, Artificial sequence
  synthetic polynucleotide sequence
cgacacatggcagcgaga

SEQ ID NO: 3930 - DNA, 18 bp, Artificial sequence
  synthetic polynucleotide sequence
tgggtgcaacgtacacga

SEQ ID NO: 3931 - DNA, 18 bp, Artificial sequence
  synthetic polynucleotide sequence
actcccaccaaagcggca

SEQ ID NO: 3932 - DNA, 18 bp, Artificial sequence
  synthetic polynucleotide sequence
tgagcaaggagttgacca

SEQ ID NO: 3933 - DNA, 18 bp, Artificial sequence
  synthetic polynucleotide sequence
ggcacagccttcgtgaca

SEQ ID NO: 3934 - DNA, 18 bp, Artificial sequence
  synthetic polynucleotide sequence
cctgaaccagtctcagca

SEQ ID NO: 3935 - DNA, 18 bp, Artificial sequence
  synthetic polynucleotide sequence
gcgcagcaggagaaggaa

SEQ ID NO: 3936 - DNA, 18 bp, Artificial sequence
  synthetic polynucleotide sequence
gagctgctggtgaccgga

SEQ ID NO: 3937 - DNA, 18 bp, Artificial sequence
  synthetic polynucleotide sequence
gctctgcagagagggcga

SEQ ID NO: 3938 - DNA, 18 bp, Artificial sequence
  synthetic polynucleotide sequence
ccgggcacacttgggaca

SEQ ID NO: 3939 - DNA, 19 bp, Artificial sequence
  synthetic polynucleotide sequence
gaagacctgggacagagga

SEQ ID NO: 3940 - DNA, 17 bp, Artificial sequence
  synthetic polynucleotide sequence
gcagggccaccaggaga

SEQ ID NO: 3941 - DNA, 17 bp, Artificial sequence
  synthetic polynucleotide sequence
gaccccagccatgagga

SEQ ID NO: 3942 - DNA, 19 bp, Artificial sequence
  synthetic polynucleotide sequence
catgcaagggaaacaacca

SEQ ID NO: 3943 - DNA, 18 bp, Artificial sequence
  synthetic polynucleotide sequence
ggccagaagaccaggaca

SEQ ID NO: 3944 - DNA, 18 bp, Artificial sequence
  synthetic polynucleotide sequence
aggcagttcccaacacga

SEQ ID NO: 3945 - DNA, 18 bp, Artificial sequence
  synthetic polynucleotide sequence
ggcaagagccacctgcta

SEQ ID NO: 3946 - DNA, 18 bp, Artificial sequence
  synthetic polynucleotide sequence
gatttcacacaccccgga

SEQ ID NO: 3947 - DNA, 18 bp, Artificial sequence
  synthetic polynucleotide sequence
gcctagcagctatgagga

SEQ ID NO: 3948 - DNA, 18 bp, Artificial sequence
  synthetic polynucleotide sequence
gcagctgagcacagcaca

SEQ ID NO: 3949 - DNA, 19 bp, Artificial sequence
  synthetic polynucleotide sequence
ggaagaaatgtcgcagcca

SEQ ID NO: 3950 - DNA, 18 bp, Artificial sequence
  synthetic polynucleotide sequence
cgactctagggaccagca

SEQ ID NO: 3951 - DNA, 18 bp, Artificial sequence
  synthetic polynucleotide sequence
tcagggtgccaggcagga

SEQ ID NO: 3952 - DNA, 18 bp, Artificial sequence
  synthetic polynucleotide sequence
tccccgaccaagcttgca

SEQ ID NO: 3953 - DNA, 18 bp, Artificial sequence
  synthetic polynucleotide sequence
accccagccaagaatgca

SEQ ID NO: 3954 - DNA, 18 bp, Artificial sequence
  synthetic polynucleotide sequence
ccgacagcatttcagaga

SEQ ID NO: 3955 - DNA, 17 bp, Artificial sequence
  synthetic polynucleotide sequence
tccaagccaggacagca

SEQ ID NO: 3956 - DNA, 19 bp, Artificial sequence
  synthetic polynucleotide sequence
cccactgatatcgcagcca

SEQ ID NO: 3957 - DNA, 18 bp, Artificial sequence
  synthetic polynucleotide sequence
ggggcaaattcaaggaga

SEQ ID NO: 3958 - DNA, 18 bp, Artificial sequence
  synthetic polynucleotide sequence
gttgatgccccagaggca

SEQ ID NO: 3959 - DNA, 20 bp, Artificial sequence
  synthetic polynucleotide sequence
ggacttgaggagagagtgca

SEQ ID NO: 3960 - DNA, 20 bp, Artificial sequence
  synthetic polynucleotide sequence
gcaagcagcaatgagttcca

SEQ ID NO: 3961 - DNA, 18 bp, Artificial sequence
  synthetic polynucleotide sequence
caatggcaagagccgaga

SEQ ID NO: 3962 - DNA, 21 bp, Artificial sequence
  synthetic polynucleotide sequence
cacagaaagtttcaggcagca

SEQ ID NO: 3963 - DNA, 18 bp, Artificial sequence
  synthetic polynucleotide sequence
ctggaacagatcagggca

SEQ ID NO: 3964 - DNA, 18 bp, Artificial sequence
  synthetic polynucleotide sequence
gtgggagatgtcgcagga

SEQ ID NO: 3965 - DNA, 18 bp, Artificial sequence
  synthetic polynucleotide sequence
aaacgccacatccttcga

SEQ ID NO: 3966 - DNA, 18 bp, Artificial sequence
  synthetic polynucleotide sequence
ggactggaggcagcagga

SEQ ID NO: 3967 - DNA, 18 bp, Artificial sequence
  synthetic polynucleotide sequence
tatactcgacgaccagca

SEQ ID NO: 3968 - DNA, 18 bp, Artificial sequence
  synthetic polynucleotide sequence
gggagtagtggcctcaga

SEQ ID NO: 3969 - DNA, 18 bp, Artificial sequence
  synthetic polynucleotide sequence
gaaaggggtgtgcagaga

SEQ ID NO: 3970 - DNA, 18 bp, Artificial sequence
  synthetic polynucleotide sequence
gggctcaagtatccacca

SEQ ID NO: 3971 - DNA, 18 bp, Artificial sequence
  synthetic polynucleotide sequence
gtgagtaacaccccagga

SEQ ID NO: 3972 - DNA, 18 bp, Artificial sequence
  synthetic polynucleotide sequence
gcaggaaggagtagctga

SEQ ID NO: 3973 - DNA, 17 bp, Artificial sequence
  synthetic polynucleotide sequence
gggatccagtgctggca

SEQ ID NO: 3974 - DNA, 19 bp, Artificial sequence
  synthetic polynucleotide sequence
cctttgacacagcactcca

SEQ ID NO: 3975 - DNA, 18 bp, Artificial sequence
  synthetic polynucleotide sequence
aggtagaagtggacccaa

SEQ ID NO: 3976 - DNA, 18 bp, Artificial sequence
  synthetic polynucleotide sequence
gccggcaagtaccttgca

SEQ ID NO: 3977 - DNA, 18 bp, Artificial sequence
  synthetic polynucleotide sequence
gccttaagagtggagcca

SEQ ID NO: 3978 - DNA, 18 bp, Artificial sequence
  synthetic polynucleotide sequence
tgttccagggagaccaca

SEQ ID NO: 3979 - DNA, 18 bp, Artificial sequence
  synthetic polynucleotide sequence
cctggcaaagtatccaga

SEQ ID NO: 3980 - DNA, 18 bp, Artificial sequence
  synthetic polynucleotide sequence
aaggcagcattgtgggca

SEQ ID NO: 3981 - DNA, 18 bp, Artificial sequence
  synthetic polynucleotide sequence
cacaaggaaaggggcaga

SEQ ID NO: 3982 - DNA, 18 bp, Artificial sequence
  synthetic polynucleotide sequence
agccactgaactgaccca

SEQ ID NO: 3983 - DNA, 19 bp, Artificial sequence
  synthetic polynucleotide sequence
catggacagccctatggaa

SEQ ID NO: 3984 - DNA, 19 bp, Artificial sequence
  synthetic polynucleotide sequence
tgatcccctgaccaagaga

SEQ ID NO: 3985 - DNA, 18 bp, Artificial sequence
  synthetic polynucleotide sequence
ggccccttggataaggaa

SEQ ID NO: 3986 - DNA, 18 bp, Artificial sequence
  synthetic polynucleotide sequence
gggacttggaaggtgcca

SEQ ID NO: 3987 - DNA, 18 bp, Artificial sequence
  synthetic polynucleotide sequence
ccggaacatcggcaagga

SEQ ID NO: 3988 - DNA, 18 bp, Artificial sequence
  synthetic polynucleotide sequence
tgatggggcagtcagcca

SEQ ID NO: 3989 - DNA, 18 bp, Artificial sequence
  synthetic polynucleotide sequence
gcagtgagagtaccagca

SEQ ID NO: 3990 - DNA, 18 bp, Artificial sequence
  synthetic polynucleotide sequence
cacccagagaagcagaga

SEQ ID NO: 3991 - DNA, 18 bp, Artificial sequence
  synthetic polynucleotide sequence
tcaaggaacagcagggga

SEQ ID NO: 3992 - DNA, 19 bp, Artificial sequence
  synthetic polynucleotide sequence
caaaagttgcaaggccaca

SEQ ID NO: 3993 - DNA, 18 bp, Artificial sequence
  synthetic polynucleotide sequence
gcaatgggtacgaggtca

SEQ ID NO: 3994 - DNA, 18 bp, Artificial sequence
  synthetic polynucleotide sequence
cttccagcaagaagctca

SEQ ID NO: 3995 - DNA, 18 bp, Artificial sequence
  synthetic polynucleotide sequence
tgaggatgatggcaagga

SEQ ID NO: 3996 - DNA, 18 bp, Artificial sequence
  synthetic polynucleotide sequence
acacaagatgcaacggga

SEQ ID NO: 3997 - DNA, 18 bp, Artificial sequence
  synthetic polynucleotide sequence
gacgaggacgagtggcaa

SEQ ID NO: 3998 - DNA, 18 bp, Artificial sequence
  synthetic polynucleotide sequence
atcatgcgatccgagcga

SEQ ID NO: 3999 - DNA, 18 bp, Artificial sequence
  synthetic polynucleotide sequence
tcagacctgacccaggca

SEQ ID NO: 4000 - DNA, 18 bp, Artificial sequence
  synthetic polynucleotide sequence
cgcaggtgtaggactgga

SEQ ID NO: 4001 - DNA, 18 bp, Artificial sequence
  synthetic polynucleotide sequence
cagcggctgcagcacaca

SEQ ID NO: 4002 - DNA, 18 bp, Artificial sequence
  synthetic polynucleotide sequence
atgtggctcgccagcgca

SEQ ID NO: 4003 - DNA, 18 bp, Artificial sequence
  synthetic polynucleotide sequence
acagctgtgagagccgga

SEQ ID NO: 4004 - DNA, 18 bp, Artificial sequence
  synthetic polynucleotide sequence
agccgaggacccgcagga

SEQ ID NO: 4005 - DNA, 18 bp, Artificial sequence
  synthetic polynucleotide sequence
cctgagccacaacagaca

SEQ ID NO: 4006 - DNA, 18 bp, Artificial sequence
  synthetic polynucleotide sequence
cccaccctgtaagctgca

SEQ ID NO: 4007 - DNA, 18 bp, Artificial sequence
  synthetic polynucleotide sequence
ccagaccagacaggcaca

SEQ ID NO: 4008 - DNA, 18 bp, Artificial sequence
  synthetic polynucleotide sequence
gcctcgccagcatccaca

SEQ ID NO: 4009 - DNA, 18 bp, Artificial sequence
  synthetic polynucleotide sequence
agtggatggtccccacca

SEQ ID NO: 4010 - DNA, 18 bp, Artificial sequence
  synthetic polynucleotide sequence
agccacggcattcaggca

SEQ ID NO: 4011 - DNA, 18 bp, Artificial sequence
  synthetic polynucleotide sequence
cacctgccatggagggga

SEQ ID NO: 4012 - DNA, 18 bp, Artificial sequence
  synthetic polynucleotide sequence
gccatctgggtccagaca

SEQ ID NO: 4013 - DNA, 18 bp, Artificial sequence
  synthetic polynucleotide sequence
gtcacctggtccaggcca

SEQ ID NO: 4014 - DNA, 18 bp, Artificial sequence
  synthetic polynucleotide sequence
ggcttgacgggggacaca

SEQ ID NO: 4015 - DNA, 18 bp, Artificial sequence
  synthetic polynucleotide sequence
accgctggatctgagcaa

SEQ ID NO: 4016 - DNA, 18 bp, Artificial sequence
  synthetic polynucleotide sequence
attgcaccctccagccca

SEQ ID NO: 4017 - DNA, 18 bp, Artificial sequence
  synthetic polynucleotide sequence
cggtggggaactcagaga

SEQ ID NO: 4018 - DNA, 18 bp, Artificial sequence
  synthetic polynucleotide sequence
ttggcggacacgcagcca

SEQ ID NO: 4019 - DNA, 18 bp, Artificial sequence
  synthetic polynucleotide sequence
ctcccaggctgcagagga

SEQ ID NO: 4020 - DNA, 18 bp, Artificial sequence
  synthetic polynucleotide sequence
attcagggcatgggagca

SEQ ID NO: 4021 - DNA, 18 bp, Artificial sequence
  synthetic polynucleotide sequence
gctctccatcgaaggcaa

SEQ ID NO: 4022 - DNA, 18 bp, Artificial sequence
  synthetic polynucleotide sequence
gggtgccagcagcctgga

SEQ ID NO: 4023 - DNA, 18 bp, Artificial sequence
  synthetic polynucleotide sequence
tctgggagctccaggaca

SEQ ID NO: 4024 - DNA, 18 bp, Artificial sequence
  synthetic polynucleotide sequence
ggtcagcttcaggaggga

SEQ ID NO: 4025 - DNA, 18 bp, Artificial sequence
  synthetic polynucleotide sequence
agcagcgggagctccaca

SEQ ID NO: 4026 - DNA, 18 bp, Artificial sequence
  synthetic polynucleotide sequence
ccagacacagtcgcccca

SEQ ID NO: 4027 - DNA, 18 bp, Artificial sequence
  synthetic polynucleotide sequence
gaggtgacagtctacgca

SEQ ID NO: 4028 - DNA, 18 bp, Artificial sequence
  synthetic polynucleotide sequence
gcaatcagctcctggaga

SEQ ID NO: 4029 - DNA, 18 bp, Artificial sequence
  synthetic polynucleotide sequence
acctccacaaggagctca

SEQ ID NO: 4030 - DNA, 18 bp, Artificial sequence
  synthetic polynucleotide sequence
actgccaccaactatcca

SEQ ID NO: 4031 - DNA, 18 bp, Artificial sequence
  synthetic polynucleotide sequence
cggaaagggctgcgggaa

SEQ ID NO: 4032 - DNA, 18 bp, Artificial sequence
  synthetic polynucleotide sequence
ggccactcggtctccaca

SEQ ID NO: 4033 - DNA, 18 bp, Artificial sequence
  synthetic polynucleotide sequence
gcactcacccaaggccga

SEQ ID NO: 4034 - DNA, 18 bp, Artificial sequence
  synthetic polynucleotide sequence
ccgtgtacagctgcacca

SEQ ID NO: 4035 - DNA, 18 bp, Artificial sequence
  synthetic polynucleotide sequence
catcaacacagcccagga

SEQ ID NO: 4036 - DNA, 18 bp, Artificial sequence
  synthetic polynucleotide sequence
aagaccagggaggcgtca

SEQ ID NO: 4037 - DNA, 18 bp, Artificial sequence
  synthetic polynucleotide sequence
gacagaactgctgaagga

SEQ ID NO: 4038 - DNA, 18 bp, Artificial sequence
  synthetic polynucleotide sequence
tccacatcccgaaggcca

SEQ ID NO: 4039 - DNA, 18 bp, Artificial sequence
  synthetic polynucleotide sequence
atgtggacgatgggcaca

SEQ ID NO: 4040 - DNA, 18 bp, Artificial sequence
  synthetic polynucleotide sequence
gtcagcgcagtgacggca

SEQ ID NO: 4041 - DNA, 18 bp, Artificial sequence
  synthetic polynucleotide sequence
agccctgctgctgagcca

SEQ ID NO: 4042 - DNA, 18 bp, Artificial sequence
  synthetic polynucleotide sequence
tgtagacacccagcgcca

SEQ ID NO: 4043 - DNA, 18 bp, Artificial sequence
  synthetic polynucleotide sequence
catcaacaccctgggcca

SEQ ID NO: 4044 - DNA, 18 bp, Artificial sequence
  synthetic polynucleotide sequence
gacagtccagcagcccca

SEQ ID NO: 4045 - DNA, 18 bp, Artificial sequence
  synthetic polynucleotide sequence
gctctggatggacaagga

SEQ ID NO: 4046 - DNA, 18 bp, Artificial sequence
  synthetic polynucleotide sequence
agacacgatgccagcaca

SEQ ID NO: 4047 - DNA, 18 bp, Artificial sequence
  synthetic polynucleotide sequence
tgaaggccccagccctga

SEQ ID NO: 4048 - DNA, 18 bp, Artificial sequence
  synthetic polynucleotide sequence
tggaagacacgatcacca

SEQ ID NO: 4049 - DNA, 18 bp, Artificial sequence
  synthetic polynucleotide sequence
cccacaagatgacaacca

SEQ ID NO: 4050 - DNA, 18 bp, Artificial sequence
  synthetic polynucleotide sequence
ggttatccaccaggccca

SEQ ID NO: 4051 - DNA, 18 bp, Artificial sequence
  synthetic polynucleotide sequence
ggacaccaccacagccca

SEQ ID NO: 4052 - DNA, 18 bp, Artificial sequence
  synthetic polynucleotide sequence
aggctgaagaagagccca

SEQ ID NO: 4053 - DNA, 18 bp, Artificial sequence
  synthetic polynucleotide sequence
cccactgactggctgaca

SEQ ID NO: 4054 - DNA, 18 bp, Artificial sequence
  synthetic polynucleotide sequence
ggagtatagccccctcca

SEQ ID NO: 4055 - DNA, 18 bp, Artificial sequence
  synthetic polynucleotide sequence
aagccacgtgaccgccaa

SEQ ID NO: 4056 - DNA, 18 bp, Artificial sequence
  synthetic polynucleotide sequence
ccagacgggtggcccaga

SEQ ID NO: 4057 - DNA, 18 bp, Artificial sequence
  synthetic polynucleotide sequence
ggccaagaaagccgcaga

SEQ ID NO: 4058 - DNA, 18 bp, Artificial sequence
  synthetic polynucleotide sequence
gtctgcggacatcaggga

SEQ ID NO: 4059 - DNA, 18 bp, Artificial sequence
  synthetic polynucleotide sequence
tccgtgtacgcaaggcca

SEQ ID NO: 4060 - DNA, 18 bp, Artificial sequence
  synthetic polynucleotide sequence
agccacctccagaagcca

SEQ ID NO: 4061 - DNA, 18 bp, Artificial sequence
  synthetic polynucleotide sequence
tctaccagctgggaagga

SEQ ID NO: 4062 - DNA, 18 bp, Artificial sequence
  synthetic polynucleotide sequence
ggccgtctccacaatgca

SEQ ID NO: 4063 - DNA, 18 bp, Artificial sequence
  synthetic polynucleotide sequence
tgacagcggcagtgacca

SEQ ID NO: 4064 - DNA, 18 bp, Artificial sequence
  synthetic polynucleotide sequence
gtccgtggatgaagcgca

SEQ ID NO: 4065 - DNA, 18 bp, Artificial sequence
  synthetic polynucleotide sequence
aactgcgacggaagccga

SEQ ID NO: 4066 - DNA, 18 bp, Artificial sequence
  synthetic polynucleotide sequence
aggagggactggagggca

SEQ ID NO: 4067 - DNA, 18 bp, Artificial sequence
  synthetic polynucleotide sequence
tagtgaaggtgacccgga

SEQ ID NO: 4068 - DNA, 18 bp, Artificial sequence
  synthetic polynucleotide sequence
agccagctccaacagcca

SEQ ID NO: 4069 - DNA, 18 bp, Artificial sequence
  synthetic polynucleotide sequence
acccagagggaccagcaa

SEQ ID NO: 4070 - DNA, 18 bp, Artificial sequence
  synthetic polynucleotide sequence
gcccataacgcaccacca

SEQ ID NO: 4071 - DNA, 18 bp, Artificial sequence
  synthetic polynucleotide sequence
ccggacactgatcgacca

SEQ ID NO: 4072 - DNA, 18 bp, Artificial sequence
  synthetic polynucleotide sequence
aactccacaagccaccga

SEQ ID NO: 4073 - DNA, 20 bp, Artificial sequence
  synthetic polynucleotide sequence
gccaagacatgaagtaccca

SEQ ID NO: 4074 - DNA, 18 bp, Artificial sequence
  synthetic polynucleotide sequence
atggctgcccggagacca

SEQ ID NO: 4075 - DNA, 18 bp, Artificial sequence
  synthetic polynucleotide sequence
cccgtcaagccaacagga

SEQ ID NO: 4076 - DNA, 18 bp, Artificial sequence
  synthetic polynucleotide sequence
tggcaggaacagcagcca

SEQ ID NO: 4077 - DNA, 18 bp, Artificial sequence
  synthetic polynucleotide sequence
gtactgcctgcgaagaga

SEQ ID NO: 4078 - DNA, 18 bp, Artificial sequence
  synthetic polynucleotide sequence
tgagcattccgggagcca

SEQ ID NO: 4079 - DNA, 18 bp, Artificial sequence
  synthetic polynucleotide sequence
agaaccagccccagccca

SEQ ID NO: 4080 - DNA, 18 bp, Artificial sequence
  synthetic polynucleotide sequence
agtccaggattggggcca

SEQ ID NO: 4081 - DNA, 18 bp, Artificial sequence
  synthetic polynucleotide sequence
ctccagagggagacacga

SEQ ID NO: 4082 - DNA, 18 bp, Artificial sequence
  synthetic polynucleotide sequence
ggtgcgatcctcccacca

SEQ ID NO: 4083 - DNA, 18 bp, Artificial sequence
  synthetic polynucleotide sequence
agcgactagaggacacga

SEQ ID NO: 4084 - DNA, 18 bp, Artificial sequence
  synthetic polynucleotide sequence
tgggctgcctgcaggcga

SEQ ID NO: 4085 - DNA, 18 bp, Artificial sequence
  synthetic polynucleotide sequence
tgagggagccacatgcca

SEQ ID NO: 4086 - DNA, 18 bp, Artificial sequence
  synthetic polynucleotide sequence
gcccagccatctgatgga

SEQ ID NO: 4087 - DNA, 18 bp, Artificial sequence
  synthetic polynucleotide sequence
ctcggtcatcagagccca

SEQ ID NO: 4088 - DNA, 18 bp, Artificial sequence
  synthetic polynucleotide sequence
cgatgtccaccacgacca

SEQ ID NO: 4089 - DNA, 18 bp, Artificial sequence
  synthetic polynucleotide sequence
ggcagccaggtcaaggaa

SEQ ID NO: 4090 - DNA, 18 bp, Artificial sequence
  synthetic polynucleotide sequence
taagtacagtcagcccca

SEQ ID NO: 4091 - DNA, 18 bp, Artificial sequence
  synthetic polynucleotide sequence
ggaccatctacgagagca

SEQ ID NO: 4092 - DNA, 18 bp, Artificial sequence
  synthetic polynucleotide sequence
ccagaacgaaccctccga

SEQ ID NO: 4093 - DNA, 18 bp, Artificial sequence
  synthetic polynucleotide sequence
gtgcgcagaggacgagga

SEQ ID NO: 4094 - DNA, 18 bp, Artificial sequence
  synthetic polynucleotide sequence
gggcagcacatagcgtga

SEQ ID NO: 4095 - DNA, 18 bp, Artificial sequence
  synthetic polynucleotide sequence
gaagcgctgccaccgaga

SEQ ID NO: 4096 - DNA, 18 bp, Artificial sequence
  synthetic polynucleotide sequence
tccagagccgggatgtga

SEQ ID NO: 4097 - DNA, 18 bp, Artificial sequence
  synthetic polynucleotide sequence
gatggagccttggaccga

SEQ ID NO: 4098 - DNA, 18 bp, Artificial sequence
  synthetic polynucleotide sequence
ggacctctctgggcagca

SEQ ID NO: 4099 - DNA, 18 bp, Artificial sequence
  synthetic polynucleotide sequence
ctgctccagaagagggca

SEQ ID NO: 4100 - DNA, 18 bp, Artificial sequence
  synthetic polynucleotide sequence
cacagtagtccagggcca

SEQ ID NO: 4101 - DNA, 18 bp, Artificial sequence
  synthetic polynucleotide sequence
gccacctccagatcgaca

SEQ ID NO: 4102 - DNA, 18 bp, Artificial sequence
  synthetic polynucleotide sequence
tgaatggatgccaccaca

SEQ ID NO: 4103 - DNA, 18 bp, Artificial sequence
  synthetic polynucleotide sequence
ccctgaaggcacaagaga

SEQ ID NO: 4104 - DNA, 18 bp, Artificial sequence
  synthetic polynucleotide sequence
ttggaggaacagcggcca

SEQ ID NO: 4105 - DNA, 18 bp, Artificial sequence
  synthetic polynucleotide sequence
cccctcactctggaagca

SEQ ID NO: 4106 - DNA, 18 bp, Artificial sequence
  synthetic polynucleotide sequence
agtggagtagctgaccca

SEQ ID NO: 4107 - DNA, 18 bp, Artificial sequence
  synthetic polynucleotide sequence
ggtgcagatgtgacagca

SEQ ID NO: 4108 - DNA, 18 bp, Artificial sequence
  synthetic polynucleotide sequence
gggtcgtcggccaatgca

SEQ ID NO: 4109 - DNA, 18 bp, Artificial sequence
  synthetic polynucleotide sequence
gggctgctagaagcacga

SEQ ID NO: 4110 - DNA, 18 bp, Artificial sequence
  synthetic polynucleotide sequence
cgagcacaccttccacca

SEQ ID NO: 4111 - DNA, 18 bp, Artificial sequence
  synthetic polynucleotide sequence
cgaactagccagaagcga

SEQ ID NO: 4112 - DNA, 18 bp, Artificial sequence
  synthetic polynucleotide sequence
ccctgactgggaagccca

SEQ ID NO: 4113 - DNA, 18 bp, Artificial sequence
  synthetic polynucleotide sequence
ccttcgacagagccacca

SEQ ID NO: 4114 - DNA, 18 bp, Artificial sequence
  synthetic polynucleotide sequence
ctctcgggctggaaccca

SEQ ID NO: 4115 - DNA, 18 bp, Artificial sequence
  synthetic polynucleotide sequence
ggcgcagaagcttgagca

SEQ ID NO: 4116 - DNA, 18 bp, Artificial sequence
  synthetic polynucleotide sequence
ggcaggctggaatccaca

SEQ ID NO: 4117 - DNA, 18 bp, Artificial sequence
  synthetic polynucleotide sequence
ctgaaagcaggagcagca

SEQ ID NO: 4118 - DNA, 18 bp, Artificial sequence
  synthetic polynucleotide sequence
ctgctactccaccagcaa

SEQ ID NO: 4119 - DNA, 18 bp, Artificial sequence
  synthetic polynucleotide sequence
tctcctcaccgagggcca

SEQ ID NO: 4120 - DNA, 18 bp, Artificial sequence
  synthetic polynucleotide sequence
gcgcaggttggacaccca

SEQ ID NO: 4121 - DNA, 18 bp, Artificial sequence
  synthetic polynucleotide sequence
gcagtgccaggacgacca

SEQ ID NO: 4122 - DNA, 18 bp, Artificial sequence
  synthetic polynucleotide sequence
caggacagaggcaggaga

SEQ ID NO: 4123 - DNA, 18 bp, Artificial sequence
  synthetic polynucleotide sequence
gctgcacggatctcgaga

SEQ ID NO: 4124 - DNA, 18 bp, Artificial sequence
  synthetic polynucleotide sequence
tgaagccggagtagccca

SEQ ID NO: 4125 - DNA, 18 bp, Artificial sequence
  synthetic polynucleotide sequence
cgtgtgccaatggaggca

SEQ ID NO: 4126 - DNA, 18 bp, Artificial sequence
  synthetic polynucleotide sequence
gtctgcacccccgacaca

SEQ ID NO: 4127 - DNA, 18 bp, Artificial sequence
  synthetic polynucleotide sequence
ccgacctctccacagaca

SEQ ID NO: 4128 - DNA, 18 bp, Artificial sequence
  synthetic polynucleotide sequence
gcacagccactgccacca

SEQ ID NO: 4129 - DNA, 18 bp, Artificial sequence
  synthetic polynucleotide sequence
ctgcagcacccataccca

SEQ ID NO: 4130 - DNA, 18 bp, Artificial sequence
  synthetic polynucleotide sequence
cagctagtggtggggcaa

SEQ ID NO: 4131 - DNA, 18 bp, Artificial sequence
  synthetic polynucleotide sequence
acctagctctgccggaga

SEQ ID NO: 4132 - DNA, 18 bp, Artificial sequence
  synthetic polynucleotide sequence
acgggtggggagccagca

SEQ ID NO: 4133 - DNA, 18 bp, Artificial sequence
  synthetic polynucleotide sequence
aggtgccgctggagcaca

SEQ ID NO: 4134 - DNA, 18 bp, Artificial sequence
  synthetic polynucleotide sequence
ggcagctgactgcgggca

SEQ ID NO: 4135 - DNA, 19 bp, Artificial sequence
  synthetic polynucleotide sequence
gctctgtgggacagaagaa

SEQ ID NO: 4136 - DNA, 18 bp, Artificial sequence
  synthetic polynucleotide sequence
gctcgtagagcagcacca

SEQ ID NO: 4137 - DNA, 18 bp, Artificial sequence
  synthetic polynucleotide sequence
agtcccagtcaacgccca

SEQ ID NO: 4138 - DNA, 18 bp, Artificial sequence
  synthetic polynucleotide sequence
tcaccagcctcagagcca

SEQ ID NO: 4139 - DNA, 18 bp, Artificial sequence
  synthetic polynucleotide sequence
accaccgggagccaggaa

SEQ ID NO: 4140 - DNA, 18 bp, Artificial sequence
  synthetic polynucleotide sequence
taaggcgatctggacgga

SEQ ID NO: 4141 - DNA, 18 bp, Artificial sequence
  synthetic polynucleotide sequence
gcctggagcaagagcaca

SEQ ID NO: 4142 - DNA, 18 bp, Artificial sequence
  synthetic polynucleotide sequence
catgcagaaggaggccca

SEQ ID NO: 4143 - DNA, 18 bp, Artificial sequence
  synthetic polynucleotide sequence
ggactcctgggtcaccaa

SEQ ID NO: 4144 - DNA, 18 bp, Artificial sequence
  synthetic polynucleotide sequence
ggccccaccataggcaga

SEQ ID NO: 4145 - DNA, 18 bp, Artificial sequence
  synthetic polynucleotide sequence
acgtgcaggcagagacga

SEQ ID NO: 4146 - DNA, 18 bp, Artificial sequence
  synthetic polynucleotide sequence
acccactgcagcaggcca

SEQ ID NO: 4147 - DNA, 18 bp, Artificial sequence
  synthetic polynucleotide sequence
atgaggaccgggtggaca

SEQ ID NO: 4148 - DNA, 18 bp, Artificial sequence
  synthetic polynucleotide sequence
catcactgccacctccca

SEQ ID NO: 4149 - DNA, 18 bp, Artificial sequence
  synthetic polynucleotide sequence
gggagacactgtcggaca

SEQ ID NO: 4150 - DNA, 18 bp, Artificial sequence
  synthetic polynucleotide sequence
gcacgtgtggctcaagca

SEQ ID NO: 4151 - DNA, 18 bp, Artificial sequence
  synthetic polynucleotide sequence
gcagagggcatgtggaga

SEQ ID NO: 4152 - DNA, 18 bp, Artificial sequence
  synthetic polynucleotide sequence
gcacataaggtccgggga

SEQ ID NO: 4153 - DNA, 18 bp, Artificial sequence
  synthetic polynucleotide sequence
gcccagtggaaccaccaa

SEQ ID NO: 4154 - DNA, 18 bp, Artificial sequence
  synthetic polynucleotide sequence
gtcgctaatggggccaca

SEQ ID NO: 4155 - DNA, 18 bp, Artificial sequence
  synthetic polynucleotide sequence
gcgcaggaggagagcgaa

SEQ ID NO: 4156 - DNA, 18 bp, Artificial sequence
  synthetic polynucleotide sequence
tcaaggcacccagtccca

SEQ ID NO: 4157 - DNA, 18 bp, Artificial sequence
  synthetic polynucleotide sequence
ctgttgccacagaggaca

SEQ ID NO: 4158 - DNA, 18 bp, Artificial sequence
  synthetic polynucleotide sequence
agggcgtctggaggctca

SEQ ID NO: 4159 - DNA, 18 bp, Artificial sequence
  synthetic polynucleotide sequence
ccagctcaatggccagga

SEQ ID NO: 4160 - DNA, 18 bp, Artificial sequence
  synthetic polynucleotide sequence
gaatgtgtggccaggcca

SEQ ID NO: 4161 - DNA, 18 bp, Artificial sequence
  synthetic polynucleotide sequence
ggacaaggaggaaaccaa

SEQ ID NO: 4162 - DNA, 18 bp, Artificial sequence
  synthetic polynucleotide sequence
ggaagctggctctggaga

SEQ ID NO: 4163 - DNA, 18 bp, Artificial sequence
  synthetic polynucleotide sequence
cggaggcagagtgaccga

SEQ ID NO: 4164 - DNA, 18 bp, Artificial sequence
  synthetic polynucleotide sequence
gctggggtcagtggcaga

SEQ ID NO: 4165 - DNA, 18 bp, Artificial sequence
  synthetic polynucleotide sequence
atggagcagcctgggaca

SEQ ID NO: 4166 - DNA, 18 bp, Artificial sequence
  synthetic polynucleotide sequence
gggccactcctctcagga

SEQ ID NO: 4167 - DNA, 18 bp, Artificial sequence
  synthetic polynucleotide sequence
tgtggactaccgggcaga

SEQ ID NO: 4168 - DNA, 18 bp, Artificial sequence
  synthetic polynucleotide sequence
aacacgcctgcaagggca

SEQ ID NO: 4169 - DNA, 18 bp, Artificial sequence
  synthetic polynucleotide sequence
ttggaggaggaggaagga

SEQ ID NO: 4170 - DNA, 18 bp, Artificial sequence
  synthetic polynucleotide sequence
acctcggcaattgggaca

SEQ ID NO: 4171 - DNA, 18 bp, Artificial sequence
  synthetic polynucleotide sequence
ccaaggaccgctgcgaga

SEQ ID NO: 4172 - DNA, 18 bp, Artificial sequence
  synthetic polynucleotide sequence
tgacatcaccaggctcca

SEQ ID NO: 4173 - DNA, 18 bp, Artificial sequence
  synthetic polynucleotide sequence
gaggtggtctgcgacgaa

SEQ ID NO: 4174 - DNA, 18 bp, Artificial sequence
  synthetic polynucleotide sequence
ccatccacgtgaggctca

SEQ ID NO: 4175 - DNA, 18 bp, Artificial sequence
  synthetic polynucleotide sequence
aggaggtactgatggaca

SEQ ID NO: 4176 - DNA, 18 bp, Artificial sequence
  synthetic polynucleotide sequence
tgaggcgggatggcccca

SEQ ID NO: 4177 - DNA, 18 bp, Artificial sequence
  synthetic polynucleotide sequence
accacagccccttcgaca

SEQ ID NO: 4178 - DNA, 18 bp, Artificial sequence
  synthetic polynucleotide sequence
ccccgctgcagcccagca

SEQ ID NO: 4179 - DNA, 17 bp, Artificial sequence
  synthetic polynucleotide sequence
agtcggagggtgcagga

SEQ ID NO: 4180 - DNA, 18 bp, Artificial sequence
  synthetic polynucleotide sequence
gatgccgattttggcaca

SEQ ID NO: 4181 - DNA, 18 bp, Artificial sequence
  synthetic polynucleotide sequence
agtccagcgacgaggaga

SEQ ID NO: 4182 - DNA, 18 bp, Artificial sequence
  synthetic polynucleotide sequence
ggtactgctgcaacgcca

SEQ ID NO: 4183 - DNA, 18 bp, Artificial sequence
  synthetic polynucleotide sequence
ggagcagaaagaacccaa

SEQ ID NO: 4184 - DNA, 18 bp, Artificial sequence
  synthetic polynucleotide sequence
catccttggaccagcgga

SEQ ID NO: 4185 - DNA, 18 bp, Artificial sequence
  synthetic polynucleotide sequence
gacgtcgaccagcagaga

SEQ ID NO: 4186 - DNA, 18 bp, Artificial sequence
  synthetic polynucleotide sequence
aatgcgtagcgacctgca

SEQ ID NO: 4187 - DNA, 17 bp, Artificial sequence
  synthetic polynucleotide sequence
cggcctctgagctggga

SEQ ID NO: 4188 - DNA, 18 bp, Artificial sequence
  synthetic polynucleotide sequence
gccaccactgaaggcaga

SEQ ID NO: 4189 - DNA, 18 bp, Artificial sequence
  synthetic polynucleotide sequence
acacagctgccaccctca

SEQ ID NO: 4190 - DNA, 18 bp, Artificial sequence
  synthetic polynucleotide sequence
ccatcagtagcctccaga

SEQ ID NO: 4191 - DNA, 18 bp, Artificial sequence
  synthetic polynucleotide sequence
ggctatcagaaaccccaa

SEQ ID NO: 4192 - DNA, 18 bp, Artificial sequence
  synthetic polynucleotide sequence
gatccaccgacaatacca

SEQ ID NO: 4193 - DNA, 18 bp, Artificial sequence
  synthetic polynucleotide sequence
gcagagagccagcaagga

SEQ ID NO: 4194 - DNA, 18 bp, Artificial sequence
  synthetic polynucleotide sequence
ccgcctgagctgaaggga

SEQ ID NO: 4195 - DNA, 18 bp, Artificial sequence
  synthetic polynucleotide sequence
gcgctgacaccacagcta

SEQ ID NO: 4196 - DNA, 18 bp, Artificial sequence
  synthetic polynucleotide sequence
ggaagagccgagtcggga

SEQ ID NO: 4197 - DNA, 18 bp, Artificial sequence
  synthetic polynucleotide sequence
gagctgcggactgagcca

SEQ ID NO: 4198 - DNA, 18 bp, Artificial sequence
  synthetic polynucleotide sequence
cagccgcagtgtgcagca

SEQ ID NO: 4199 - DNA, 18 bp, Artificial sequence
  synthetic polynucleotide sequence
atcaagccgtggcggaga

SEQ ID NO: 4200 - DNA, 18 bp, Artificial sequence
  synthetic polynucleotide sequence
cactgctcctcagacgga

SEQ ID NO: 4201 - DNA, 18 bp, Artificial sequence
  synthetic polynucleotide sequence
cacaccaccccagagaca

SEQ ID NO: 4202 - DNA, 18 bp, Artificial sequence
  synthetic polynucleotide sequence
acgtagctgcagccggca

SEQ ID NO: 4203 - DNA, 18 bp, Artificial sequence
  synthetic polynucleotide sequence
gcccaagcttcaacagca

SEQ ID NO: 4204 - DNA, 18 bp, Artificial sequence
  synthetic polynucleotide sequence
ctggcagctgggcacaca

SEQ ID NO: 4205 - DNA, 18 bp, Artificial sequence
  synthetic polynucleotide sequence
gctgctccatcccagcca

SEQ ID NO: 4206 - DNA, 18 bp, Artificial sequence
  synthetic polynucleotide sequence
gtggtgaggagcctgcca

SEQ ID NO: 4207 - DNA, 18 bp, Artificial sequence
  synthetic polynucleotide sequence
caccaacatgccacggca

SEQ ID NO: 4208 - DNA, 18 bp, Artificial sequence
  synthetic polynucleotide sequence
aatgcggctgatgcggca

SEQ ID NO: 4209 - DNA, 14 bp, Artificial sequence
  synthetic polynucleotide sequence
cggccagaacgcgg

SEQ ID NO: 4210 - DNA, 17 bp, Artificial sequence
  synthetic polynucleotide sequence
gaccagctgcaagacca

SEQ ID NO: 4211 - DNA, 18 bp, Artificial sequence
  synthetic polynucleotide sequence
caggcaactggagaggaa

SEQ ID NO: 4212 - DNA, 18 bp, Artificial sequence
  synthetic polynucleotide sequence
gtgcaacaggaactggca

SEQ ID NO: 4213 - DNA, 18 bp, Artificial sequence
  synthetic polynucleotide sequence
ggccttcatccaccacga

SEQ ID NO: 4214 - DNA, 18 bp, Artificial sequence
  synthetic polynucleotide sequence
ggggtacaggcgtggaca

SEQ ID NO: 4215 - DNA, 18 bp, Artificial sequence
  synthetic polynucleotide sequence
gctgcccaagttccacca

SEQ ID NO: 4216 - DNA, 18 bp, Artificial sequence
  synthetic polynucleotide sequence
tccagagcctggtgcaca

SEQ ID NO: 4217 - DNA, 18 bp, Artificial sequence
  synthetic polynucleotide sequence
agggaagggcaagcccaa

SEQ ID NO: 4218 - DNA, 18 bp, Artificial sequence
  synthetic polynucleotide sequence
ggtggaatccctccgaca

SEQ ID NO: 4219 - DNA, 19 bp, Artificial sequence
  synthetic polynucleotide sequence
gctgagaagaggaagccca

SEQ ID NO: 4220 - DNA, 17 bp, Artificial sequence
  synthetic polynucleotide sequence
cacacacctccgaggca

SEQ ID NO: 4221 - DNA, 18 bp, Artificial sequence
  synthetic polynucleotide sequence
cccaagcgcctcaagaca

SEQ ID NO: 4222 - DNA, 18 bp, Artificial sequence
  synthetic polynucleotide sequence
aaggaagcgatcccggca

SEQ ID NO: 4223 - DNA, 18 bp, Artificial sequence
  synthetic polynucleotide sequence
caggttgcctagcaggaa

SEQ ID NO: 4224 - DNA, 18 bp, Artificial sequence
  synthetic polynucleotide sequence
acgacgctcgtaggggca

SEQ ID NO: 4225 - DNA, 18 bp, Artificial sequence
  synthetic polynucleotide sequence
caactgtggaagtaggca

SEQ ID NO: 4226 - DNA, 18 bp, Artificial sequence
  synthetic polynucleotide sequence
ctaccaccacaatcacca

SEQ ID NO: 4227 - DNA, 18 bp, Artificial sequence
  synthetic polynucleotide sequence
cccagcagaggtgaagga

SEQ ID NO: 4228 - DNA, 18 bp, Artificial sequence
  synthetic polynucleotide sequence
gccaggctgtactggaga

SEQ ID NO: 4229 - DNA, 18 bp, Artificial sequence
  synthetic polynucleotide sequence
gccaggggatgtcaggaa

SEQ ID NO: 4230 - DNA, 18 bp, Artificial sequence
  synthetic polynucleotide sequence
cctccgcgcacacacaca

SEQ ID NO: 4231 - DNA, 18 bp, Artificial sequence
  synthetic polynucleotide sequence
cctggacagtgggaagga

SEQ ID NO: 4232 - DNA, 18 bp, Artificial sequence
  synthetic polynucleotide sequence
ggagatgagtcctggcga

SEQ ID NO: 4233 - DNA, 18 bp, Artificial sequence
  synthetic polynucleotide sequence
gcatcagcaccatccgca

SEQ ID NO: 4234 - DNA, 18 bp, Artificial sequence
  synthetic polynucleotide sequence
ccagggacgagagagaca

SEQ ID NO: 4235 - DNA, 18 bp, Artificial sequence
  synthetic polynucleotide sequence
agggaagcaccctggaca

SEQ ID NO: 4236 - DNA, 18 bp, Artificial sequence
  synthetic polynucleotide sequence
atcacagcgaaccacgga

SEQ ID NO: 4237 - DNA, 18 bp, Artificial sequence
  synthetic polynucleotide sequence
tgatgcaaccctgcagca

SEQ ID NO: 4238 - DNA, 18 bp, Artificial sequence
  synthetic polynucleotide sequence
ctgctgctcggaacagga

SEQ ID NO: 4239 - DNA, 18 bp, Artificial sequence
  synthetic polynucleotide sequence
gggcagctgccatcccaa

SEQ ID NO: 4240 - DNA, 18 bp, Artificial sequence
  synthetic polynucleotide sequence
cccctgagtgactacgga

SEQ ID NO: 4241 - DNA, 18 bp, Artificial sequence
  synthetic polynucleotide sequence
tgtgccctaccaggacca

SEQ ID NO: 4242 - DNA, 18 bp, Artificial sequence
  synthetic polynucleotide sequence
cttcccgccaagccacca

SEQ ID NO: 4243 - DNA, 18 bp, Artificial sequence
  synthetic polynucleotide sequence
agcctccagctggtgaca

SEQ ID NO: 4244 - DNA, 18 bp, Artificial sequence
  synthetic polynucleotide sequence
tgcccaggatctgcagca

SEQ ID NO: 4245 - DNA, 18 bp, Artificial sequence
  synthetic polynucleotide sequence
cctgcaccaacaaggcca

SEQ ID NO: 4246 - DNA, 18 bp, Artificial sequence
  synthetic polynucleotide sequence
gggacccttggaacacca

SEQ ID NO: 4247 - DNA, 18 bp, Artificial sequence
  synthetic polynucleotide sequence
cggatgagcagctgagca

SEQ ID NO: 4248 - DNA, 18 bp, Artificial sequence
  synthetic polynucleotide sequence
actgggaaggtggccaca

SEQ ID NO: 4249 - DNA, 18 bp, Artificial sequence
  synthetic polynucleotide sequence
tcccactcagctgccaga

SEQ ID NO: 4250 - DNA, 18 bp, Artificial sequence
  synthetic polynucleotide sequence
gcaggttgcactgcagca

SEQ ID NO: 4251 - DNA, 18 bp, Artificial sequence
  synthetic polynucleotide sequence
cggcactgtcatccccaa

SEQ ID NO: 4252 - DNA, 18 bp, Artificial sequence
  synthetic polynucleotide sequence
ggttccgcacaggctgca

SEQ ID NO: 4253 - DNA, 18 bp, Artificial sequence
  synthetic polynucleotide sequence
ccacttggctgaggagga

SEQ ID NO: 4254 - DNA, 18 bp, Artificial sequence
  synthetic polynucleotide sequence
tgagcggccacagtcaga

SEQ ID NO: 4255 - DNA, 18 bp, Artificial sequence
  synthetic polynucleotide sequence
gggaggagaaggcaggaa

SEQ ID NO: 4256 - DNA, 18 bp, Artificial sequence
  synthetic polynucleotide sequence
aggagcgaggctcttcca

SEQ ID NO: 4257 - DNA, 18 bp, Artificial sequence
  synthetic polynucleotide sequence
ggagctcatgccacctga

SEQ ID NO: 4258 - DNA, 18 bp, Artificial sequence
  synthetic polynucleotide sequence
tgctgagagagccacgta

SEQ ID NO: 4259 - DNA, 18 bp, Artificial sequence
  synthetic polynucleotide sequence
gggtctcccaactccaga

SEQ ID NO: 4260 - DNA, 18 bp, Artificial sequence
  synthetic polynucleotide sequence
cgaccagggctttggaga

SEQ ID NO: 4261 - DNA, 18 bp, Artificial sequence
  synthetic polynucleotide sequence
cctgaccttcgccagcaa

SEQ ID NO: 4262 - DNA, 18 bp, Artificial sequence
  synthetic polynucleotide sequence
cccagaagctggtcagca

SEQ ID NO: 4263 - DNA, 18 bp, Artificial sequence
  synthetic polynucleotide sequence
gcatggaatggtaccaga

SEQ ID NO: 4264 - DNA, 18 bp, Artificial sequence
  synthetic polynucleotide sequence
actgccactcccgatcca

SEQ ID NO: 4265 - DNA, 18 bp, Artificial sequence
  synthetic polynucleotide sequence
ggcacaccttggccagca

SEQ ID NO: 4266 - DNA, 18 bp, Artificial sequence
  synthetic polynucleotide sequence
ccaggcagagcacgagca

SEQ ID NO: 4267 - DNA, 18 bp, Artificial sequence
  synthetic polynucleotide sequence
gattccggagggcaccaa

SEQ ID NO: 4268 - DNA, 18 bp, Artificial sequence
  synthetic polynucleotide sequence
tcggcatcggatcccaca

SEQ ID NO: 4269 - DNA, 18 bp, Artificial sequence
  synthetic polynucleotide sequence
caacctgcacgtgaccca

SEQ ID NO: 4270 - DNA, 18 bp, Artificial sequence
  synthetic polynucleotide sequence
atgccccttgggacggca

SEQ ID NO: 4271 - DNA, 18 bp, Artificial sequence
  synthetic polynucleotide sequence
tcaacccagaccccacca

SEQ ID NO: 4272 - DNA, 18 bp, Artificial sequence
  synthetic polynucleotide sequence
tctcccagaccatcgaca

SEQ ID NO: 4273 - DNA, 18 bp, Artificial sequence
  synthetic polynucleotide sequence
cgccgtgctctccgggca

SEQ ID NO: 4274 - DNA, 18 bp, Artificial sequence
  synthetic polynucleotide sequence
acatcgtggctgcaccaa

SEQ ID NO: 4275 - DNA, 18 bp, Artificial sequence
  synthetic polynucleotide sequence
gcccaaaatccatggcaa

SEQ ID NO: 4276 - DNA, 18 bp, Artificial sequence
  synthetic polynucleotide sequence
ctgatgagcaagtcagca

SEQ ID NO: 4277 - DNA, 18 bp, Artificial sequence
  synthetic polynucleotide sequence
ggcacaaggcaaaaccca

SEQ ID NO: 4278 - DNA, 18 bp, Artificial sequence
  synthetic polynucleotide sequence
tcatgatggccacaggga

SEQ ID NO: 4279 - DNA, 18 bp, Artificial sequence
  synthetic polynucleotide sequence
ggacctccctcaagacca

SEQ ID NO: 4280 - DNA, 18 bp, Artificial sequence
  synthetic polynucleotide sequence
tgtacaggacaggcggga

SEQ ID NO: 4281 - DNA, 18 bp, Artificial sequence
  synthetic polynucleotide sequence
gcccgttcactaccagca

SEQ ID NO: 4282 - DNA, 18 bp, Artificial sequence
  synthetic polynucleotide sequence
agagggcaggacacagca

SEQ ID NO: 4283 - DNA, 18 bp, Artificial sequence
  synthetic polynucleotide sequence
cccagactccaccgcaga

SEQ ID NO: 4284 - DNA, 18 bp, Artificial sequence
  synthetic polynucleotide sequence
gcgtgatgtgcaccacga

SEQ ID NO: 4285 - DNA, 18 bp, Artificial sequence
  synthetic polynucleotide sequence
cctgcgtcagtgagacca

SEQ ID NO: 4286 - DNA, 18 bp, Artificial sequence
  synthetic polynucleotide sequence
agaagtggctgcacccca

SEQ ID NO: 4287 - DNA, 18 bp, Artificial sequence
  synthetic polynucleotide sequence
gtggaattcggcagccca

SEQ ID NO: 4288 - DNA, 18 bp, Artificial sequence
  synthetic polynucleotide sequence
caacagcatcacccagga

SEQ ID NO: 4289 - DNA, 18 bp, Artificial sequence
  synthetic polynucleotide sequence
caacctcggcttggcgaa

SEQ ID NO: 4290 - DNA, 18 bp, Artificial sequence
  synthetic polynucleotide sequence
gctgcagcaacctactga

SEQ ID NO: 4291 - DNA, 18 bp, Artificial sequence
  synthetic polynucleotide sequence
ggagaacatgtacgggga

SEQ ID NO: 4292 - DNA, 18 bp, Artificial sequence
  synthetic polynucleotide sequence
tcatcaggatcaaccgca

SEQ ID NO: 4293 - DNA, 18 bp, Artificial sequence
  synthetic polynucleotide sequence
gaccgcatgccatcccaa

SEQ ID NO: 4294 - DNA, 18 bp, Artificial sequence
  synthetic polynucleotide sequence
tcactgcagcagcccaca

SEQ ID NO: 4295 - DNA, 18 bp, Artificial sequence
  synthetic polynucleotide sequence
tgtgaaagggccacccca

SEQ ID NO: 4296 - DNA, 18 bp, Artificial sequence
  synthetic polynucleotide sequence
tggtgcaaggagacgcca

SEQ ID NO: 4297 - DNA, 18 bp, Artificial sequence
  synthetic polynucleotide sequence
tggatgcgacgctgcaga

SEQ ID NO: 4298 - DNA, 18 bp, Artificial sequence
  synthetic polynucleotide sequence
ggcacagcgtgggctcca

SEQ ID NO: 4299 - DNA, 18 bp, Artificial sequence
  synthetic polynucleotide sequence
gacagactgaggaggcca

SEQ ID NO: 4300 - DNA, 18 bp, Artificial sequence
  synthetic polynucleotide sequence
tcagggacagcatccaca

SEQ ID NO: 4301 - DNA, 18 bp, Artificial sequence
  synthetic polynucleotide sequence
ctgcagggaagcacagca

SEQ ID NO: 4302 - DNA, 18 bp, Artificial sequence
  synthetic polynucleotide sequence
cgcaatggcacatcagca

SEQ ID NO: 4303 - DNA, 18 bp, Artificial sequence
  synthetic polynucleotide sequence
gacgatggccaggaagca

SEQ ID NO: 4304 - DNA, 18 bp, Artificial sequence
  synthetic polynucleotide sequence
aacaacccacggagccca

SEQ ID NO: 4305 - DNA, 18 bp, Artificial sequence
  synthetic polynucleotide sequence
gacctgtgatgagcggca

SEQ ID NO: 4306 - DNA, 18 bp, Artificial sequence
  synthetic polynucleotide sequence
atgggggatgtggagcca

SEQ ID NO: 4307 - DNA, 18 bp, Artificial sequence
  synthetic polynucleotide sequence
accaagacatggccacca

SEQ ID NO: 4308 - DNA, 17 bp, Artificial sequence
  synthetic polynucleotide sequence
ccaggaagcgctggcca

SEQ ID NO: 4309 - DNA, 18 bp, Artificial sequence
  synthetic polynucleotide sequence
tggaatggggacacagga

SEQ ID NO: 4310 - DNA, 18 bp, Artificial sequence
  synthetic polynucleotide sequence
tcttggacaacagcgaca

SEQ ID NO: 4311 - DNA, 18 bp, Artificial sequence
  synthetic polynucleotide sequence
gcagggccaaaggaagga

SEQ ID NO: 4312 - DNA, 18 bp, Artificial sequence
  synthetic polynucleotide sequence
gcgcagcctgactggaca

SEQ ID NO: 4313 - DNA, 18 bp, Artificial sequence
  synthetic polynucleotide sequence
gctcgaaaaacagcagca

SEQ ID NO: 4314 - DNA, 18 bp, Artificial sequence
  synthetic polynucleotide sequence
gaggacacgtcgccctca

SEQ ID NO: 4315 - DNA, 18 bp, Artificial sequence
  synthetic polynucleotide sequence
ctcccagacctgtaacca

SEQ ID NO: 4316 - DNA, 18 bp, Artificial sequence
  synthetic polynucleotide sequence
ctggagcagccctagcca

SEQ ID NO: 4317 - DNA, 18 bp, Artificial sequence
  synthetic polynucleotide sequence
aggcacagcagaacccca

SEQ ID NO: 4318 - DNA, 18 bp, Artificial sequence
  synthetic polynucleotide sequence
tctcctgcagggccgaca

SEQ ID NO: 4319 - DNA, 18 bp, Artificial sequence
  synthetic polynucleotide sequence
tacgcagccgcctgggaa

SEQ ID NO: 4320 - DNA, 18 bp, Artificial sequence
  synthetic polynucleotide sequence
cccaggccgtgatgagca

SEQ ID NO: 4321 - DNA, 18 bp, Artificial sequence
  synthetic polynucleotide sequence
agtgcccccagatgagga

SEQ ID NO: 4322 - DNA, 18 bp, Artificial sequence
  synthetic polynucleotide sequence
gtacatggccaggaggca

SEQ ID NO: 4323 - DNA, 18 bp, Artificial sequence
  synthetic polynucleotide sequence
ccacaggcgagtcagaca

SEQ ID NO: 4324 - DNA, 18 bp, Artificial sequence
  synthetic polynucleotide sequence
gggcagccagttcagcca

SEQ ID NO: 4325 - DNA, 18 bp, Artificial sequence
  synthetic polynucleotide sequence
tccgagaggtggaggaga

SEQ ID NO: 4326 - DNA, 18 bp, Artificial sequence
  synthetic polynucleotide sequence
agtgggtgatggagcgca

SEQ ID NO: 4327 - DNA, 18 bp, Artificial sequence
  synthetic polynucleotide sequence
cctggttcaacgaggcca

SEQ ID NO: 4328 - DNA, 18 bp, Artificial sequence
  synthetic polynucleotide sequence
tctgccgaacagtgcgga

SEQ ID NO: 4329 - DNA, 18 bp, Artificial sequence
  synthetic polynucleotide sequence
gcaagttccaggtggaca

SEQ ID NO: 4330 - DNA, 18 bp, Artificial sequence
  synthetic polynucleotide sequence
cagagcggcttaccccca

SEQ ID NO: 4331 - DNA, 18 bp, Artificial sequence
  synthetic polynucleotide sequence
gtcatcaggcccaacgta

SEQ ID NO: 4332 - DNA, 18 bp, Artificial sequence
  synthetic polynucleotide sequence
acgtcgggaactatgcca

SEQ ID NO: 4333 - DNA, 18 bp, Artificial sequence
  synthetic polynucleotide sequence
caaaaccagccgctccga

SEQ ID NO: 4334 - DNA, 18 bp, Artificial sequence
  synthetic polynucleotide sequence
aggacggctgtgatgcca

SEQ ID NO: 4335 - DNA, 18 bp, Artificial sequence
  synthetic polynucleotide sequence
gtgcatcccagcagcgga

SEQ ID NO: 4336 - DNA, 18 bp, Artificial sequence
  synthetic polynucleotide sequence
gtgcagggcatcctccca

SEQ ID NO: 4337 - DNA, 18 bp, Artificial sequence
  synthetic polynucleotide sequence
ctcgtccactgccgggaa

SEQ ID NO: 4338 - DNA, 18 bp, Artificial sequence
  synthetic polynucleotide sequence
ctcacgatgctcagggca

SEQ ID NO: 4339 - DNA, 18 bp, Artificial sequence
  synthetic polynucleotide sequence
acgggtgaggctggagga

SEQ ID NO: 4340 - DNA, 18 bp, Artificial sequence
  synthetic polynucleotide sequence
agtgcacgcccacggaga

SEQ ID NO: 4341 - DNA, 18 bp, Artificial sequence
  synthetic polynucleotide sequence
cagctcctgcagtacgaa

SEQ ID NO: 4342 - DNA, 18 bp, Artificial sequence
  synthetic polynucleotide sequence
tgcagtaggcaccctgca

SEQ ID NO: 4343 - DNA, 18 bp, Artificial sequence
  synthetic polynucleotide sequence
gcagcgactggaacgaga

SEQ ID NO: 4344 - DNA, 18 bp, Artificial sequence
  synthetic polynucleotide sequence
ttggacagcggactacca

SEQ ID NO: 4345 - DNA, 18 bp, Artificial sequence
  synthetic polynucleotide sequence
cctggacgtgctcggcaa

SEQ ID NO: 4346 - DNA, 18 bp, Artificial sequence
  synthetic polynucleotide sequence
agctgatggcctcaggga

SEQ ID NO: 4347 - DNA, 18 bp, Artificial sequence
  synthetic polynucleotide sequence
cagcaactcctgccccaa

SEQ ID NO: 4348 - DNA, 18 bp, Artificial sequence
  synthetic polynucleotide sequence
gatggcgatggtggcaga

SEQ ID NO: 4349 - DNA, 18 bp, Artificial sequence
  synthetic polynucleotide sequence
cctcaatgtcacccccaa

SEQ ID NO: 4350 - DNA, 18 bp, Artificial sequence
  synthetic polynucleotide sequence
ccccgcagttctgggaca

SEQ ID NO: 4351 - DNA, 18 bp, Artificial sequence
  synthetic polynucleotide sequence
cgctggctggaagggcga

SEQ ID NO: 4352 - DNA, 18 bp, Artificial sequence
  synthetic polynucleotide sequence
gaagggagcgctatctga

SEQ ID NO: 4353 - DNA, 18 bp, Artificial sequence
  synthetic polynucleotide sequence
aggggcagatgcaaggca

SEQ ID NO: 4354 - DNA, 18 bp, Artificial sequence
  synthetic polynucleotide sequence
ccaggagctcatccagca

SEQ ID NO: 4355 - DNA, 18 bp, Artificial sequence
  synthetic polynucleotide sequence
caggcctgatccgacaca

SEQ ID NO: 4356 - DNA, 18 bp, Artificial sequence
  synthetic polynucleotide sequence
gaagccccactggagcca

SEQ ID NO: 4357 - DNA, 18 bp, Artificial sequence
  synthetic polynucleotide sequence
tcaggacgttcgccagga

SEQ ID NO: 4358 - DNA, 18 bp, Artificial sequence
  synthetic polynucleotide sequence
caccgtgtagtgggacca

SEQ ID NO: 4359 - DNA, 18 bp, Artificial sequence
  synthetic polynucleotide sequence
gcgctaagaccggacaga

SEQ ID NO: 4360 - DNA, 18 bp, Artificial sequence
  synthetic polynucleotide sequence
gaaggatcagcacccgga

SEQ ID NO: 4361 - DNA, 18 bp, Artificial sequence
  synthetic polynucleotide sequence
gctcatcggggacaagca

SEQ ID NO: 4362 - DNA, 18 bp, Artificial sequence
  synthetic polynucleotide sequence
tccatggcctgcacggca

SEQ ID NO: 4363 - DNA, 18 bp, Artificial sequence
  synthetic polynucleotide sequence
cagcggaggagatccgaa

SEQ ID NO: 4364 - DNA, 18 bp, Artificial sequence
  synthetic polynucleotide sequence
tgcagaatcgagtgggca

SEQ ID NO: 4365 - DNA, 18 bp, Artificial sequence
  synthetic polynucleotide sequence
ccagacctctcaccacca

SEQ ID NO: 4366 - DNA, 18 bp, Artificial sequence
  synthetic polynucleotide sequence
ttccaacaactggaggca

SEQ ID NO: 4367 - DNA, 19 bp, Artificial sequence
  synthetic polynucleotide sequence
ggaagcgaaatcgaggaca

SEQ ID NO: 4368 - DNA, 18 bp, Artificial sequence
  synthetic polynucleotide sequence
atcctccacatccgcaca

SEQ ID NO: 4369 - DNA, 18 bp, Artificial sequence
  synthetic polynucleotide sequence
ccctcatccctcaccaca

SEQ ID NO: 4370 - DNA, 18 bp, Artificial sequence
  synthetic polynucleotide sequence
cggagaagtcctcccgca

SEQ ID NO: 4371 - DNA, 18 bp, Artificial sequence
  synthetic polynucleotide sequence
cccatccttggaccagga

SEQ ID NO: 4372 - DNA, 18 bp, Artificial sequence
  synthetic polynucleotide sequence
gtccccaaggtcgtagga

SEQ ID NO: 4373 - DNA, 18 bp, Artificial sequence
  synthetic polynucleotide sequence
ccaacgttctggaaggca

SEQ ID NO: 4374 - DNA, 18 bp, Artificial sequence
  synthetic polynucleotide sequence
ggccttgacactgggcca

SEQ ID NO: 4375 - DNA, 18 bp, Artificial sequence
  synthetic polynucleotide sequence
ccatcaaggcagacccca

SEQ ID NO: 4376 - DNA, 18 bp, Artificial sequence
  synthetic polynucleotide sequence
agacgaagcagaggggca

SEQ ID NO: 4377 - DNA, 18 bp, Artificial sequence
  synthetic polynucleotide sequence
cacaactggaggtaccca

SEQ ID NO: 4378 - DNA, 18 bp, Artificial sequence
  synthetic polynucleotide sequence
tggagtcaaggactggga

SEQ ID NO: 4379 - DNA, 18 bp, Artificial sequence
  synthetic polynucleotide sequence
gcaaggaagggccaccaa

SEQ ID NO: 4380 - DNA, 18 bp, Artificial sequence
  synthetic polynucleotide sequence
gtgcccctgtcacagcaa

SEQ ID NO: 4381 - DNA, 17 bp, Artificial sequence
  synthetic polynucleotide sequence
caggctgaggtggcaga

SEQ ID NO: 4382 - DNA, 18 bp, Artificial sequence
  synthetic polynucleotide sequence
cacagtgtggaaggcgca

SEQ ID NO: 4383 - DNA, 18 bp, Artificial sequence
  synthetic polynucleotide sequence
gatctggcagaggacgga

SEQ ID NO: 4384 - DNA, 19 bp, Artificial sequence
  synthetic polynucleotide sequence
cttcatcccaggaagtcca

SEQ ID NO: 4385 - DNA, 18 bp, Artificial sequence
  synthetic polynucleotide sequence
cactccccagcagaccaa

SEQ ID NO: 4386 - DNA, 18 bp, Artificial sequence
  synthetic polynucleotide sequence
cagctgagccgttgagga

SEQ ID NO: 4387 - DNA, 18 bp, Artificial sequence
  synthetic polynucleotide sequence
ctgctccaaactccacca

SEQ ID NO: 4388 - DNA, 19 bp, Artificial sequence
  synthetic polynucleotide sequence
gacattgagcacgtaggga

SEQ ID NO: 4389 - DNA, 18 bp, Artificial sequence
  synthetic polynucleotide sequence
agtatgccaagggagaca

SEQ ID NO: 4390 - DNA, 18 bp, Artificial sequence
  synthetic polynucleotide sequence
aggcgatcaccacccaca

SEQ ID NO: 4391 - DNA, 18 bp, Artificial sequence
  synthetic polynucleotide sequence
ggaccaggaactagcaca

SEQ ID NO: 4392 - DNA, 18 bp, Artificial sequence
  synthetic polynucleotide sequence
tggaagcaggtcctgcca

SEQ ID NO: 4393 - DNA, 18 bp, Artificial sequence
  synthetic polynucleotide sequence
cacacgctcctcacccaa

SEQ ID NO: 4394 - DNA, 18 bp, Artificial sequence
  synthetic polynucleotide sequence
cttgaaggcctccacgga

SEQ ID NO: 4395 - DNA, 18 bp, Artificial sequence
  synthetic polynucleotide sequence
gctggctggggaacgaga

SEQ ID NO: 4396 - DNA, 18 bp, Artificial sequence
  synthetic polynucleotide sequence
aaccggcctccagggaca

SEQ ID NO: 4397 - DNA, 18 bp, Artificial sequence
  synthetic polynucleotide sequence
accattcggtggccgaga

SEQ ID NO: 4398 - DNA, 18 bp, Artificial sequence
  synthetic polynucleotide sequence
agtcgtggcctggaccga

SEQ ID NO: 4399 - DNA, 18 bp, Artificial sequence
  synthetic polynucleotide sequence
tgccggtgagaaggccca

SEQ ID NO: 4400 - DNA, 18 bp, Artificial sequence
  synthetic polynucleotide sequence
gctgagatccggtcacca

SEQ ID NO: 4401 - DNA, 18 bp, Artificial sequence
  synthetic polynucleotide sequence
atggaaggcctgggagga

SEQ ID NO: 4402 - DNA, 18 bp, Artificial sequence
  synthetic polynucleotide sequence
ttggggtaaggagcccga

SEQ ID NO: 4403 - DNA, 18 bp, Artificial sequence
  synthetic polynucleotide sequence
gcacactgcgcctgccaa

SEQ ID NO: 4404 - DNA, 18 bp, Artificial sequence
  synthetic polynucleotide sequence
catctgggatggaggcga

SEQ ID NO: 4405 - DNA, 18 bp, Artificial sequence
  synthetic polynucleotide sequence
ggaagagacgccggagga

SEQ ID NO: 4406 - DNA, 18 bp, Artificial sequence
  synthetic polynucleotide sequence
ggtcatgagcacccgcca

SEQ ID NO: 4407 - DNA, 18 bp, Artificial sequence
  synthetic polynucleotide sequence
cagtcagcaaggtggcaa

SEQ ID NO: 4408 - DNA, 18 bp, Artificial sequence
  synthetic polynucleotide sequence
ggtgcaaggataggtcca

SEQ ID NO: 4409 - DNA, 18 bp, Artificial sequence
  synthetic polynucleotide sequence
ggggcatgacagacggca

SEQ ID NO: 4410 - DNA, 18 bp, Artificial sequence
  synthetic polynucleotide sequence
cacaaggactccacagca

SEQ ID NO: 4411 - DNA, 18 bp, Artificial sequence
  synthetic polynucleotide sequence
gccacatgaagagccgga

SEQ ID NO: 4412 - DNA, 18 bp, Artificial sequence
  synthetic polynucleotide sequence
tgctgcacctcagcacga

SEQ ID NO: 4413 - DNA, 18 bp, Artificial sequence
  synthetic polynucleotide sequence
cgataagggtcctgggaa

SEQ ID NO: 4414 - DNA, 18 bp, Artificial sequence
  synthetic polynucleotide sequence
aagcagggaggagccgca

SEQ ID NO: 4415 - DNA, 18 bp, Artificial sequence
  synthetic polynucleotide sequence
ccatgaccaggcaaggga

SEQ ID NO: 4416 - DNA, 18 bp, Artificial sequence
  synthetic polynucleotide sequence
gaagggctgactggggca

SEQ ID NO: 4417 - DNA, 18 bp, Artificial sequence
  synthetic polynucleotide sequence
cagaggcagtgatgggaa

SEQ ID NO: 4418 - DNA, 18 bp, Artificial sequence
  synthetic polynucleotide sequence
ccaccaatggctccagca

SEQ ID NO: 4419 - DNA, 18 bp, Artificial sequence
  synthetic polynucleotide sequence
gcggactatgagagcgga

SEQ ID NO: 4420 - DNA, 18 bp, Artificial sequence
  synthetic polynucleotide sequence
ccccggagcttgaggcca

SEQ ID NO: 4421 - DNA, 18 bp, Artificial sequence
  synthetic polynucleotide sequence
tacaaatgctcaggccca

SEQ ID NO: 4422 - DNA, 18 bp, Artificial sequence
  synthetic polynucleotide sequence
agctcggtgagtagagga

SEQ ID NO: 4423 - DNA, 18 bp, Artificial sequence
  synthetic polynucleotide sequence
ttgccaaggagctccaga

SEQ ID NO: 4424 - DNA, 18 bp, Artificial sequence
  synthetic polynucleotide sequence
atccatcagggacgagca

SEQ ID NO: 4425 - DNA, 18 bp, Artificial sequence
  synthetic polynucleotide sequence
ctcctggctcgacaagga

SEQ ID NO: 4426 - DNA, 18 bp, Artificial sequence
  synthetic polynucleotide sequence
gtccctggcactggagca

SEQ ID NO: 4427 - DNA, 18 bp, Artificial sequence
  synthetic polynucleotide sequence
aaactctggacgtcagca

SEQ ID NO: 4428 - DNA, 18 bp, Artificial sequence
  synthetic polynucleotide sequence
ggagcgagggcgagtcca

SEQ ID NO: 4429 - DNA, 18 bp, Artificial sequence
  synthetic polynucleotide sequence
agcgtcgagaagtggcaa

SEQ ID NO: 4430 - DNA, 18 bp, Artificial sequence
  synthetic polynucleotide sequence
acagcagcagcagaggca

SEQ ID NO: 4431 - DNA, 18 bp, Artificial sequence
  synthetic polynucleotide sequence
gccaaggacccatcgaga

SEQ ID NO: 4432 - DNA, 18 bp, Artificial sequence
  synthetic polynucleotide sequence
tgcagcaggtctcccaga

SEQ ID NO: 4433 - DNA, 18 bp, Artificial sequence
  synthetic polynucleotide sequence
cgtagaagggcacagaga

SEQ ID NO: 4434 - DNA, 18 bp, Artificial sequence
  synthetic polynucleotide sequence
aatcgcctaaccatcgca

SEQ ID NO: 4435 - DNA, 18 bp, Artificial sequence
  synthetic polynucleotide sequence
cggtcatcgactgccaca

SEQ ID NO: 4436 - DNA, 18 bp, Artificial sequence
  synthetic polynucleotide sequence
ccggcaccatctccacga

SEQ ID NO: 4437 - DNA, 18 bp, Artificial sequence
  synthetic polynucleotide sequence
acgattacctggcggaca

SEQ ID NO: 4438 - DNA, 18 bp, Artificial sequence
  synthetic polynucleotide sequence
aacgtagggcatgacaca

SEQ ID NO: 4439 - DNA, 18 bp, Artificial sequence
  synthetic polynucleotide sequence
ccccaacatcctcaccga

SEQ ID NO: 4440 - DNA, 18 bp, Artificial sequence
  synthetic polynucleotide sequence
cgtggacgtcgaagcgca

SEQ ID NO: 4441 - DNA, 18 bp, Artificial sequence
  synthetic polynucleotide sequence
tcagaagcgaggggagca

SEQ ID NO: 4442 - DNA, 18 bp, Artificial sequence
  synthetic polynucleotide sequence
cccaggactgcactggca

SEQ ID NO: 4443 - DNA, 18 bp, Artificial sequence
  synthetic polynucleotide sequence
ccgctgcgtggacaccaa

SEQ ID NO: 4444 - DNA, 18 bp, Artificial sequence
  synthetic polynucleotide sequence
gcgagtttccagcacgga

SEQ ID NO: 4445 - DNA, 18 bp, Artificial sequence
  synthetic polynucleotide sequence
gcaagtaccttggcagga

SEQ ID NO: 4446 - DNA, 18 bp, Artificial sequence
  synthetic polynucleotide sequence
aggatgatgaaccggtga

SEQ ID NO: 4447 - DNA, 18 bp, Artificial sequence
  synthetic polynucleotide sequence
caagctcagcttccggga

SEQ ID NO: 4448 - DNA, 18 bp, Artificial sequence
  synthetic polynucleotide sequence
agggccacatcgatctca

SEQ ID NO: 4449 - DNA, 18 bp, Artificial sequence
  synthetic polynucleotide sequence
tcacagtcctcaggccca

SEQ ID NO: 4450 - DNA, 18 bp, Artificial sequence
  synthetic polynucleotide sequence
cagtccaggcaagtggga

SEQ ID NO: 4451 - DNA, 18 bp, Artificial sequence
  synthetic polynucleotide sequence
caacgagaccctgtacga

SEQ ID NO: 4452 - DNA, 18 bp, Artificial sequence
  synthetic polynucleotide sequence
gggtccagagcacgggga

SEQ ID NO: 4453 - DNA, 18 bp, Artificial sequence
  synthetic polynucleotide sequence
gcccactcacaacctgca

SEQ ID NO: 4454 - DNA, 18 bp, Artificial sequence
  synthetic polynucleotide sequence
ccatggtgaactggggga

SEQ ID NO: 4455 - DNA, 18 bp, Artificial sequence
  synthetic polynucleotide sequence
gaagtctgagtcagccca

SEQ ID NO: 4456 - DNA, 18 bp, Artificial sequence
  synthetic polynucleotide sequence
agacagagggggctggga

SEQ ID NO: 4457 - DNA, 18 bp, Artificial sequence
  synthetic polynucleotide sequence
catgagtcagccgagcca

SEQ ID NO: 4458 - DNA, 18 bp, Artificial sequence
  synthetic polynucleotide sequence
ccaggaggaacagtagga

SEQ ID NO: 4459 - DNA, 18 bp, Artificial sequence
  synthetic polynucleotide sequence
ccaggagttcagccccaa

SEQ ID NO: 4460 - DNA, 18 bp, Artificial sequence
  synthetic polynucleotide sequence
ggcgtcacagcattggga

SEQ ID NO: 4461 - DNA, 18 bp, Artificial sequence
  synthetic polynucleotide sequence
cgctaaggactgcggaca

SEQ ID NO: 4462 - DNA, 18 bp, Artificial sequence
  synthetic polynucleotide sequence
ccgggctctgcgggggca

SEQ ID NO: 4463 - DNA, 18 bp, Artificial sequence
  synthetic polynucleotide sequence
gggaaggagaacctgcca

SEQ ID NO: 4464 - DNA, 18 bp, Artificial sequence
  synthetic polynucleotide sequence
ctccgccaacacatggca

SEQ ID NO: 4465 - DNA, 18 bp, Artificial sequence
  synthetic polynucleotide sequence
cccgggttcgagcaggta

SEQ ID NO: 4466 - DNA, 18 bp, Artificial sequence
  synthetic polynucleotide sequence
attcaacgctgagacgca

SEQ ID NO: 4467 - DNA, 18 bp, Artificial sequence
  synthetic polynucleotide sequence
tgggcaatgccagagcca

SEQ ID NO: 4468 - DNA, 18 bp, Artificial sequence
  synthetic polynucleotide sequence
ccaggcgatgagcagcca

SEQ ID NO: 4469 - DNA, 18 bp, Artificial sequence
  synthetic polynucleotide sequence
aaccgaaccccgaggcaa

SEQ ID NO: 4470 - DNA, 18 bp, Artificial sequence
  synthetic polynucleotide sequence
tgcgcaggccatcaagca

SEQ ID NO: 4471 - DNA, 18 bp, Artificial sequence
  synthetic polynucleotide sequence
gcctgctgacactgagga

SEQ ID NO: 4472 - DNA, 18 bp, Artificial sequence
  synthetic polynucleotide sequence
gcctggccatcctcacca

SEQ ID NO: 4473 - DNA, 18 bp, Artificial sequence
  synthetic polynucleotide sequence
tggcatgggagaagacca

SEQ ID NO: 4474 - DNA, 18 bp, Artificial sequence
  synthetic polynucleotide sequence
agacgccatccactgcga

SEQ ID NO: 4475 - DNA, 18 bp, Artificial sequence
  synthetic polynucleotide sequence
acccgacaggagtggaca

SEQ ID NO: 4476 - DNA, 18 bp, Artificial sequence
  synthetic polynucleotide sequence
tgtgcagtggggccagca

SEQ ID NO: 4477 - DNA, 18 bp, Artificial sequence
  synthetic polynucleotide sequence
catggaggggtccccaga

SEQ ID NO: 4478 - DNA, 18 bp, Artificial sequence
  synthetic polynucleotide sequence
gcagctcttcaggcggca

SEQ ID NO: 4479 - DNA, 18 bp, Artificial sequence
  synthetic polynucleotide sequence
caggcaaatccccaggca

SEQ ID NO: 4480 - DNA, 18 bp, Artificial sequence
  synthetic polynucleotide sequence
ccacggcatcttccacga

SEQ ID NO: 4481 - DNA, 18 bp, Artificial sequence
  synthetic polynucleotide sequence
gatggatgtgaaccccga

SEQ ID NO: 4482 - DNA, 18 bp, Artificial sequence
  synthetic polynucleotide sequence
cggacgcacgagccgtga

SEQ ID NO: 4483 - DNA, 18 bp, Artificial sequence
  synthetic polynucleotide sequence
tagtgagccagagggcga

SEQ ID NO: 4484 - DNA, 18 bp, Artificial sequence
  synthetic polynucleotide sequence
acatgggccatgagggca

SEQ ID NO: 4485 - DNA, 18 bp, Artificial sequence
  synthetic polynucleotide sequence
aggagaggtctaaggcaa

SEQ ID NO: 4486 - DNA, 18 bp, Artificial sequence
  synthetic polynucleotide sequence
atgcaggtgatgcagcga

SEQ ID NO: 4487 - DNA, 18 bp, Artificial sequence
  synthetic polynucleotide sequence
gaggaagcgccacaccaa

SEQ ID NO: 4488 - DNA, 18 bp, Artificial sequence
  synthetic polynucleotide sequence
gagaggagcaaggggcga

SEQ ID NO: 4489 - DNA, 18 bp, Artificial sequence
  synthetic polynucleotide sequence
cgctcaccctcaagccca

SEQ ID NO: 4490 - DNA, 18 bp, Artificial sequence
  synthetic polynucleotide sequence
tgcagatccggcactgga

SEQ ID NO: 4491 - DNA, 18 bp, Artificial sequence
  synthetic polynucleotide sequence
gagctgctgaaccgggaa

SEQ ID NO: 4492 - DNA, 18 bp, Artificial sequence
  synthetic polynucleotide sequence
accagggccaccagctca

SEQ ID NO: 4493 - DNA, 18 bp, Artificial sequence
  synthetic polynucleotide sequence
cctccgcaagatgcagga

SEQ ID NO: 4494 - DNA, 18 bp, Artificial sequence
  synthetic polynucleotide sequence
cccttgaccacctgggaa

SEQ ID NO: 4495 - DNA, 18 bp, Artificial sequence
  synthetic polynucleotide sequence
cggccagtgcagtagtga

SEQ ID NO: 4496 - DNA, 18 bp, Artificial sequence
  synthetic polynucleotide sequence
ggtgactctgcaacagga

SEQ ID NO: 4497 - DNA, 18 bp, Artificial sequence
  synthetic polynucleotide sequence
aatgcaacagagcggcca

SEQ ID NO: 4498 - DNA, 18 bp, Artificial sequence
  synthetic polynucleotide sequence
ccaatgaccaagtgagga

SEQ ID NO: 4499 - DNA, 18 bp, Artificial sequence
  synthetic polynucleotide sequence
gctgctgagcacaggaca

SEQ ID NO: 4500 - DNA, 18 bp, Artificial sequence
  synthetic polynucleotide sequence
gcgtcagtagcatgcgga

SEQ ID NO: 4501 - DNA, 18 bp, Artificial sequence
  synthetic polynucleotide sequence
gcatccggaatatggaga

SEQ ID NO: 4502 - DNA, 18 bp, Artificial sequence
  synthetic polynucleotide sequence
ctctacgaggaactggca

SEQ ID NO: 4503 - DNA, 18 bp, Artificial sequence
  synthetic polynucleotide sequence
cggaacggcagaaagaca

SEQ ID NO: 4504 - DNA, 18 bp, Artificial sequence
  synthetic polynucleotide sequence
atgccaacctccaagaga

SEQ ID NO: 4505 - DNA, 18 bp, Artificial sequence
  synthetic polynucleotide sequence
ggaccaacagaaacggga

SEQ ID NO: 4506 - DNA, 18 bp, Artificial sequence
  synthetic polynucleotide sequence
gattccggcaactgacca

SEQ ID NO: 4507 - DNA, 18 bp, Artificial sequence
  synthetic polynucleotide sequence
gtgcatgggccagaagga

SEQ ID NO: 4508 - DNA, 18 bp, Artificial sequence
  synthetic polynucleotide sequence
agaaccagaggacaggta

SEQ ID NO: 4509 - DNA, 18 bp, Artificial sequence
  synthetic polynucleotide sequence
ccatcccccatggaacga

SEQ ID NO: 4510 - DNA, 18 bp, Artificial sequence
  synthetic polynucleotide sequence
tcccgatgaactcaagga

SEQ ID NO: 4511 - DNA, 18 bp, Artificial sequence
  synthetic polynucleotide sequence
agacttcccggcaggaga

SEQ ID NO: 4512 - DNA, 18 bp, Artificial sequence
  synthetic polynucleotide sequence
tcagcagctctcgaacca

SEQ ID NO: 4513 - DNA, 18 bp, Artificial sequence
  synthetic polynucleotide sequence
taggcgcttgaccccaca

SEQ ID NO: 4514 - DNA, 18 bp, Artificial sequence
  synthetic polynucleotide sequence
cataccgaggaggagcta

SEQ ID NO: 4515 - DNA, 18 bp, Artificial sequence
  synthetic polynucleotide sequence
ctgcagaaggacacacga

SEQ ID NO: 4516 - DNA, 18 bp, Artificial sequence
  synthetic polynucleotide sequence
tgcccgtgacagcctgga

SEQ ID NO: 4517 - DNA, 18 bp, Artificial sequence
  synthetic polynucleotide sequence
cggtgcagcagtgatgga

SEQ ID NO: 4518 - DNA, 18 bp, Artificial sequence
  synthetic polynucleotide sequence
agcagccaggtgttccga

SEQ ID NO: 4519 - DNA, 18 bp, Artificial sequence
  synthetic polynucleotide sequence
gacagggaccgaagagga

SEQ ID NO: 4520 - DNA, 18 bp, Artificial sequence
  synthetic polynucleotide sequence
gctgggggaggaactcga

SEQ ID NO: 4521 - DNA, 19 bp, Artificial sequence
  synthetic polynucleotide sequence
agtccaaagcctcaaagga

SEQ ID NO: 4522 - DNA, 17 bp, Artificial sequence
  synthetic polynucleotide sequence
ccctcctcgcaactcca

SEQ ID NO: 4523 - DNA, 18 bp, Artificial sequence
  synthetic polynucleotide sequence
catcctaggcacccagca

SEQ ID NO: 4524 - DNA, 18 bp, Artificial sequence
  synthetic polynucleotide sequence
gcagatgtcaatgacgca

SEQ ID NO: 4525 - DNA, 18 bp, Artificial sequence
  synthetic polynucleotide sequence
ccaaccccatccacctca

SEQ ID NO: 4526 - DNA, 18 bp, Artificial sequence
  synthetic polynucleotide sequence
gcgtgaacatcactccca

SEQ ID NO: 4527 - DNA, 18 bp, Artificial sequence
  synthetic polynucleotide sequence
cccgctccctgaggagga

SEQ ID NO: 4528 - DNA, 18 bp, Artificial sequence
  synthetic polynucleotide sequence
caatgagcagcgagtcca

SEQ ID NO: 4529 - DNA, 19 bp, Artificial sequence
  synthetic polynucleotide sequence
gggggattaaaagccacca

SEQ ID NO: 4530 - DNA, 19 bp, Artificial sequence
  synthetic polynucleotide sequence
caagggattgtgggcaaca

SEQ ID NO: 4531 - DNA, 18 bp, Artificial sequence
  synthetic polynucleotide sequence
acctgctggccagaggca

SEQ ID NO: 4532 - DNA, 18 bp, Artificial sequence
  synthetic polynucleotide sequence
gccacacctttacggcca

SEQ ID NO: 4533 - DNA, 18 bp, Artificial sequence
  synthetic polynucleotide sequence
tacgaggcgcaaggtgga

SEQ ID NO: 4534 - DNA, 18 bp, Artificial sequence
  synthetic polynucleotide sequence
gacttgaccctgaccgga

SEQ ID NO: 4535 - DNA, 18 bp, Artificial sequence
  synthetic polynucleotide sequence
gccccagaaagagcggga

SEQ ID NO: 4536 - DNA, 18 bp, Artificial sequence
  synthetic polynucleotide sequence
tgagggacacctgaggga

SEQ ID NO: 4537 - DNA, 18 bp, Artificial sequence
  synthetic polynucleotide sequence
gagacgaagtgacctcga

SEQ ID NO: 4538 - DNA, 18 bp, Artificial sequence
  synthetic polynucleotide sequence
gcgtgggactgataacca

SEQ ID NO: 4539 - DNA, 18 bp, Artificial sequence
  synthetic polynucleotide sequence
cggggaacagttcacaga

SEQ ID NO: 4540 - DNA, 18 bp, Artificial sequence
  synthetic polynucleotide sequence
ctcggtcccgaacactga

SEQ ID NO: 4541 - DNA, 18 bp, Artificial sequence
  synthetic polynucleotide sequence
ccggggactacagcacga

SEQ ID NO: 4542 - DNA, 18 bp, Artificial sequence
  synthetic polynucleotide sequence
tccgacactccatcagga

SEQ ID NO: 4543 - DNA, 18 bp, Artificial sequence
  synthetic polynucleotide sequence
gccatcgacaccgaggaa

SEQ ID NO: 4544 - DNA, 18 bp, Artificial sequence
  synthetic polynucleotide sequence
ccatgaggcagcggcaca

SEQ ID NO: 4545 - DNA, 18 bp, Artificial sequence
  synthetic polynucleotide sequence
aagccaggggctaagcca

SEQ ID NO: 4546 - DNA, 18 bp, Artificial sequence
  synthetic polynucleotide sequence
acgactgagcaggcctca

SEQ ID NO: 4547 - DNA, 18 bp, Artificial sequence
  synthetic polynucleotide sequence
gctggggaaaaggcagca

SEQ ID NO: 4548 - DNA, 18 bp, Artificial sequence
  synthetic polynucleotide sequence
gctggaggttgcagggca

SEQ ID NO: 4549 - DNA, 18 bp, Artificial sequence
  synthetic polynucleotide sequence
cagaaaaggtggaccaga

SEQ ID NO: 4550 - DNA, 18 bp, Artificial sequence
  synthetic polynucleotide sequence
cgccggtcgcctgggcga

SEQ ID NO: 4551 - DNA, 18 bp, Artificial sequence
  synthetic polynucleotide sequence
cgaggcatgcttgacaca

SEQ ID NO: 4552 - DNA, 18 bp, Artificial sequence
  synthetic polynucleotide sequence
ctgctggatacggagcca

SEQ ID NO: 4553 - DNA, 18 bp, Artificial sequence
  synthetic polynucleotide sequence
gagaccttggcaaggaga

SEQ ID NO: 4554 - DNA, 18 bp, Artificial sequence
  synthetic polynucleotide sequence
tggcagacagcaccgtga

SEQ ID NO: 4555 - DNA, 18 bp, Artificial sequence
  synthetic polynucleotide sequence
caaaggacgaccatgcaa

SEQ ID NO: 4556 - DNA, 18 bp, Artificial sequence
  synthetic polynucleotide sequence
acaaggtgaaccttggca

SEQ ID NO: 4557 - DNA, 17 bp, Artificial sequence
  synthetic polynucleotide sequence
gggcaggaaccgtggga

SEQ ID NO: 4558 - DNA, 17 bp, Artificial sequence
  synthetic polynucleotide sequence
cccggacgaaggaggca

SEQ ID NO: 4559 - DNA, 18 bp, Artificial sequence
  synthetic polynucleotide sequence
ccattgacggaatgacca

SEQ ID NO: 4560 - DNA, 18 bp, Artificial sequence
  synthetic polynucleotide sequence
catctgcgtcaggagcca

SEQ ID NO: 4561 - DNA, 18 bp, Artificial sequence
  synthetic polynucleotide sequence
gagaagcagctagaacca

SEQ ID NO: 4562 - DNA, 18 bp, Artificial sequence
  synthetic polynucleotide sequence
tcctaggagacacaacca

SEQ ID NO: 4563 - DNA, 18 bp, Artificial sequence
  synthetic polynucleotide sequence
acgacggtcagcaagcca

SEQ ID NO: 4564 - DNA, 18 bp, Artificial sequence
  synthetic polynucleotide sequence
cacgtcacttccaccgga

SEQ ID NO: 4565 - DNA, 18 bp, Artificial sequence
  synthetic polynucleotide sequence
tccccactacctccacca

SEQ ID NO: 4566 - DNA, 18 bp, Artificial sequence
  synthetic polynucleotide sequence
gctggaacactctggaga

SEQ ID NO: 4567 - DNA, 18 bp, Artificial sequence
  synthetic polynucleotide sequence
ggaccccaggatcgggaa

SEQ ID NO: 4568 - DNA, 18 bp, Artificial sequence
  synthetic polynucleotide sequence
acgggggtcgagaggcca

SEQ ID NO: 4569 - DNA, 18 bp, Artificial sequence
  synthetic polynucleotide sequence
cccctaagtccagccaga

SEQ ID NO: 4570 - DNA, 18 bp, Artificial sequence
  synthetic polynucleotide sequence
aatgggccaggggtggaa

SEQ ID NO: 4571 - DNA, 18 bp, Artificial sequence
  synthetic polynucleotide sequence
cctggccgatgtcagcaa

SEQ ID NO: 4572 - DNA, 18 bp, Artificial sequence
  synthetic polynucleotide sequence
agtccgtcagcaggggca

SEQ ID NO: 4573 - DNA, 18 bp, Artificial sequence
  synthetic polynucleotide sequence
ggcctacaagaaaccgga

SEQ ID NO: 4574 - DNA, 18 bp, Artificial sequence
  synthetic polynucleotide sequence
gcagcattctgagacgga

SEQ ID NO: 4575 - DNA, 18 bp, Artificial sequence
  synthetic polynucleotide sequence
accgccttgtggaaggga

SEQ ID NO: 4576 - DNA, 18 bp, Artificial sequence
  synthetic polynucleotide sequence
gcaaggaatcgtggggca

SEQ ID NO: 4577 - DNA, 18 bp, Artificial sequence
  synthetic polynucleotide sequence
caggtccagagagcccaa

SEQ ID NO: 4578 - DNA, 18 bp, Artificial sequence
  synthetic polynucleotide sequence
agggcgacagtcagggca

SEQ ID NO: 4579 - DNA, 18 bp, Artificial sequence
  synthetic polynucleotide sequence
tacggagtggggacccca

SEQ ID NO: 4580 - DNA, 18 bp, Artificial sequence
  synthetic polynucleotide sequence
gcagctgcaactccacca

SEQ ID NO: 4581 - DNA, 18 bp, Artificial sequence
  synthetic polynucleotide sequence
aggcaccctcgagaccca

SEQ ID NO: 4582 - DNA, 18 bp, Artificial sequence
  synthetic polynucleotide sequence
ggcacacggtacaagaga

SEQ ID NO: 4583 - DNA, 18 bp, Artificial sequence
  synthetic polynucleotide sequence
tgacatccgggtagccaa

SEQ ID NO: 4584 - DNA, 18 bp, Artificial sequence
  synthetic polynucleotide sequence
ccagttcaagacacacca

SEQ ID NO: 4585 - DNA, 18 bp, Artificial sequence
  synthetic polynucleotide sequence
tggtaccaccacagcaca

SEQ ID NO: 4586 - DNA, 18 bp, Artificial sequence
  synthetic polynucleotide sequence
tgatgagcatgggcagca

SEQ ID NO: 4587 - DNA, 18 bp, Artificial sequence
  synthetic polynucleotide sequence
agaccagctgcggggtca

SEQ ID NO: 4588 - DNA, 18 bp, Artificial sequence
  synthetic polynucleotide sequence
acagcagccatggaccca

SEQ ID NO: 4589 - DNA, 18 bp, Artificial sequence
  synthetic polynucleotide sequence
aaaggcctgaagcagtca

SEQ ID NO: 4590 - DNA, 18 bp, Artificial sequence
  synthetic polynucleotide sequence
agtacatcacggcgtgca

SEQ ID NO: 4591 - DNA, 18 bp, Artificial sequence
  synthetic polynucleotide sequence
tgagcctcccactgagga

SEQ ID NO: 4592 - DNA, 18 bp, Artificial sequence
  synthetic polynucleotide sequence
cattaggtgagaaggcca

SEQ ID NO: 4593 - DNA, 18 bp, Artificial sequence
  synthetic polynucleotide sequence
gacctgccaaacgtggga

SEQ ID NO: 4594 - DNA, 18 bp, Artificial sequence
  synthetic polynucleotide sequence
atggaggcacgagggcta

SEQ ID NO: 4595 - DNA, 18 bp, Artificial sequence
  synthetic polynucleotide sequence
ggaggggtcctagagcca

SEQ ID NO: 4596 - DNA, 18 bp, Artificial sequence
  synthetic polynucleotide sequence
ggagcccggttgatacca

SEQ ID NO: 4597 - DNA, 18 bp, Artificial sequence
  synthetic polynucleotide sequence
agtggaagtactgccaga

SEQ ID NO: 4598 - DNA, 18 bp, Artificial sequence
  synthetic polynucleotide sequence
gcagggcttcctgagaga

SEQ ID NO: 4599 - DNA, 18 bp, Artificial sequence
  synthetic polynucleotide sequence
ctaagcccagccgtggta

SEQ ID NO: 4600 - DNA, 18 bp, Artificial sequence
  synthetic polynucleotide sequence
aaccctgcagtgtgacga

SEQ ID NO: 4601 - DNA, 19 bp, Artificial sequence
  synthetic polynucleotide sequence
gcaagcacttcagcaacca

SEQ ID NO: 4602 - DNA, 18 bp, Artificial sequence
  synthetic polynucleotide sequence
cggtacaaacccaccaga

SEQ ID NO: 4603 - DNA, 18 bp, Artificial sequence
  synthetic polynucleotide sequence
gttgcaccagctacgcga

SEQ ID NO: 4604 - DNA, 18 bp, Artificial sequence
  synthetic polynucleotide sequence
ccctcttgccccgaagga

SEQ ID NO: 4605 - DNA, 18 bp, Artificial sequence
  synthetic polynucleotide sequence
acggtccccttcgacaga

SEQ ID NO: 4606 - DNA, 18 bp, Artificial sequence
  synthetic polynucleotide sequence
tgaggctgaagacgccca

SEQ ID NO: 4607 - DNA, 18 bp, Artificial sequence
  synthetic polynucleotide sequence
gcagaggttgcagagcca

SEQ ID NO: 4608 - DNA, 18 bp, Artificial sequence
  synthetic polynucleotide sequence
gcctgacacagttccaca

SEQ ID NO: 4609 - DNA, 18 bp, Artificial sequence
  synthetic polynucleotide sequence
gacagctggcagaaggga

SEQ ID NO: 4610 - DNA, 18 bp, Artificial sequence
  synthetic polynucleotide sequence
gggacgtgttggcagcca

SEQ ID NO: 4611 - DNA, 18 bp, Artificial sequence
  synthetic polynucleotide sequence
tggaaggtgcactggaca

SEQ ID NO: 4612 - DNA, 18 bp, Artificial sequence
  synthetic polynucleotide sequence
ccttctggccagacacca

SEQ ID NO: 4613 - DNA, 21 bp, Artificial sequence
  synthetic polynucleotide sequence
ccaacattagctgcagtgaca

SEQ ID NO: 4614 - DNA, 18 bp, Artificial sequence
  synthetic polynucleotide sequence
acgaagaccaggagggca

SEQ ID NO: 4615 - DNA, 18 bp, Artificial sequence
  synthetic polynucleotide sequence
ccgtgaccagagaaggca

SEQ ID NO: 4616 - DNA, 18 bp, Artificial sequence
  synthetic polynucleotide sequence
gccgctgatgaaggtgca

SEQ ID NO: 4617 - DNA, 18 bp, Artificial sequence
  synthetic polynucleotide sequence
tacaccatgcgacgagga

SEQ ID NO: 4618 - DNA, 18 bp, Artificial sequence
  synthetic polynucleotide sequence
ccacccaggccagggcga

SEQ ID NO: 4619 - DNA, 18 bp, Artificial sequence
  synthetic polynucleotide sequence
ggatcactgggaagacga

SEQ ID NO: 4620 - DNA, 18 bp, Artificial sequence
  synthetic polynucleotide sequence
agcggatggcatggagga

SEQ ID NO: 4621 - DNA, 18 bp, Artificial sequence
  synthetic polynucleotide sequence
ccctccggaacacaagga

SEQ ID NO: 4622 - DNA, 18 bp, Artificial sequence
  synthetic polynucleotide sequence
ggaggcagtacaccagga

SEQ ID NO: 4623 - DNA, 21 bp, Artificial sequence
  synthetic polynucleotide sequence
caaccatccagaacacaagga

SEQ ID NO: 4624 - DNA, 19 bp, Artificial sequence
  synthetic polynucleotide sequence
ctgaggaggcagtagacca

SEQ ID NO: 4625 - DNA, 18 bp, Artificial sequence
  synthetic polynucleotide sequence
cagccaagccctcggaca

SEQ ID NO: 4626 - DNA, 18 bp, Artificial sequence
  synthetic polynucleotide sequence
acgtgtgcagtacaccca

SEQ ID NO: 4627 - DNA, 18 bp, Artificial sequence
  synthetic polynucleotide sequence
gggcaggaagattcagga

SEQ ID NO: 4628 - DNA, 19 bp, Artificial sequence
  synthetic polynucleotide sequence
gctgccaaagttgagacca

SEQ ID NO: 4629 - DNA, 18 bp, Artificial sequence
  synthetic polynucleotide sequence
gcacctggggagaaccaa

SEQ ID NO: 4630 - DNA, 18 bp, Artificial sequence
  synthetic polynucleotide sequence
ctcctcagcgtggacaca

SEQ ID NO: 4631 - DNA, 18 bp, Artificial sequence
  synthetic polynucleotide sequence
gtgggagatgtgacagca

SEQ ID NO: 4632 - DNA, 18 bp, Artificial sequence
  synthetic polynucleotide sequence
gaatcagcgagtacggga

SEQ ID NO: 4633 - DNA, 18 bp, Artificial sequence
  synthetic polynucleotide sequence
gggaagagttggtgagca

SEQ ID NO: 4634 - DNA, 18 bp, Artificial sequence
  synthetic polynucleotide sequence
agtgagacagtgccacca

SEQ ID NO: 4635 - DNA, 18 bp, Artificial sequence
  synthetic polynucleotide sequence
cgtggcagtgcccacaca

SEQ ID NO: 4636 - DNA, 18 bp, Artificial sequence
  synthetic polynucleotide sequence
ccacaggtgcgttgggca

SEQ ID NO: 4637 - DNA, 18 bp, Artificial sequence
  synthetic polynucleotide sequence
cgctatggctcagagcaa

SEQ ID NO: 4638 - DNA, 18 bp, Artificial sequence
  synthetic polynucleotide sequence
aactgcattgccagcaca

SEQ ID NO: 4639 - DNA, 18 bp, Artificial sequence
  synthetic polynucleotide sequence
cgggtctcaagaccagga

SEQ ID NO: 4640 - DNA, 18 bp, Artificial sequence
  synthetic polynucleotide sequence
agagtgcagcagtgagca

SEQ ID NO: 4641 - DNA, 17 bp, Artificial sequence
  synthetic polynucleotide sequence
cggcatgggcctcacca

SEQ ID NO: 4642 - DNA, 18 bp, Artificial sequence
  synthetic polynucleotide sequence
gcagcaagaagcccacga

SEQ ID NO: 4643 - DNA, 18 bp, Artificial sequence
  synthetic polynucleotide sequence
ggcagaagttcacagcca

SEQ ID NO: 4644 - DNA, 18 bp, Artificial sequence
  synthetic polynucleotide sequence
agacaccatgacgcccca

SEQ ID NO: 4645 - DNA, 18 bp, Artificial sequence
  synthetic polynucleotide sequence
ggagagactgaggacaca

SEQ ID NO: 4646 - DNA, 18 bp, Artificial sequence
  synthetic polynucleotide sequence
cagacgttcagaacggca

SEQ ID NO: 4647 - DNA, 18 bp, Artificial sequence
  synthetic polynucleotide sequence
atcggctcggtgaccgaa

SEQ ID NO: 4648 - DNA, 18 bp, Artificial sequence
  synthetic polynucleotide sequence
gtcctgtgcagagcccca

SEQ ID NO: 4649 - DNA, 18 bp, Artificial sequence
  synthetic polynucleotide sequence
gtggtcgaggcggaggaa

SEQ ID NO: 4650 - DNA, 18 bp, Artificial sequence
  synthetic polynucleotide sequence
gagggagccgttcagcca

SEQ ID NO: 4651 - DNA, 18 bp, Artificial sequence
  synthetic polynucleotide sequence
ccggctcctaataacgga

SEQ ID NO: 4652 - DNA, 18 bp, Artificial sequence
  synthetic polynucleotide sequence
tgaaggggcactgtacca

SEQ ID NO: 4653 - DNA, 18 bp, Artificial sequence
  synthetic polynucleotide sequence
tggggaggtcaaccgcta

SEQ ID NO: 4654 - DNA, 18 bp, Artificial sequence
  synthetic polynucleotide sequence
atctggcagggtgagcca

SEQ ID NO: 4655 - DNA, 18 bp, Artificial sequence
  synthetic polynucleotide sequence
ggatgaacagcaccggca

SEQ ID NO: 4656 - DNA, 18 bp, Artificial sequence
  synthetic polynucleotide sequence
gcacatcaccctggacca

SEQ ID NO: 4657 - DNA, 18 bp, Artificial sequence
  synthetic polynucleotide sequence
ctcctggactacggacca

SEQ ID NO: 4658 - DNA, 18 bp, Artificial sequence
  synthetic polynucleotide sequence
agtggaaggcctcgggga

SEQ ID NO: 4659 - DNA, 18 bp, Artificial sequence
  synthetic polynucleotide sequence
caagatccagggcagcga

SEQ ID NO: 4660 - DNA, 18 bp, Artificial sequence
  synthetic polynucleotide sequence
cataggtggagtgggaga

SEQ ID NO: 4661 - DNA, 18 bp, Artificial sequence
  synthetic polynucleotide sequence
ccctggagacagaaggga

SEQ ID NO: 4662 - DNA, 18 bp, Artificial sequence
  synthetic polynucleotide sequence
cagcacttcggcatagca

SEQ ID NO: 4663 - DNA, 18 bp, Artificial sequence
  synthetic polynucleotide sequence
aggtgtccgacaagccca

SEQ ID NO: 4664 - DNA, 18 bp, Artificial sequence
  synthetic polynucleotide sequence
caccacctcttcaagcca

SEQ ID NO: 4665 - DNA, 18 bp, Artificial sequence
  synthetic polynucleotide sequence
acgggttcagcgaggaga

SEQ ID NO: 4666 - DNA, 18 bp, Artificial sequence
  synthetic polynucleotide sequence
tagcccagtgtccagcca

SEQ ID NO: 4667 - DNA, 18 bp, Artificial sequence
  synthetic polynucleotide sequence
gagcgaagaggtggccaa

SEQ ID NO: 4668 - DNA, 18 bp, Artificial sequence
  synthetic polynucleotide sequence
ataccccagggcatggga

SEQ ID NO: 4669 - DNA, 18 bp, Artificial sequence
  synthetic polynucleotide sequence
gaggaggaagaccagcca

SEQ ID NO: 4670 - DNA, 18 bp, Artificial sequence
  synthetic polynucleotide sequence
gggtccacaggttgacga

SEQ ID NO: 4671 - DNA, 18 bp, Artificial sequence
  synthetic polynucleotide sequence
gtggccagcatccagcaa

SEQ ID NO: 4672 - DNA, 18 bp, Artificial sequence
  synthetic polynucleotide sequence
tgctgaaccacctgggca

SEQ ID NO: 4673 - DNA, 18 bp, Artificial sequence
  synthetic polynucleotide sequence
ctgcccgaactgaccaga

SEQ ID NO: 4674 - DNA, 18 bp, Artificial sequence
  synthetic polynucleotide sequence
ggtccagggctctgagga

SEQ ID NO: 4675 - DNA, 18 bp, Artificial sequence
  synthetic polynucleotide sequence
agcctcgatggagcagca

SEQ ID NO: 4676 - DNA, 18 bp, Artificial sequence
  synthetic polynucleotide sequence
tagcagaggcatctagga

SEQ ID NO: 4677 - DNA, 18 bp, Artificial sequence
  synthetic polynucleotide sequence
gggcttatcgccagcaca

SEQ ID NO: 4678 - DNA, 18 bp, Artificial sequence
  synthetic polynucleotide sequence
cattagcacacacgccca

SEQ ID NO: 4679 - DNA, 19 bp, Artificial sequence
  synthetic polynucleotide sequence
gagaaggtggtgcaggaga

SEQ ID NO: 4680 - DNA, 17 bp, Artificial sequence
  synthetic polynucleotide sequence
ccctccgtcaaggcaga

SEQ ID NO: 4681 - DNA, 18 bp, Artificial sequence
  synthetic polynucleotide sequence
actccctagatgccccca

SEQ ID NO: 4682 - DNA, 18 bp, Artificial sequence
  synthetic polynucleotide sequence
caggccacactgaacgga

SEQ ID NO: 4683 - DNA, 18 bp, Artificial sequence
  synthetic polynucleotide sequence
gaagcccaggcctgcaga

SEQ ID NO: 4684 - DNA, 18 bp, Artificial sequence
  synthetic polynucleotide sequence
cttcaggggacatggcaa

SEQ ID NO: 4685 - DNA, 18 bp, Artificial sequence
  synthetic polynucleotide sequence
cggaagctgaggaagaca

SEQ ID NO: 4686 - DNA, 18 bp, Artificial sequence
  synthetic polynucleotide sequence
aggactagtccaaggcca

SEQ ID NO: 4687 - DNA, 18 bp, Artificial sequence
  synthetic polynucleotide sequence
ggctcaaaacttgggaga

SEQ ID NO: 4688 - DNA, 18 bp, Artificial sequence
  synthetic polynucleotide sequence
accccagcagtgttcaca

SEQ ID NO: 4689 - DNA, 18 bp, Artificial sequence
  synthetic polynucleotide sequence
tgaccaagccaccaagca

SEQ ID NO: 4690 - DNA, 18 bp, Artificial sequence
  synthetic polynucleotide sequence
accactcctggacggtga

SEQ ID NO: 4691 - DNA, 18 bp, Artificial sequence
  synthetic polynucleotide sequence
actgcttgccaaccccca

SEQ ID NO: 4692 - DNA, 18 bp, Artificial sequence
  synthetic polynucleotide sequence
ccgagtggaagtgcagga

SEQ ID NO: 4693 - DNA, 18 bp, Artificial sequence
  synthetic polynucleotide sequence
tggcaaaggaggagggga

SEQ ID NO: 4694 - DNA, 18 bp, Artificial sequence
  synthetic polynucleotide sequence
gatgcacagcctgcagca

SEQ ID NO: 4695 - DNA, 18 bp, Artificial sequence
  synthetic polynucleotide sequence
tacgtggacccccacaca

SEQ ID NO: 4696 - DNA, 18 bp, Artificial sequence
  synthetic polynucleotide sequence
ctgccgagtgacacagga

SEQ ID NO: 4697 - DNA, 18 bp, Artificial sequence
  synthetic polynucleotide sequence
gtgagccatgcagcccaa

SEQ ID NO: 4698 - DNA, 18 bp, Artificial sequence
  synthetic polynucleotide sequence
gtgatgctgaccgcagca

SEQ ID NO: 4699 - DNA, 18 bp, Artificial sequence
  synthetic polynucleotide sequence
tcggacagctgccaggaa

SEQ ID NO: 4700 - DNA, 18 bp, Artificial sequence
  synthetic polynucleotide sequence
cccgagacagagaccaga

SEQ ID NO: 4701 - DNA, 18 bp, Artificial sequence
  synthetic polynucleotide sequence
cgagcacgtacagcagca

SEQ ID NO: 4702 - DNA, 18 bp, Artificial sequence
  synthetic polynucleotide sequence
gctgtagccacaccgcca

SEQ ID NO: 4703 - DNA, 18 bp, Artificial sequence
  synthetic polynucleotide sequence
cccagcttcctgagggca

SEQ ID NO: 4704 - DNA, 18 bp, Artificial sequence
  synthetic polynucleotide sequence
ctcggagcattccgacca

SEQ ID NO: 4705 - DNA, 18 bp, Artificial sequence
  synthetic polynucleotide sequence
agttgggagcagggcgaa

SEQ ID NO: 4706 - DNA, 18 bp, Artificial sequence
  synthetic polynucleotide sequence
gagggagctgcttgacca

SEQ ID NO: 4707 - DNA, 18 bp, Artificial sequence
  synthetic polynucleotide sequence
cttcctgaggacccacga

SEQ ID NO: 4708 - DNA, 18 bp, Artificial sequence
  synthetic polynucleotide sequence
ctcggtggacatagccca

SEQ ID NO: 4709 - DNA, 18 bp, Artificial sequence
  synthetic polynucleotide sequence
ggacctggctgctaggaa

SEQ ID NO: 4710 - DNA, 18 bp, Artificial sequence
  synthetic polynucleotide sequence
atcctggaggtagcggga

SEQ ID NO: 4711 - DNA, 18 bp, Artificial sequence
  synthetic polynucleotide sequence
catgggccagttcgacca

SEQ ID NO: 4712 - DNA, 18 bp, Artificial sequence
  synthetic polynucleotide sequence
aaggagtccagggagcca

SEQ ID NO: 4713 - DNA, 18 bp, Artificial sequence
  synthetic polynucleotide sequence
gaaggtgggctacaccga

SEQ ID NO: 4714 - DNA, 18 bp, Artificial sequence
  synthetic polynucleotide sequence
cccgcaacatgcccacca

SEQ ID NO: 4715 - DNA, 18 bp, Artificial sequence
  synthetic polynucleotide sequence
gcggctaaacgacggaca

SEQ ID NO: 4716 - DNA, 18 bp, Artificial sequence
  synthetic polynucleotide sequence
ggatgttgcgagcagcca

SEQ ID NO: 4717 - DNA, 18 bp, Artificial sequence
  synthetic polynucleotide sequence
gtggtcaccaagagccga

SEQ ID NO: 4718 - DNA, 18 bp, Artificial sequence
  synthetic polynucleotide sequence
acagcgagcgatggacga

SEQ ID NO: 4719 - DNA, 18 bp, Artificial sequence
  synthetic polynucleotide sequence
cccagaagcatgagcgga

SEQ ID NO: 4720 - DNA, 18 bp, Artificial sequence
  synthetic polynucleotide sequence
gctccagcaccgacagga

SEQ ID NO: 4721 - DNA, 18 bp, Artificial sequence
  synthetic polynucleotide sequence
ccccacctgaaaagggga

SEQ ID NO: 4722 - DNA, 18 bp, Artificial sequence
  synthetic polynucleotide sequence
ggcatcagaatccagcca

SEQ ID NO: 4723 - DNA, 18 bp, Artificial sequence
  synthetic polynucleotide sequence
agctccgggagttccaga

SEQ ID NO: 4724 - DNA, 18 bp, Artificial sequence
  synthetic polynucleotide sequence
tgggggcaccactgacca

SEQ ID NO: 4725 - DNA, 18 bp, Artificial sequence
  synthetic polynucleotide sequence
tgaaccagcttcggggga

SEQ ID NO: 4726 - DNA, 18 bp, Artificial sequence
  synthetic polynucleotide sequence
tacccacactgcccacca

SEQ ID NO: 4727 - DNA, 18 bp, Artificial sequence
  synthetic polynucleotide sequence
gccttcgcagcctcacca

SEQ ID NO: 4728 - DNA, 18 bp, Artificial sequence
  synthetic polynucleotide sequence
tcggagtggagcagctga

SEQ ID NO: 4729 - DNA, 18 bp, Artificial sequence
  synthetic polynucleotide sequence
cccttcacggaggaccca

SEQ ID NO: 4730 - DNA, 18 bp, Artificial sequence
  synthetic polynucleotide sequence
tgcccactggctccagca

SEQ ID NO: 4731 - DNA, 18 bp, Artificial sequence
  synthetic polynucleotide sequence
ccgagctggcagaaccaa

SEQ ID NO: 4732 - DNA, 18 bp, Artificial sequence
  synthetic polynucleotide sequence
tgaattcccaacgcacca

SEQ ID NO: 4733 - DNA, 18 bp, Artificial sequence
  synthetic polynucleotide sequence
gcagcagtgaaacagcca

SEQ ID NO: 4734 - DNA, 18 bp, Artificial sequence
  synthetic polynucleotide sequence
cagtcacaccagaaggca

SEQ ID NO: 4735 - DNA, 19 bp, Artificial sequence
  synthetic polynucleotide sequence
ccgagacttggagccagaa

SEQ ID NO: 4736 - DNA, 16 bp, Artificial sequence
  synthetic polynucleotide sequence
cgctgcttgaccgaca

SEQ ID NO: 4737 - DNA, 18 bp, Artificial sequence
  synthetic polynucleotide sequence
gcagctgaaccagcggaa

SEQ ID NO: 4738 - DNA, 18 bp, Artificial sequence
  synthetic polynucleotide sequence
tcaggtccagaggcccga

SEQ ID NO: 4739 - DNA, 18 bp, Artificial sequence
  synthetic polynucleotide sequence
acggcagcagcaagagca

SEQ ID NO: 4740 - DNA, 18 bp, Artificial sequence
  synthetic polynucleotide sequence
ccagattgctcgaggcca

SEQ ID NO: 4741 - DNA, 18 bp, Artificial sequence
  synthetic polynucleotide sequence
catggccacccctgccaa

SEQ ID NO: 4742 - DNA, 18 bp, Artificial sequence
  synthetic polynucleotide sequence
gctgggagagcccacaga

SEQ ID NO: 4743 - DNA, 18 bp, Artificial sequence
  synthetic polynucleotide sequence
ggaagaggaagaggagga

SEQ ID NO: 4744 - DNA, 18 bp, Artificial sequence
  synthetic polynucleotide sequence
gccccagaacccctgtga

SEQ ID NO: 4745 - DNA, 18 bp, Artificial sequence
  synthetic polynucleotide sequence
cacagtgagggggaggaa

SEQ ID NO: 4746 - DNA, 18 bp, Artificial sequence
  synthetic polynucleotide sequence
acatgccacaggtaccca

SEQ ID NO: 4747 - DNA, 18 bp, Artificial sequence
  synthetic polynucleotide sequence
ggcctgtgacctgaacca

SEQ ID NO: 4748 - DNA, 18 bp, Artificial sequence
  synthetic polynucleotide sequence
tgtctgagcacccacaga

SEQ ID NO: 4749 - DNA, 19 bp, Artificial sequence
  synthetic polynucleotide sequence
ggcacagtctacaagggca

SEQ ID NO: 4750 - DNA, 17 bp, Artificial sequence
  synthetic polynucleotide sequence
ggagcccacaccagcca

SEQ ID NO: 4751 - DNA, 18 bp, Artificial sequence
  synthetic polynucleotide sequence
ggccatctcaccaaacga

SEQ ID NO: 4752 - DNA, 18 bp, Artificial sequence
  synthetic polynucleotide sequence
gtagagcctggatcacca

SEQ ID NO: 4753 - DNA, 18 bp, Artificial sequence
  synthetic polynucleotide sequence
gaaccggaggagaaggca

SEQ ID NO: 4754 - DNA, 18 bp, Artificial sequence
  synthetic polynucleotide sequence
tacagggtggagtgggca

SEQ ID NO: 4755 - DNA, 18 bp, Artificial sequence
  synthetic polynucleotide sequence
cccagactacctgcagga

SEQ ID NO: 4756 - DNA, 18 bp, Artificial sequence
  synthetic polynucleotide sequence
tgtaaggtggaggcggca

SEQ ID NO: 4757 - DNA, 18 bp, Artificial sequence
  synthetic polynucleotide sequence
ggggacacaagctggaga

SEQ ID NO: 4758 - DNA, 18 bp, Artificial sequence
  synthetic polynucleotide sequence
ggtgtcagcctgcaagga

SEQ ID NO: 4759 - DNA, 18 bp, Artificial sequence
  synthetic polynucleotide sequence
caacagtccctggccgaa

SEQ ID NO: 4760 - DNA, 18 bp, Artificial sequence
  synthetic polynucleotide sequence
tggaggcagacaattcca

SEQ ID NO: 4761 - DNA, 18 bp, Artificial sequence
  synthetic polynucleotide sequence
ccagcaggccctcaagga

SEQ ID NO: 4762 - DNA, 18 bp, Artificial sequence
  synthetic polynucleotide sequence
gtctccaggtaccgccca

SEQ ID NO: 4763 - DNA, 18 bp, Artificial sequence
  synthetic polynucleotide sequence
gtggctcaagacccagga

SEQ ID NO: 4764 - DNA, 18 bp, Artificial sequence
  synthetic polynucleotide sequence
gggcaccagacctcagca

SEQ ID NO: 4765 - DNA, 18 bp, Artificial sequence
  synthetic polynucleotide sequence
aggcacagcatctgcaga

SEQ ID NO: 4766 - DNA, 18 bp, Artificial sequence
  synthetic polynucleotide sequence
atgtcaatgccccgacga

SEQ ID NO: 4767 - DNA, 18 bp, Artificial sequence
  synthetic polynucleotide sequence
ccaaaggccgtggaacca

SEQ ID NO: 4768 - DNA, 18 bp, Artificial sequence
  synthetic polynucleotide sequence
aggaggctctcggactca

SEQ ID NO: 4769 - DNA, 18 bp, Artificial sequence
  synthetic polynucleotide sequence
gacgtgctggaacaggga

SEQ ID NO: 4770 - DNA, 18 bp, Artificial sequence
  synthetic polynucleotide sequence
gaggtcatccaggaccga

SEQ ID NO: 4771 - DNA, 18 bp, Artificial sequence
  synthetic polynucleotide sequence
gcaaggatgaacggacca

SEQ ID NO: 4772 - DNA, 18 bp, Artificial sequence
  synthetic polynucleotide sequence
cctgtgaggaggaggcga

SEQ ID NO: 4773 - DNA, 18 bp, Artificial sequence
  synthetic polynucleotide sequence
tggtactagaggacccaa

SEQ ID NO: 4774 - DNA, 18 bp, Artificial sequence
  synthetic polynucleotide sequence
gtcataacgtggagacca

SEQ ID NO: 4775 - DNA, 18 bp, Artificial sequence
  synthetic polynucleotide sequence
cggggaggaggatggaga

SEQ ID NO: 4776 - DNA, 18 bp, Artificial sequence
  synthetic polynucleotide sequence
acttgagccacacgtgga

SEQ ID NO: 4777 - DNA, 18 bp, Artificial sequence
  synthetic polynucleotide sequence
atccaggcagtggccaga

SEQ ID NO: 4778 - DNA, 18 bp, Artificial sequence
  synthetic polynucleotide sequence
cgggccacctcgtcggga

SEQ ID NO: 4779 - DNA, 18 bp, Artificial sequence
  synthetic polynucleotide sequence
ccagccacagaacccaga

SEQ ID NO: 4780 - DNA, 18 bp, Artificial sequence
  synthetic polynucleotide sequence
ccagggggttggaggtga

SEQ ID NO: 4781 - DNA, 18 bp, Artificial sequence
  synthetic polynucleotide sequence
ccccctggaccacaccaa

SEQ ID NO: 4782 - DNA, 18 bp, Artificial sequence
  synthetic polynucleotide sequence
tcaccatcatgggcgaga

SEQ ID NO: 4783 - DNA, 18 bp, Artificial sequence
  synthetic polynucleotide sequence
cgagctgatacccagaca

SEQ ID NO: 4784 - DNA, 18 bp, Artificial sequence
  synthetic polynucleotide sequence
gttgggcctgccgacgaa

SEQ ID NO: 4785 - DNA, 18 bp, Artificial sequence
  synthetic polynucleotide sequence
gcccacacacttcaggaa

SEQ ID NO: 4786 - DNA, 18 bp, Artificial sequence
  synthetic polynucleotide sequence
tagtgagacctggggcca

SEQ ID NO: 4787 - DNA, 18 bp, Artificial sequence
  synthetic polynucleotide sequence
tccagacagatgaggtga

SEQ ID NO: 4788 - DNA, 18 bp, Artificial sequence
  synthetic polynucleotide sequence
acactgcgttcgggacca

SEQ ID NO: 4789 - DNA, 18 bp, Artificial sequence
  synthetic polynucleotide sequence
gccagaagggaaaggcca

SEQ ID NO: 4790 - DNA, 18 bp, Artificial sequence
  synthetic polynucleotide sequence
tcctgaagggctgggcca

SEQ ID NO: 4791 - DNA, 18 bp, Artificial sequence
  synthetic polynucleotide sequence
gcccaatgcacacggcaa

SEQ ID NO: 4792 - DNA, 18 bp, Artificial sequence
  synthetic polynucleotide sequence
tctgtgccaggcacccca

SEQ ID NO: 4793 - DNA, 18 bp, Artificial sequence
  synthetic polynucleotide sequence
ggggacatcagtgcgaga

SEQ ID NO: 4794 - DNA, 18 bp, Artificial sequence
  synthetic polynucleotide sequence
ggacgaagccatcaggga

SEQ ID NO: 4795 - DNA, 18 bp, Artificial sequence
  synthetic polynucleotide sequence
ctggcctacatgcaagca

SEQ ID NO: 4796 - DNA, 18 bp, Artificial sequence
  synthetic polynucleotide sequence
ggcgctcgaagaatggta

SEQ ID NO: 4797 - DNA, 18 bp, Artificial sequence
  synthetic polynucleotide sequence
ggagagtgtggaacagca

SEQ ID NO: 4798 - DNA, 18 bp, Artificial sequence
  synthetic polynucleotide sequence
cgcctcggctaggcgcca

SEQ ID NO: 4799 - DNA, 18 bp, Artificial sequence
  synthetic polynucleotide sequence
gtgctgcccaggaaccca

SEQ ID NO: 4800 - DNA, 18 bp, Artificial sequence
  synthetic polynucleotide sequence
cctatgacagccacctca

SEQ ID NO: 4801 - DNA, 18 bp, Artificial sequence
  synthetic polynucleotide sequence
gcagcggcctgcacacca

SEQ ID NO: 4802 - DNA, 18 bp, Artificial sequence
  synthetic polynucleotide sequence
ccaaccttaactgcccca

SEQ ID NO: 4803 - DNA, 18 bp, Artificial sequence
  synthetic polynucleotide sequence
ggcagattacatcaggca

SEQ ID NO: 4804 - DNA, 18 bp, Artificial sequence
  synthetic polynucleotide sequence
aggcacagtcatcatgca

SEQ ID NO: 4805 - DNA, 18 bp, Artificial sequence
  synthetic polynucleotide sequence
ctacctgaacgaccacca

SEQ ID NO: 4806 - DNA, 18 bp, Artificial sequence
  synthetic polynucleotide sequence
ggctgaagatataccgca

SEQ ID NO: 4807 - DNA, 18 bp, Artificial sequence
  synthetic polynucleotide sequence
cccaagagctcagacaca

SEQ ID NO: 4808 - DNA, 18 bp, Artificial sequence
  synthetic polynucleotide sequence
agggcctggctggagaga

SEQ ID NO: 4809 - DNA, 18 bp, Artificial sequence
  synthetic polynucleotide sequence
cacagtctcaggcatgga

SEQ ID NO: 4810 - DNA, 18 bp, Artificial sequence
  synthetic polynucleotide sequence
catcccgaaggtgccgta

SEQ ID NO: 4811 - DNA, 18 bp, Artificial sequence
  synthetic polynucleotide sequence
gaagctggctggagagga

SEQ ID NO: 4812 - DNA, 18 bp, Artificial sequence
  synthetic polynucleotide sequence
tcaaggaagcgggcacca

SEQ ID NO: 4813 - DNA, 18 bp, Artificial sequence
  synthetic polynucleotide sequence
caacctggcagacaggga

SEQ ID NO: 4814 - DNA, 18 bp, Artificial sequence
  synthetic polynucleotide sequence
gagcgccagacgagacca

SEQ ID NO: 4815 - DNA, 18 bp, Artificial sequence
  synthetic polynucleotide sequence
cctgaccaagttggccga

SEQ ID NO: 4816 - DNA, 18 bp, Artificial sequence
  synthetic polynucleotide sequence
ggtcaattgagcgccaca

SEQ ID NO: 4817 - DNA, 18 bp, Artificial sequence
  synthetic polynucleotide sequence
gcactgcagccctccaca

SEQ ID NO: 4818 - DNA, 18 bp, Artificial sequence
  synthetic polynucleotide sequence
tgtggagggacaccgcta

SEQ ID NO: 4819 - DNA, 18 bp, Artificial sequence
  synthetic polynucleotide sequence
cgctcattcccacggaga

SEQ ID NO: 4820 - DNA, 18 bp, Artificial sequence
  synthetic polynucleotide sequence
aggctcctgactgggaca

SEQ ID NO: 4821 - DNA, 18 bp, Artificial sequence
  synthetic polynucleotide sequence
gcgagaagctctgcacga

SEQ ID NO: 4822 - DNA, 18 bp, Artificial sequence
  synthetic polynucleotide sequence
ccctccagcttcacccca

SEQ ID NO: 4823 - DNA, 18 bp, Artificial sequence
  synthetic polynucleotide sequence
atcacctcctcagcccca

SEQ ID NO: 4824 - DNA, 18 bp, Artificial sequence
  synthetic polynucleotide sequence
cgaagggaccggcaacca

SEQ ID NO: 4825 - DNA, 18 bp, Artificial sequence
  synthetic polynucleotide sequence
agtgatcgaccagagcta

SEQ ID NO: 4826 - DNA, 18 bp, Artificial sequence
  synthetic polynucleotide sequence
cgggaagcaccaactgca

SEQ ID NO: 4827 - DNA, 18 bp, Artificial sequence
  synthetic polynucleotide sequence
tgctgggcaaacaggcca

SEQ ID NO: 4828 - DNA, 18 bp, Artificial sequence
  synthetic polynucleotide sequence
ctgtcaccacagctggca

SEQ ID NO: 4829 - DNA, 18 bp, Artificial sequence
  synthetic polynucleotide sequence
agaccgtcctgccacgga

SEQ ID NO: 4830 - DNA, 18 bp, Artificial sequence
  synthetic polynucleotide sequence
tcagagtccacggctcca

SEQ ID NO: 4831 - DNA, 18 bp, Artificial sequence
  synthetic polynucleotide sequence
ccgtggaggaggagagga

SEQ ID NO: 4832 - DNA, 18 bp, Artificial sequence
  synthetic polynucleotide sequence
tctgcaccccacagcgca

SEQ ID NO: 4833 - DNA, 18 bp, Artificial sequence
  synthetic polynucleotide sequence
cagcttcgactcagagga

SEQ ID NO: 4834 - DNA, 18 bp, Artificial sequence
  synthetic polynucleotide sequence
ggtcagcacggtcccgca

SEQ ID NO: 4835 - DNA, 18 bp, Artificial sequence
  synthetic polynucleotide sequence
cgaagatgactgcagcca

SEQ ID NO: 4836 - DNA, 18 bp, Artificial sequence
  synthetic polynucleotide sequence
ccagcacagctgcaggta

SEQ ID NO: 4837 - DNA, 18 bp, Artificial sequence
  synthetic polynucleotide sequence
aggctcccggcagatcca

SEQ ID NO: 4838 - DNA, 18 bp, Artificial sequence
  synthetic polynucleotide sequence
aggcgatgacatggcgga

SEQ ID NO: 4839 - DNA, 18 bp, Artificial sequence
  synthetic polynucleotide sequence
agcctgaggaggtcgcca

SEQ ID NO: 4840 - DNA, 18 bp, Artificial sequence
  synthetic polynucleotide sequence
gattgtccgggaaggcca

SEQ ID NO: 4841 - DNA, 18 bp, Artificial sequence
  synthetic polynucleotide sequence
cccccttaccagaggcga

SEQ ID NO: 4842 - DNA, 18 bp, Artificial sequence
  synthetic polynucleotide sequence
cctcgacctgtccaggca

SEQ ID NO: 4843 - DNA, 18 bp, Artificial sequence
  synthetic polynucleotide sequence
agctgatgcccagcccca

SEQ ID NO: 4844 - DNA, 18 bp, Artificial sequence
  synthetic polynucleotide sequence
atgcagcccgtcctcgga

SEQ ID NO: 4845 - DNA, 18 bp, Artificial sequence
  synthetic polynucleotide sequence
cagagagagcagcagcga

SEQ ID NO: 4846 - DNA, 18 bp, Artificial sequence
  synthetic polynucleotide sequence
tccgcagaggtgaacaca

SEQ ID NO: 4847 - DNA, 18 bp, Artificial sequence
  synthetic polynucleotide sequence
aacttgcccctgccacca

SEQ ID NO: 4848 - DNA, 18 bp, Artificial sequence
  synthetic polynucleotide sequence
aggtggaggtggcaggga

SEQ ID NO: 4849 - DNA, 18 bp, Artificial sequence
  synthetic polynucleotide sequence
aggggcttctcaggccaa

SEQ ID NO: 4850 - DNA, 18 bp, Artificial sequence
  synthetic polynucleotide sequence
ctgccactgcggggtcca

SEQ ID NO: 4851 - DNA, 18 bp, Artificial sequence
  synthetic polynucleotide sequence
cagacaagccagccgaga

SEQ ID NO: 4852 - DNA, 18 bp, Artificial sequence
  synthetic polynucleotide sequence
cacaggcttctccaccga

SEQ ID NO: 4853 - DNA, 18 bp, Artificial sequence
  synthetic polynucleotide sequence
tccgcgagaaggaccaga

SEQ ID NO: 4854 - DNA, 18 bp, Artificial sequence
  synthetic polynucleotide sequence
aggcctcgtatggggaca

SEQ ID NO: 4855 - DNA, 18 bp, Artificial sequence
  synthetic polynucleotide sequence
acctgccggaaaccacca

SEQ ID NO: 4856 - DNA, 18 bp, Artificial sequence
  synthetic polynucleotide sequence
ccggcgagtagtagggca

SEQ ID NO: 4857 - DNA, 18 bp, Artificial sequence
  synthetic polynucleotide sequence
ggaaacgtccagcaccga

SEQ ID NO: 4858 - DNA, 18 bp, Artificial sequence
  synthetic polynucleotide sequence
ccacgatccatgaggcca

SEQ ID NO: 4859 - DNA, 18 bp, Artificial sequence
  synthetic polynucleotide sequence
ctaagctacgctgggcaa

SEQ ID NO: 4860 - DNA, 18 bp, Artificial sequence
  synthetic polynucleotide sequence
gaatgggcaggcatagca

SEQ ID NO: 4861 - DNA, 18 bp, Artificial sequence
  synthetic polynucleotide sequence
ggcataagggaggaggaa

SEQ ID NO: 4862 - DNA, 18 bp, Artificial sequence
  synthetic polynucleotide sequence
gagtgccacaccacctga

SEQ ID NO: 4863 - DNA, 18 bp, Artificial sequence
  synthetic polynucleotide sequence
tcgctcacgccatccaga

SEQ ID NO: 4864 - DNA, 18 bp, Artificial sequence
  synthetic polynucleotide sequence
caacgtggccattacgca

SEQ ID NO: 4865 - DNA, 18 bp, Artificial sequence
  synthetic polynucleotide sequence
tgccagcactggacgaga

SEQ ID NO: 4866 - DNA, 18 bp, Artificial sequence
  synthetic polynucleotide sequence
ctcgcagataggcgctca

SEQ ID NO: 4867 - DNA, 18 bp, Artificial sequence
  synthetic polynucleotide sequence
ccgaaggctactcgcaga

SEQ ID NO: 4868 - DNA, 18 bp, Artificial sequence
  synthetic polynucleotide sequence
tcgatgcgaagctgacga

SEQ ID NO: 4869 - DNA, 18 bp, Artificial sequence
  synthetic polynucleotide sequence
aggaagatgtccgagcaa

SEQ ID NO: 4870 - DNA, 18 bp, Artificial sequence
  synthetic polynucleotide sequence
gggctaccaccactccca

SEQ ID NO: 4871 - DNA, 18 bp, Artificial sequence
  synthetic polynucleotide sequence
gcggcagcagatcaacga

SEQ ID NO: 4872 - DNA, 18 bp, Artificial sequence
  synthetic polynucleotide sequence
tagccatccggaggggca

SEQ ID NO: 4873 - DNA, 18 bp, Artificial sequence
  synthetic polynucleotide sequence
agtgctgaggtccaggca

SEQ ID NO: 4874 - DNA, 18 bp, Artificial sequence
  synthetic polynucleotide sequence
ccgagaatcactgaggca

SEQ ID NO: 4875 - DNA, 18 bp, Artificial sequence
  synthetic polynucleotide sequence
ctctcagcagaagcggta

SEQ ID NO: 4876 - DNA, 18 bp, Artificial sequence
  synthetic polynucleotide sequence
agatctccaacctgcaca

SEQ ID NO: 4877 - DNA, 18 bp, Artificial sequence
  synthetic polynucleotide sequence
tggatgccgggataccca

SEQ ID NO: 4878 - DNA, 18 bp, Artificial sequence
  synthetic polynucleotide sequence
tccatctcaagcagcgca

SEQ ID NO: 4879 - DNA, 18 bp, Artificial sequence
  synthetic polynucleotide sequence
tgcagagaagagccggga

SEQ ID NO: 4880 - DNA, 18 bp, Artificial sequence
  synthetic polynucleotide sequence
atcagagtccagggcgca

SEQ ID NO: 4881 - DNA, 18 bp, Artificial sequence
  synthetic polynucleotide sequence
atgaccttggcaccgaga

SEQ ID NO: 4882 - DNA, 18 bp, Artificial sequence
  synthetic polynucleotide sequence
caccacattccagaagca

SEQ ID NO: 4883 - DNA, 18 bp, Artificial sequence
  synthetic polynucleotide sequence
ggcccaagtggctagcca

SEQ ID NO: 4884 - DNA, 18 bp, Artificial sequence
  synthetic polynucleotide sequence
ccatcgtagtcgaggcaa

SEQ ID NO: 4885 - DNA, 18 bp, Artificial sequence
  synthetic polynucleotide sequence
acctggcaggcagtcaga

SEQ ID NO: 4886 - DNA, 18 bp, Artificial sequence
  synthetic polynucleotide sequence
cataaggccacgattgca

SEQ ID NO: 4887 - DNA, 18 bp, Artificial sequence
  synthetic polynucleotide sequence
gcttatcgcagcgggaca

SEQ ID NO: 4888 - DNA, 18 bp, Artificial sequence
  synthetic polynucleotide sequence
ggcacctgactactggga

SEQ ID NO: 4889 - DNA, 18 bp, Artificial sequence
  synthetic polynucleotide sequence
ggtggaccaattggccaa

SEQ ID NO: 4890 - DNA, 18 bp, Artificial sequence
  synthetic polynucleotide sequence
gagagtggatcagcggca

SEQ ID NO: 4891 - DNA, 18 bp, Artificial sequence
  synthetic polynucleotide sequence
cccacaggtgctacagga

SEQ ID NO: 4892 - DNA, 18 bp, Artificial sequence
  synthetic polynucleotide sequence
acaaccgggacacagcca

SEQ ID NO: 4893 - DNA, 18 bp, Artificial sequence
  synthetic polynucleotide sequence
gtggcagagcttcccaga

SEQ ID NO: 4894 - DNA, 18 bp, Artificial sequence
  synthetic polynucleotide sequence
cggctgtggtgagaacca

SEQ ID NO: 4895 - DNA, 18 bp, Artificial sequence
  synthetic polynucleotide sequence
actcatcagcaccccaga

SEQ ID NO: 4896 - DNA, 18 bp, Artificial sequence
  synthetic polynucleotide sequence
atgaggctccaatcagca

SEQ ID NO: 4897 - DNA, 18 bp, Artificial sequence
  synthetic polynucleotide sequence
gggtcaaagtccagagga

SEQ ID NO: 4898 - DNA, 18 bp, Artificial sequence
  synthetic polynucleotide sequence
gtgcataagacccggtga

SEQ ID NO: 4899 - DNA, 18 bp, Artificial sequence
  synthetic polynucleotide sequence
cccctgccaaaatcagga

SEQ ID NO: 4900 - DNA, 18 bp, Artificial sequence
  synthetic polynucleotide sequence
aggaggctgttggagaca

SEQ ID NO: 4901 - DNA, 18 bp, Artificial sequence
  synthetic polynucleotide sequence
ctgccagtgcaacccaga

SEQ ID NO: 4902 - DNA, 18 bp, Artificial sequence
  synthetic polynucleotide sequence
cagtgctctgaggcccca

SEQ ID NO: 4903 - DNA, 18 bp, Artificial sequence
  synthetic polynucleotide sequence
ccgctgaccattgggaca

SEQ ID NO: 4904 - DNA, 18 bp, Artificial sequence
  synthetic polynucleotide sequence
ccagcctgccacgtcaga

SEQ ID NO: 4905 - DNA, 18 bp, Artificial sequence
  synthetic polynucleotide sequence
ggaggagctggagagaca

SEQ ID NO: 4906 - DNA, 18 bp, Artificial sequence
  synthetic polynucleotide sequence
gcctcttccaggagggca

SEQ ID NO: 4907 - DNA, 18 bp, Artificial sequence
  synthetic polynucleotide sequence
ccacgctgatgacgcaga

SEQ ID NO: 4908 - DNA, 18 bp, Artificial sequence
  synthetic polynucleotide sequence
tgcggtccacgtagggca

SEQ ID NO: 4909 - DNA, 18 bp, Artificial sequence
  synthetic polynucleotide sequence
cccaggatcgttggagga

SEQ ID NO: 4910 - DNA, 18 bp, Artificial sequence
  synthetic polynucleotide sequence
ccaatgatggagcctcca

SEQ ID NO: 4911 - DNA, 18 bp, Artificial sequence
  synthetic polynucleotide sequence
gtgccagaccccaaccca

SEQ ID NO: 4912 - DNA, 18 bp, Artificial sequence
  synthetic polynucleotide sequence
cgcgggtcatcgaagaca

SEQ ID NO: 4913 - DNA, 18 bp, Artificial sequence
  synthetic polynucleotide sequence
tccaccgtgcagtgggaa

SEQ ID NO: 4914 - DNA, 18 bp, Artificial sequence
  synthetic polynucleotide sequence
tccagctcgccatacaca

SEQ ID NO: 4915 - DNA, 18 bp, Artificial sequence
  synthetic polynucleotide sequence
gcaagctatgcaacagga

SEQ ID NO: 4916 - DNA, 18 bp, Artificial sequence
  synthetic polynucleotide sequence
aacaggtggggatgacca

SEQ ID NO: 4917 - DNA, 18 bp, Artificial sequence
  synthetic polynucleotide sequence
cggatgcagagatcggca

SEQ ID NO: 4918 - DNA, 18 bp, Artificial sequence
  synthetic polynucleotide sequence
gcttgccaatgcgcacca

SEQ ID NO: 4919 - DNA, 18 bp, Artificial sequence
  synthetic polynucleotide sequence
gcacctggccacggcaga

SEQ ID NO: 4920 - DNA, 18 bp, Artificial sequence
  synthetic polynucleotide sequence
agcccagatggccagaca

SEQ ID NO: 4921 - DNA, 18 bp, Artificial sequence
  synthetic polynucleotide sequence
gagccagggccagagcca

SEQ ID NO: 4922 - DNA, 18 bp, Artificial sequence
  synthetic polynucleotide sequence
gtgcggacacttcggcaa

SEQ ID NO: 4923 - DNA, 18 bp, Artificial sequence
  synthetic polynucleotide sequence
cctgcccaagcacaccta

SEQ ID NO: 4924 - DNA, 18 bp, Artificial sequence
  synthetic polynucleotide sequence
gggagatgaggactcgca

SEQ ID NO: 4925 - DNA, 18 bp, Artificial sequence
  synthetic polynucleotide sequence
gcgctgaggctgaccgca

SEQ ID NO: 4926 - DNA, 18 bp, Artificial sequence
  synthetic polynucleotide sequence
gtccctgaactcggccga

SEQ ID NO: 4927 - DNA, 18 bp, Artificial sequence
  synthetic polynucleotide sequence
gtgtgacctcaccgacga

SEQ ID NO: 4928 - DNA, 18 bp, Artificial sequence
  synthetic polynucleotide sequence
cagaggctccccagcaga

SEQ ID NO: 4929 - DNA, 18 bp, Artificial sequence
  synthetic polynucleotide sequence
gcagggatgcaaacgcca

SEQ ID NO: 4930 - DNA, 18 bp, Artificial sequence
  synthetic polynucleotide sequence
tgggctcccagtaaccca

SEQ ID NO: 4931 - DNA, 18 bp, Artificial sequence
  synthetic polynucleotide sequence
acgacggggatgagcaga

SEQ ID NO: 4932 - DNA, 18 bp, Artificial sequence
  synthetic polynucleotide sequence
ccagcgtcctctcagaga

SEQ ID NO: 4933 - DNA, 18 bp, Artificial sequence
  synthetic polynucleotide sequence
gctcagcatgggcagcaa

SEQ ID NO: 4934 - DNA, 18 bp, Artificial sequence
  synthetic polynucleotide sequence
gaagccattcccagggga

SEQ ID NO: 4935 - DNA, 18 bp, Artificial sequence
  synthetic polynucleotide sequence
ggagaagatgccaaacca

SEQ ID NO: 4936 - DNA, 18 bp, Artificial sequence
  synthetic polynucleotide sequence
tcaacacagtgggcagca

SEQ ID NO: 4937 - DNA, 18 bp, Artificial sequence
  synthetic polynucleotide sequence
cacagtggcacctaagca

SEQ ID NO: 4938 - DNA, 18 bp, Artificial sequence
  synthetic polynucleotide sequence
gtccagccacaacctgga

SEQ ID NO: 4939 - DNA, 18 bp, Artificial sequence
  synthetic polynucleotide sequence
ttcacggtgggggaggaa

SEQ ID NO: 4940 - DNA, 18 bp, Artificial sequence
  synthetic polynucleotide sequence
caccttccaactgaacca

SEQ ID NO: 4941 - DNA, 18 bp, Artificial sequence
  synthetic polynucleotide sequence
gcctaccacaatcatcga

SEQ ID NO: 4942 - DNA, 18 bp, Artificial sequence
  synthetic polynucleotide sequence
catcgaactccaccccca

SEQ ID NO: 4943 - DNA, 18 bp, Artificial sequence
  synthetic polynucleotide sequence
tgggctttgccaccagga

SEQ ID NO: 4944 - DNA, 18 bp, Artificial sequence
  synthetic polynucleotide sequence
tgtaccaggacaccccca

SEQ ID NO: 4945 - DNA, 18 bp, Artificial sequence
  synthetic polynucleotide sequence
cgcaatggccaagccaga

SEQ ID NO: 4946 - DNA, 18 bp, Artificial sequence
  synthetic polynucleotide sequence
tgctgaaccaatgcacca

SEQ ID NO: 4947 - DNA, 18 bp, Artificial sequence
  synthetic polynucleotide sequence
gcaagttcgagatggaga

SEQ ID NO: 4948 - DNA, 18 bp, Artificial sequence
  synthetic polynucleotide sequence
cccggagtagtgctggga

SEQ ID NO: 4949 - DNA, 18 bp, Artificial sequence
  synthetic polynucleotide sequence
gacagcatcgaggacaga

SEQ ID NO: 4950 - DNA, 18 bp, Artificial sequence
  synthetic polynucleotide sequence
gtaccaggtcagccacca

SEQ ID NO: 4951 - DNA, 18 bp, Artificial sequence
  synthetic polynucleotide sequence
gctccaggccacatgcaa

SEQ ID NO: 4952 - DNA, 18 bp, Artificial sequence
  synthetic polynucleotide sequence
cacacaaggactgcacca

SEQ ID NO: 4953 - DNA, 18 bp, Artificial sequence
  synthetic polynucleotide sequence
cccggcacaacttacaca

SEQ ID NO: 4954 - DNA, 18 bp, Artificial sequence
  synthetic polynucleotide sequence
aaggtaggcgtccagcca

SEQ ID NO: 4955 - DNA, 18 bp, Artificial sequence
  synthetic polynucleotide sequence
cctgcacagacccgggaa

SEQ ID NO: 4956 - DNA, 18 bp, Artificial sequence
  synthetic polynucleotide sequence
gcagatgacgccatgcca

SEQ ID NO: 4957 - DNA, 18 bp, Artificial sequence
  synthetic polynucleotide sequence
ccaaggcccatgagcaca

SEQ ID NO: 4958 - DNA, 18 bp, Artificial sequence
  synthetic polynucleotide sequence
gagcatccatgggcacca

SEQ ID NO: 4959 - DNA, 18 bp, Artificial sequence
  synthetic polynucleotide sequence
ctgcacaggcagagagca

SEQ ID NO: 4960 - DNA, 18 bp, Artificial sequence
  synthetic polynucleotide sequence
ttcaccaccagccccaga

SEQ ID NO: 4961 - DNA, 18 bp, Artificial sequence
  synthetic polynucleotide sequence
cgacctgggtggacgaca

SEQ ID NO: 4962 - DNA, 18 bp, Artificial sequence
  synthetic polynucleotide sequence
ggctcacgaacagccgga

SEQ ID NO: 4963 - DNA, 18 bp, Artificial sequence
  synthetic polynucleotide sequence
tggcagtgcgaatcggaa

SEQ ID NO: 4964 - DNA, 18 bp, Artificial sequence
  synthetic polynucleotide sequence
cgccccatcatccaggga

SEQ ID NO: 4965 - DNA, 18 bp, Artificial sequence
  synthetic polynucleotide sequence
caagtcggacttgagcga

SEQ ID NO: 4966 - DNA, 18 bp, Artificial sequence
  synthetic polynucleotide sequence
gggcattgcgctccacca

SEQ ID NO: 4967 - DNA, 18 bp, Artificial sequence
  synthetic polynucleotide sequence
caggactatggcgacaga

SEQ ID NO: 4968 - DNA, 18 bp, Artificial sequence
  synthetic polynucleotide sequence
ggccttcaggatgaccaa

SEQ ID NO: 4969 - DNA, 18 bp, Artificial sequence
  synthetic polynucleotide sequence
ccgaggtccttaacccca

SEQ ID NO: 4970 - DNA, 18 bp, Artificial sequence
  synthetic polynucleotide sequence
agacctgcagaacaggca

SEQ ID NO: 4971 - DNA, 18 bp, Artificial sequence
  synthetic polynucleotide sequence
cctggaagggctcaacca

SEQ ID NO: 4972 - DNA, 18 bp, Artificial sequence
  synthetic polynucleotide sequence
aggccacaaggctgggga

SEQ ID NO: 4973 - DNA, 18 bp, Artificial sequence
  synthetic polynucleotide sequence
ctcaaagccagccgggaa

SEQ ID NO: 4974 - DNA, 18 bp, Artificial sequence
  synthetic polynucleotide sequence
aggcagggtagaagggca

SEQ ID NO: 4975 - DNA, 18 bp, Artificial sequence
  synthetic polynucleotide sequence
ctgcctggataagcccca

SEQ ID NO: 4976 - DNA, 18 bp, Artificial sequence
  synthetic polynucleotide sequence
ggttatagcaagggccca

SEQ ID NO: 4977 - DNA, 18 bp, Artificial sequence
  synthetic polynucleotide sequence
caggtggcagactcagga

SEQ ID NO: 4978 - DNA, 18 bp, Artificial sequence
  synthetic polynucleotide sequence
tatgatggcaccaccgca

SEQ ID NO: 4979 - DNA, 18 bp, Artificial sequence
  synthetic polynucleotide sequence
ttcacactccacccacga

SEQ ID NO: 4980 - DNA, 18 bp, Artificial sequence
  synthetic polynucleotide sequence
ctccaccacgaagccgta

SEQ ID NO: 4981 - DNA, 18 bp, Artificial sequence
  synthetic polynucleotide sequence
tgggcgttcagccaagga

SEQ ID NO: 4982 - DNA, 18 bp, Artificial sequence
  synthetic polynucleotide sequence
ggcaccacctggccagca

SEQ ID NO: 4983 - DNA, 18 bp, Artificial sequence
  synthetic polynucleotide sequence
ctgcctcagtgagagcca

SEQ ID NO: 4984 - DNA, 18 bp, Artificial sequence
  synthetic polynucleotide sequence
agcatcctccaccaccca

SEQ ID NO: 4985 - DNA, 18 bp, Artificial sequence
  synthetic polynucleotide sequence
gcccaccactaacgggca

SEQ ID NO: 4986 - DNA, 18 bp, Artificial sequence
  synthetic polynucleotide sequence
tctaaggacaccacccca

SEQ ID NO: 4987 - DNA, 18 bp, Artificial sequence
  synthetic polynucleotide sequence
gtccctgtgccagcgcca

SEQ ID NO: 4988 - DNA, 18 bp, Artificial sequence
  synthetic polynucleotide sequence
ccggagccattgtccaca

SEQ ID NO: 4989 - DNA, 19 bp, Artificial sequence
  synthetic polynucleotide sequence
gaaggtgtgaagagcgaga

SEQ ID NO: 4990 - DNA, 18 bp, Artificial sequence
  synthetic polynucleotide sequence
acacaggggaactcggca

SEQ ID NO: 4991 - DNA, 18 bp, Artificial sequence
  synthetic polynucleotide sequence
ggactcggaggaagagga

SEQ ID NO: 4992 - DNA, 18 bp, Artificial sequence
  synthetic polynucleotide sequence
ggcagagcagtgaggcca

SEQ ID NO: 4993 - DNA, 18 bp, Artificial sequence
  synthetic polynucleotide sequence
aagacccaggctcagcca

SEQ ID NO: 4994 - DNA, 18 bp, Artificial sequence
  synthetic polynucleotide sequence
tgcacacactacagacca

SEQ ID NO: 4995 - DNA, 18 bp, Artificial sequence
  synthetic polynucleotide sequence
agagctgccacacacgga

SEQ ID NO: 4996 - DNA, 18 bp, Artificial sequence
  synthetic polynucleotide sequence
ccaggaactgggtccaca

SEQ ID NO: 4997 - DNA, 18 bp, Artificial sequence
  synthetic polynucleotide sequence
cggcaggtgatgaagcca

SEQ ID NO: 4998 - DNA, 18 bp, Artificial sequence
  synthetic polynucleotide sequence
ccgcttgctggaggggga

SEQ ID NO: 4999 - DNA, 18 bp, Artificial sequence
  synthetic polynucleotide sequence
aacccactgctgtcgcca

SEQ ID NO: 5000 - DNA, 18 bp, Artificial sequence
  synthetic polynucleotide sequence
gccatctccacagctgca

SEQ ID NO: 5001 - DNA, 18 bp, Artificial sequence
  synthetic polynucleotide sequence
agggagtgctcaacgcca

SEQ ID NO: 5002 - DNA, 18 bp, Artificial sequence
  synthetic polynucleotide sequence
gggagcacagtggactca

SEQ ID NO: 5003 - DNA, 18 bp, Artificial sequence
  synthetic polynucleotide sequence
acaccagagactgcacca

SEQ ID NO: 5004 - DNA, 18 bp, Artificial sequence
  synthetic polynucleotide sequence
ccatgcacactggactga

SEQ ID NO: 5005 - DNA, 18 bp, Artificial sequence
  synthetic polynucleotide sequence
ccgagacgctcataggca

SEQ ID NO: 5006 - DNA, 18 bp, Artificial sequence
  synthetic polynucleotide sequence
gcgaggttcacgtaagga

SEQ ID NO: 5007 - DNA, 18 bp, Artificial sequence
  synthetic polynucleotide sequence
ccaaggcgtaagtcacca

SEQ ID NO: 5008 - DNA, 18 bp, Artificial sequence
  synthetic polynucleotide sequence
tggaagataccgtgggca

SEQ ID NO: 5009 - DNA, 18 bp, Artificial sequence
  synthetic polynucleotide sequence
ccggagctccatcccgca

SEQ ID NO: 5010 - DNA, 18 bp, Artificial sequence
  synthetic polynucleotide sequence
caagcatctccaacgaga

SEQ ID NO: 5011 - DNA, 18 bp, Artificial sequence
  synthetic polynucleotide sequence
tggcactgatggggacca

SEQ ID NO: 5012 - DNA, 18 bp, Artificial sequence
  synthetic polynucleotide sequence
tccgcctgcgtggcagca

SEQ ID NO: 5013 - DNA, 18 bp, Artificial sequence
  synthetic polynucleotide sequence
cccagcttccctgaacga

SEQ ID NO: 5014 - DNA, 18 bp, Artificial sequence
  synthetic polynucleotide sequence
ggacctgccatccaagga

SEQ ID NO: 5015 - DNA, 18 bp, Artificial sequence
  synthetic polynucleotide sequence
gaggcaacagcaccgcaa

SEQ ID NO: 5016 - DNA, 18 bp, Artificial sequence
  synthetic polynucleotide sequence
gaagtcatcccgggagga

SEQ ID NO: 5017 - DNA, 18 bp, Artificial sequence
  synthetic polynucleotide sequence
ggagccgatactcaagca

SEQ ID NO: 5018 - DNA, 18 bp, Artificial sequence
  synthetic polynucleotide sequence
ggctctgggatgcgggga

SEQ ID NO: 5019 - DNA, 18 bp, Artificial sequence
  synthetic polynucleotide sequence
ccctcaaggcagccgtga

SEQ ID NO: 5020 - DNA, 18 bp, Artificial sequence
  synthetic polynucleotide sequence
ccgacctgaagacgcgca

SEQ ID NO: 5021 - DNA, 18 bp, Artificial sequence
  synthetic polynucleotide sequence
cccaaggagagtcatcca

SEQ ID NO: 5022 - DNA, 18 bp, Artificial sequence
  synthetic polynucleotide sequence
atgtagcagcccgaagca

SEQ ID NO: 5023 - DNA, 18 bp, Artificial sequence
  synthetic polynucleotide sequence
cgcagggtacgccaagca

SEQ ID NO: 5024 - DNA, 18 bp, Artificial sequence
  synthetic polynucleotide sequence
gccaatctggcctgcaca

SEQ ID NO: 5025 - DNA, 18 bp, Artificial sequence
  synthetic polynucleotide sequence
cgccagcctctccagcca

SEQ ID NO: 5026 - DNA, 18 bp, Artificial sequence
  synthetic polynucleotide sequence
tgtaggccagggtcagca

SEQ ID NO: 5027 - DNA, 18 bp, Artificial sequence
  synthetic polynucleotide sequence
gaccccaccttgtgcaca

SEQ ID NO: 5028 - DNA, 18 bp, Artificial sequence
  synthetic polynucleotide sequence
gaagcgctcccaggcaca

SEQ ID NO: 5029 - DNA, 18 bp, Artificial sequence
  synthetic polynucleotide sequence
gcattaccacctcagcca

SEQ ID NO: 5030 - DNA, 18 bp, Artificial sequence
  synthetic polynucleotide sequence
cctgaaccatgtgccgaa

SEQ ID NO: 5031 - DNA, 18 bp, Artificial sequence
  synthetic polynucleotide sequence
gcagtccagcaacagcca

SEQ ID NO: 5032 - DNA, 18 bp, Artificial sequence
  synthetic polynucleotide sequence
aggtgaggtgtggaggca

SEQ ID NO: 5033 - DNA, 18 bp, Artificial sequence
  synthetic polynucleotide sequence
gccaagaagagcgaggca

SEQ ID NO: 5034 - DNA, 18 bp, Artificial sequence
  synthetic polynucleotide sequence
ccctctccagcctcagca

SEQ ID NO: 5035 - DNA, 18 bp, Artificial sequence
  synthetic polynucleotide sequence
ccttcagcaccctgagga

SEQ ID NO: 5036 - DNA, 18 bp, Artificial sequence
  synthetic polynucleotide sequence
gcagcgacttcagcagca

SEQ ID NO: 5037 - DNA, 18 bp, Artificial sequence
  synthetic polynucleotide sequence
gaagcccaagcgcaggaa

SEQ ID NO: 5038 - DNA, 18 bp, Artificial sequence
  synthetic polynucleotide sequence
tacccaggtgctacagca

SEQ ID NO: 5039 - DNA, 18 bp, Artificial sequence
  synthetic polynucleotide sequence
gtggtggcactccacaga

SEQ ID NO: 5040 - DNA, 18 bp, Artificial sequence
  synthetic polynucleotide sequence
gcatccacacatgatgga

SEQ ID NO: 5041 - DNA, 18 bp, Artificial sequence
  synthetic polynucleotide sequence
gccctcctgcgtggacga

SEQ ID NO: 5042 - DNA, 18 bp, Artificial sequence
  synthetic polynucleotide sequence
gcagggctccatctgaca

SEQ ID NO: 5043 - DNA, 18 bp, Artificial sequence
  synthetic polynucleotide sequence
catagaagagcggtcaca

SEQ ID NO: 5044 - DNA, 18 bp, Artificial sequence
  synthetic polynucleotide sequence
caagaaggttgagcccga

SEQ ID NO: 5045 - DNA, 18 bp, Artificial sequence
  synthetic polynucleotide sequence
ccaagcagtggtgtgaca

SEQ ID NO: 5046 - DNA, 18 bp, Artificial sequence
  synthetic polynucleotide sequence
gggctgcgtgcacgtcca

SEQ ID NO: 5047 - DNA, 18 bp, Artificial sequence
  synthetic polynucleotide sequence
cagagggttcggacgaca

SEQ ID NO: 5048 - DNA, 18 bp, Artificial sequence
  synthetic polynucleotide sequence
agtcagcttgggccagca

SEQ ID NO: 5049 - DNA, 18 bp, Artificial sequence
  synthetic polynucleotide sequence
ccctgactactgcgagga

SEQ ID NO: 5050 - DNA, 18 bp, Artificial sequence
  synthetic polynucleotide sequence
gcggcaccaggatggaga

SEQ ID NO: 5051 - DNA, 18 bp, Artificial sequence
  synthetic polynucleotide sequence
gaaaggccagccccagga

SEQ ID NO: 5052 - DNA, 18 bp, Artificial sequence
  synthetic polynucleotide sequence
tcacggtcaggccgcaca

SEQ ID NO: 5053 - DNA, 18 bp, Artificial sequence
  synthetic polynucleotide sequence
aggaggaggaactcccca

SEQ ID NO: 5054 - DNA, 18 bp, Artificial sequence
  synthetic polynucleotide sequence
ctgagaaggcccgaggca

SEQ ID NO: 5055 - DNA, 18 bp, Artificial sequence
  synthetic polynucleotide sequence
ccagaggccagtgaccaa

SEQ ID NO: 5056 - DNA, 18 bp, Artificial sequence
  synthetic polynucleotide sequence
ccacatactcctgcacca

SEQ ID NO: 5057 - DNA, 18 bp, Artificial sequence
  synthetic polynucleotide sequence
gccacctccagaatgaga

SEQ ID NO: 5058 - DNA, 18 bp, Artificial sequence
  synthetic polynucleotide sequence
ctcccgggaatgaagcca

SEQ ID NO: 5059 - DNA, 18 bp, Artificial sequence
  synthetic polynucleotide sequence
gcaggacctcctgaagga

SEQ ID NO: 5060 - DNA, 19 bp, Artificial sequence
  synthetic polynucleotide sequence
agataggcatcgggtgaca

SEQ ID NO: 5061 - DNA, 18 bp, Artificial sequence
  synthetic polynucleotide sequence
aactgggcttccgggaca

SEQ ID NO: 5062 - DNA, 18 bp, Artificial sequence
  synthetic polynucleotide sequence
ggggcatgcagccctcca

SEQ ID NO: 5063 - DNA, 18 bp, Artificial sequence
  synthetic polynucleotide sequence
agccccctatgtagcaga

SEQ ID NO: 5064 - DNA, 18 bp, Artificial sequence
  synthetic polynucleotide sequence
gcagggtagccaagtgga

SEQ ID NO: 5065 - DNA, 18 bp, Artificial sequence
  synthetic polynucleotide sequence
ggactcggtgagacgcca

SEQ ID NO: 5066 - DNA, 18 bp, Artificial sequence
  synthetic polynucleotide sequence
ggtggaaggcctcagaca

SEQ ID NO: 5067 - DNA, 18 bp, Artificial sequence
  synthetic polynucleotide sequence
aggcccacagaccaggaa

SEQ ID NO: 5068 - DNA, 18 bp, Artificial sequence
  synthetic polynucleotide sequence
cgttcaccaccctgcgaa

SEQ ID NO: 5069 - DNA, 18 bp, Artificial sequence
  synthetic polynucleotide sequence
ggactaagcctgctccaa

SEQ ID NO: 5070 - DNA, 18 bp, Artificial sequence
  synthetic polynucleotide sequence
tctgaggagctacgagga

SEQ ID NO: 5071 - DNA, 18 bp, Artificial sequence
  synthetic polynucleotide sequence
tgatggcagaggtcagca

SEQ ID NO: 5072 - DNA, 18 bp, Artificial sequence
  synthetic polynucleotide sequence
gcccagtacaggtaggga

SEQ ID NO: 5073 - DNA, 18 bp, Artificial sequence
  synthetic polynucleotide sequence
cctcctggcgtaagcgga

SEQ ID NO: 5074 - DNA, 18 bp, Artificial sequence
  synthetic polynucleotide sequence
tggctgcctccgaaggga

SEQ ID NO: 5075 - DNA, 18 bp, Artificial sequence
  synthetic polynucleotide sequence
tggctccccagaaacgca

SEQ ID NO: 5076 - DNA, 18 bp, Artificial sequence
  synthetic polynucleotide sequence
ccaagtcggtaagcccca

SEQ ID NO: 5077 - DNA, 18 bp, Artificial sequence
  synthetic polynucleotide sequence
aagacccagaggagccca

SEQ ID NO: 5078 - DNA, 18 bp, Artificial sequence
  synthetic polynucleotide sequence
cagaaccctcagagagca

SEQ ID NO: 5079 - DNA, 18 bp, Artificial sequence
  synthetic polynucleotide sequence
cctggagagctacgagga

SEQ ID NO: 5080 - DNA, 18 bp, Artificial sequence
  synthetic polynucleotide sequence
aggaccgaccagcaagca

SEQ ID NO: 5081 - DNA, 18 bp, Artificial sequence
  synthetic polynucleotide sequence
cgagagcaacgtggccaa

SEQ ID NO: 5082 - DNA, 18 bp, Artificial sequence
  synthetic polynucleotide sequence
gttggtggccaccagcca

SEQ ID NO: 5083 - DNA, 18 bp, Artificial sequence
  synthetic polynucleotide sequence
tccagccagaaaacccca

SEQ ID NO: 5084 - DNA, 18 bp, Artificial sequence
  synthetic polynucleotide sequence
aggaagctctggagggca

SEQ ID NO: 5085 - DNA, 18 bp, Artificial sequence
  synthetic polynucleotide sequence
ccctccagctggaggaga

SEQ ID NO: 5086 - DNA, 18 bp, Artificial sequence
  synthetic polynucleotide sequence
gtgttggcaagcagccga

SEQ ID NO: 5087 - DNA, 18 bp, Artificial sequence
  synthetic polynucleotide sequence
ggacccagaaaagcccaa

SEQ ID NO: 5088 - DNA, 18 bp, Artificial sequence
  synthetic polynucleotide sequence
actcttaagcacagccca

SEQ ID NO: 5089 - DNA, 18 bp, Artificial sequence
  synthetic polynucleotide sequence
aggacaaccagccacgga

SEQ ID NO: 5090 - DNA, 20 bp, Artificial sequence
  synthetic polynucleotide sequence
cacattcatcacggactgga

SEQ ID NO: 5091 - DNA, 18 bp, Artificial sequence
  synthetic polynucleotide sequence
cggctccagcggagacca

SEQ ID NO: 5092 - DNA, 19 bp, Artificial sequence
  synthetic polynucleotide sequence
cagaaggaaagacgggaga

SEQ ID NO: 5093 - DNA, 18 bp, Artificial sequence
  synthetic polynucleotide sequence
cagcagactcgcagcaga

SEQ ID NO: 5094 - DNA, 18 bp, Artificial sequence
  synthetic polynucleotide sequence
tgaagtctaggagcggca

SEQ ID NO: 5095 - DNA, 18 bp, Artificial sequence
  synthetic polynucleotide sequence
cctggagccagatgcaca

SEQ ID NO: 5096 - DNA, 18 bp, Artificial sequence
  synthetic polynucleotide sequence
ggagtgactgcaacacca

SEQ ID NO: 5097 - DNA, 18 bp, Artificial sequence
  synthetic polynucleotide sequence
cctggagaggggagccaa

SEQ ID NO: 5098 - DNA, 18 bp, Artificial sequence
  synthetic polynucleotide sequence
gcaactcctcccagggca

SEQ ID NO: 5099 - DNA, 18 bp, Artificial sequence
  synthetic polynucleotide sequence
ctgatccaggcaggcaga

SEQ ID NO: 5100 - DNA, 18 bp, Artificial sequence
  synthetic polynucleotide sequence
aagcaggtgggtggcaga

SEQ ID NO: 5101 - DNA, 18 bp, Artificial sequence
  synthetic polynucleotide sequence
ggaaaacagccgggagga

SEQ ID NO: 5102 - DNA, 18 bp, Artificial sequence
  synthetic polynucleotide sequence
cctgggacaagtcacgca

SEQ ID NO: 5103 - DNA, 18 bp, Artificial sequence
  synthetic polynucleotide sequence
gggactaccagctgcaca

SEQ ID NO: 5104 - DNA, 18 bp, Artificial sequence
  synthetic polynucleotide sequence
ttggggccatgaagacca

SEQ ID NO: 5105 - DNA, 18 bp, Artificial sequence
  synthetic polynucleotide sequence
gtggcaagtgggaggcca

SEQ ID NO: 5106 - DNA, 18 bp, Artificial sequence
  synthetic polynucleotide sequence
cctgggccgtagcagaca

SEQ ID NO: 5107 - DNA, 18 bp, Artificial sequence
  synthetic polynucleotide sequence
gatgacacccaggaggca

SEQ ID NO: 5108 - DNA, 18 bp, Artificial sequence
  synthetic polynucleotide sequence
ggagcatctcagtaccca

SEQ ID NO: 5109 - DNA, 18 bp, Artificial sequence
  synthetic polynucleotide sequence
cccacaccacatcagcca

SEQ ID NO: 5110 - DNA, 18 bp, Artificial sequence
  synthetic polynucleotide sequence
tggtgaagaactcccgca

SEQ ID NO: 5111 - DNA, 18 bp, Artificial sequence
  synthetic polynucleotide sequence
gacatcaactccaaggga

SEQ ID NO: 5112 - DNA, 18 bp, Artificial sequence
  synthetic polynucleotide sequence
aggacagggcttatggca

SEQ ID NO: 5113 - DNA, 18 bp, Artificial sequence
  synthetic polynucleotide sequence
ggtgatgatggaggggaa

SEQ ID NO: 5114 - DNA, 18 bp, Artificial sequence
  synthetic polynucleotide sequence
gattgaacactgccccca

SEQ ID NO: 5115 - DNA, 18 bp, Artificial sequence
  synthetic polynucleotide sequence
cagcacctctatccccga

SEQ ID NO: 5116 - DNA, 18 bp, Artificial sequence
  synthetic polynucleotide sequence
aggccacgcttcaggaca

SEQ ID NO: 5117 - DNA, 18 bp, Artificial sequence
  synthetic polynucleotide sequence
cagtggcagaaacgggga

SEQ ID NO: 5118 - DNA, 18 bp, Artificial sequence
  synthetic polynucleotide sequence
tagcctgcacgtggacca

SEQ ID NO: 5119 - DNA, 18 bp, Artificial sequence
  synthetic polynucleotide sequence
agccaccactctcagcca

SEQ ID NO: 5120 - DNA, 18 bp, Artificial sequence
  synthetic polynucleotide sequence
ctacgctgatgaccccca

SEQ ID NO: 5121 - DNA, 18 bp, Artificial sequence
  synthetic polynucleotide sequence
ggagatgcacagcagcga

SEQ ID NO: 5122 - DNA, 18 bp, Artificial sequence
  synthetic polynucleotide sequence
acagtccagccctgagca

SEQ ID NO: 5123 - DNA, 18 bp, Artificial sequence
  synthetic polynucleotide sequence
gcactctggtaggcacca

SEQ ID NO: 5124 - DNA, 18 bp, Artificial sequence
  synthetic polynucleotide sequence
cattgaggtcccgcacca

SEQ ID NO: 5125 - DNA, 18 bp, Artificial sequence
  synthetic polynucleotide sequence
ggaagcaggagcagcaca

SEQ ID NO: 5126 - DNA, 18 bp, Artificial sequence
  synthetic polynucleotide sequence
ccctggggaacagaccca

SEQ ID NO: 5127 - DNA, 18 bp, Artificial sequence
  synthetic polynucleotide sequence
ctccacagcctcagccga

SEQ ID NO: 5128 - DNA, 18 bp, Artificial sequence
  synthetic polynucleotide sequence
actcccacgaccacggca

SEQ ID NO: 5129 - DNA, 18 bp, Artificial sequence
  synthetic polynucleotide sequence
aggctaccagctcagcga

SEQ ID NO: 5130 - DNA, 18 bp, Artificial sequence
  synthetic polynucleotide sequence
cagcctgtagccagacga

SEQ ID NO: 5131 - DNA, 18 bp, Artificial sequence
  synthetic polynucleotide sequence
gctacaccatgacggcca

SEQ ID NO: 5132 - DNA, 18 bp, Artificial sequence
  synthetic polynucleotide sequence
gaggacactcgaagcgca

SEQ ID NO: 5133 - DNA, 18 bp, Artificial sequence
  synthetic polynucleotide sequence
ccccatccgctgtgagga

SEQ ID NO: 5134 - DNA, 18 bp, Artificial sequence
  synthetic polynucleotide sequence
tggaagatgtcagcggga

SEQ ID NO: 5135 - DNA, 18 bp, Artificial sequence
  synthetic polynucleotide sequence
agcgttcagaccggcaga

SEQ ID NO: 5136 - DNA, 18 bp, Artificial sequence
  synthetic polynucleotide sequence
ccgacatgtcgacgtcca

SEQ ID NO: 5137 - DNA, 18 bp, Artificial sequence
  synthetic polynucleotide sequence
taaccaccgctgccagca

SEQ ID NO: 5138 - DNA, 18 bp, Artificial sequence
  synthetic polynucleotide sequence
gatgtgagcgctgaggca

SEQ ID NO: 5139 - DNA, 18 bp, Artificial sequence
  synthetic polynucleotide sequence
gggaaccacaggtgccaa

SEQ ID NO: 5140 - DNA, 18 bp, Artificial sequence
  synthetic polynucleotide sequence
gcaggaagcagagccaca

SEQ ID NO: 5141 - DNA, 18 bp, Artificial sequence
  synthetic polynucleotide sequence
ggacgagtgtgcaaggga

SEQ ID NO: 5142 - DNA, 18 bp, Artificial sequence
  synthetic polynucleotide sequence
acactggccatggggaca

SEQ ID NO: 5143 - DNA, 18 bp, Artificial sequence
  synthetic polynucleotide sequence
ggccaccactgggaagga

SEQ ID NO: 5144 - DNA, 18 bp, Artificial sequence
  synthetic polynucleotide sequence
gagcacgtcgtcggggga

SEQ ID NO: 5145 - DNA, 18 bp, Artificial sequence
  synthetic polynucleotide sequence
tggcctccatcggaacca

SEQ ID NO: 5146 - DNA, 18 bp, Artificial sequence
  synthetic polynucleotide sequence
tcaccaagagccgggtca

SEQ ID NO: 5147 - DNA, 18 bp, Artificial sequence
  synthetic polynucleotide sequence
aggttacccgtgcaggca

SEQ ID NO: 5148 - DNA, 18 bp, Artificial sequence
  synthetic polynucleotide sequence
gtcggtggggtgacggga

SEQ ID NO: 5149 - DNA, 18 bp, Artificial sequence
  synthetic polynucleotide sequence
cacaccactacgccgcaa

SEQ ID NO: 5150 - DNA, 18 bp, Artificial sequence
  synthetic polynucleotide sequence
agcgtaggcctccaggga

SEQ ID NO: 5151 - DNA, 18 bp, Artificial sequence
  synthetic polynucleotide sequence
gactggaagcaaccccaa

SEQ ID NO: 5152 - DNA, 18 bp, Artificial sequence
  synthetic polynucleotide sequence
aggagacctcgaccccca

SEQ ID NO: 5153 - DNA, 18 bp, Artificial sequence
  synthetic polynucleotide sequence
gggcgtgagctccaggaa

SEQ ID NO: 5154 - DNA, 18 bp, Artificial sequence
  synthetic polynucleotide sequence
gctgtacaggctgaagga

SEQ ID NO: 5155 - DNA, 18 bp, Artificial sequence
  synthetic polynucleotide sequence
tctccactggcagcagca

SEQ ID NO: 5156 - DNA, 18 bp, Artificial sequence
  synthetic polynucleotide sequence
cagcctggcccaggctga

SEQ ID NO: 5157 - DNA, 18 bp, Artificial sequence
  synthetic polynucleotide sequence
ctcaggctgatgaaggca

SEQ ID NO: 5158 - DNA, 18 bp, Artificial sequence
  synthetic polynucleotide sequence
gggcagtcctgagaagca

SEQ ID NO: 5159 - DNA, 18 bp, Artificial sequence
  synthetic polynucleotide sequence
tacgacctcacgggagga

SEQ ID NO: 5160 - DNA, 18 bp, Artificial sequence
  synthetic polynucleotide sequence
cttcccaactgacacaga

SEQ ID NO: 5161 - DNA, 18 bp, Artificial sequence
  synthetic polynucleotide sequence
agaaatcagcagcccaga

SEQ ID NO: 5162 - DNA, 18 bp, Artificial sequence
  synthetic polynucleotide sequence
gcaggtgaattacagcga

SEQ ID NO: 5163 - DNA, 18 bp, Artificial sequence
  synthetic polynucleotide sequence
gagtcaccaacagcagca

SEQ ID NO: 5164 - DNA, 18 bp, Artificial sequence
  synthetic polynucleotide sequence
cggtagggcgattgggca

SEQ ID NO: 5165 - DNA, 18 bp, Artificial sequence
  synthetic polynucleotide sequence
cgggggtgaatatgacca

SEQ ID NO: 5166 - DNA, 18 bp, Artificial sequence
  synthetic polynucleotide sequence
ggtcctggaagtgggcca

SEQ ID NO: 5167 - DNA, 18 bp, Artificial sequence
  synthetic polynucleotide sequence
aagtctggagcacgagca

SEQ ID NO: 5168 - DNA, 18 bp, Artificial sequence
  synthetic polynucleotide sequence
accggatgcatcggacca

SEQ ID NO: 5169 - DNA, 18 bp, Artificial sequence
  synthetic polynucleotide sequence
gcaaggtcccaacaagca

SEQ ID NO: 5170 - DNA, 18 bp, Artificial sequence
  synthetic polynucleotide sequence
ccgactcccaactgcaca

SEQ ID NO: 5171 - DNA, 18 bp, Artificial sequence
  synthetic polynucleotide sequence
cgcatggccgtggcagga

SEQ ID NO: 5172 - DNA, 18 bp, Artificial sequence
  synthetic polynucleotide sequence
cagctcggttcagccaca

SEQ ID NO: 5173 - DNA, 18 bp, Artificial sequence
  synthetic polynucleotide sequence
ggccctgggagagcctca

SEQ ID NO: 5174 - DNA, 18 bp, Artificial sequence
  synthetic polynucleotide sequence
tcagtcgacagtagagga

SEQ ID NO: 5175 - DNA, 18 bp, Artificial sequence
  synthetic polynucleotide sequence
tgacgacatggaagggca

SEQ ID NO: 5176 - DNA, 18 bp, Artificial sequence
  synthetic polynucleotide sequence
ccgaaggccaatccagga

SEQ ID NO: 5177 - DNA, 18 bp, Artificial sequence
  synthetic polynucleotide sequence
tcacggtccaggtggcaa

SEQ ID NO: 5178 - DNA, 18 bp, Artificial sequence
  synthetic polynucleotide sequence
gttcccacacaggccaca

SEQ ID NO: 5179 - DNA, 18 bp, Artificial sequence
  synthetic polynucleotide sequence
ctgcgaggcaggaacaca

SEQ ID NO: 5180 - DNA, 18 bp, Artificial sequence
  synthetic polynucleotide sequence
caagcacttgaagctcca

SEQ ID NO: 5181 - DNA, 18 bp, Artificial sequence
  synthetic polynucleotide sequence
cagggcgaagtgacccca

SEQ ID NO: 5182 - DNA, 18 bp, Artificial sequence
  synthetic polynucleotide sequence
catgacacctcaaggcca

SEQ ID NO: 5183 - DNA, 18 bp, Artificial sequence
  synthetic polynucleotide sequence
catccaagcctgtgacca

SEQ ID NO: 5184 - DNA, 18 bp, Artificial sequence
  synthetic polynucleotide sequence
tgggcagccttcacagga

SEQ ID NO: 5185 - DNA, 18 bp, Artificial sequence
  synthetic polynucleotide sequence
catccaagcctgtgacca

SEQ ID NO: 5186 - DNA, 16 bp, Artificial sequence
  synthetic polynucleotide sequence
ggccactacagcagca

SEQ ID NO: 5187 - DNA, 18 bp, Artificial sequence
  synthetic polynucleotide sequence
agctggcatgcggactga

SEQ ID NO: 5188 - DNA, 18 bp, Artificial sequence
  synthetic polynucleotide sequence
ctcgagcaccctgtacca

SEQ ID NO: 5189 - DNA, 18 bp, Artificial sequence
  synthetic polynucleotide sequence
ggtgcagctagaagtcca

SEQ ID NO: 5190 - DNA, 18 bp, Artificial sequence
  synthetic polynucleotide sequence
cccaacaagccccctgca

SEQ ID NO: 5191 - DNA, 18 bp, Artificial sequence
  synthetic polynucleotide sequence
ggccccaacagtgacgga

SEQ ID NO: 5192 - DNA, 18 bp, Artificial sequence
  synthetic polynucleotide sequence
cgatgacgattcccacca

SEQ ID NO: 5193 - DNA, 18 bp, Artificial sequence
  synthetic polynucleotide sequence
tgagcggctggcacacca

SEQ ID NO: 5194 - DNA, 18 bp, Artificial sequence
  synthetic polynucleotide sequence
gggcagtcagggcgtgga

SEQ ID NO: 5195 - DNA, 18 bp, Artificial sequence
  synthetic polynucleotide sequence
tgaccgcccagggaacca

SEQ ID NO: 5196 - DNA, 18 bp, Artificial sequence
  synthetic polynucleotide sequence
gtcagggaatctcccgca

SEQ ID NO: 5197 - DNA, 18 bp, Artificial sequence
  synthetic polynucleotide sequence
ccagctggcactgggcaa

SEQ ID NO: 5198 - DNA, 18 bp, Artificial sequence
  synthetic polynucleotide sequence
gacactgcatagcgacca

SEQ ID NO: 5199 - DNA, 18 bp, Artificial sequence
  synthetic polynucleotide sequence
ggacaggtgatggaggga

SEQ ID NO: 5200 - DNA, 18 bp, Artificial sequence
  synthetic polynucleotide sequence
ttgggcgagacaccggga

SEQ ID NO: 5201 - DNA, 19 bp, Artificial sequence
  synthetic polynucleotide sequence
actcctgtgaggccaacaa

SEQ ID NO: 5202 - DNA, 19 bp, Artificial sequence
  synthetic polynucleotide sequence
cagtccccagagaactcca

SEQ ID NO: 5203 - DNA, 18 bp, Artificial sequence
  synthetic polynucleotide sequence
gcccgaaggaaaccagga

SEQ ID NO: 5204 - DNA, 18 bp, Artificial sequence
  synthetic polynucleotide sequence
ggaaggcctggacgagga

SEQ ID NO: 5205 - DNA, 18 bp, Artificial sequence
  synthetic polynucleotide sequence
gctccctgccatcagaca

SEQ ID NO: 5206 - DNA, 18 bp, Artificial sequence
  synthetic polynucleotide sequence
cttcctccgacgccagca

SEQ ID NO: 5207 - DNA, 18 bp, Artificial sequence
  synthetic polynucleotide sequence
ccccaggcatctcaggaa

SEQ ID NO: 5208 - DNA, 18 bp, Artificial sequence
  synthetic polynucleotide sequence
gaggagctgaggaagcca

SEQ ID NO: 5209 - DNA, 18 bp, Artificial sequence
  synthetic polynucleotide sequence
gccactgaggacaaccaa

SEQ ID NO: 5210 - DNA, 18 bp, Artificial sequence
  synthetic polynucleotide sequence
ggagcagttcctggagca

SEQ ID NO: 5211 - DNA, 19 bp, Artificial sequence
  synthetic polynucleotide sequence
acgacaaggtggtctacaa

SEQ ID NO: 5212 - DNA, 19 bp, Artificial sequence
  synthetic polynucleotide sequence
cagccaccttagcggagaa

SEQ ID NO: 5213 - DNA, 18 bp, Artificial sequence
  synthetic polynucleotide sequence
ctgaacaggagtgggaca

SEQ ID NO: 5214 - DNA, 18 bp, Artificial sequence
  synthetic polynucleotide sequence
aggcccatagagttggca

SEQ ID NO: 5215 - DNA, 18 bp, Artificial sequence
  synthetic polynucleotide sequence
accccagtgtgaccggca

SEQ ID NO: 5216 - DNA, 18 bp, Artificial sequence
  synthetic polynucleotide sequence
ggagtggcccgttgcaga

SEQ ID NO: 5217 - DNA, 18 bp, Artificial sequence
  synthetic polynucleotide sequence
gcgggagcgcggaggcga

SEQ ID NO: 5218 - DNA, 18 bp, Artificial sequence
  synthetic polynucleotide sequence
gacaggttgaacaagcca

SEQ ID NO: 5219 - DNA, 18 bp, Artificial sequence
  synthetic polynucleotide sequence
agggtgtcgatgaggcca

SEQ ID NO: 5220 - DNA, 18 bp, Artificial sequence
  synthetic polynucleotide sequence
cagtagaggcctggcaca

SEQ ID NO: 5221 - DNA, 18 bp, Artificial sequence
  synthetic polynucleotide sequence
ctcaggaggtaagcgcca

SEQ ID NO: 5222 - DNA, 18 bp, Artificial sequence
  synthetic polynucleotide sequence
gaggacccaaccagggca

SEQ ID NO: 5223 - DNA, 18 bp, Artificial sequence
  synthetic polynucleotide sequence
tgctgcggctaccgagga

SEQ ID NO: 5224 - DNA, 18 bp, Artificial sequence
  synthetic polynucleotide sequence
tgggcccaataccccgga

SEQ ID NO: 5225 - DNA, 18 bp, Artificial sequence
  synthetic polynucleotide sequence
gaagccccttgtcaccaa

SEQ ID NO: 5226 - DNA, 18 bp, Artificial sequence
  synthetic polynucleotide sequence
acttgaatcggagcagca

SEQ ID NO: 5227 - DNA, 18 bp, Artificial sequence
  synthetic polynucleotide sequence
tggccattcaccgggaga

SEQ ID NO: 5228 - DNA, 18 bp, Artificial sequence
  synthetic polynucleotide sequence
acgtcaggtgcggaccca

SEQ ID NO: 5229 - DNA, 18 bp, Artificial sequence
  synthetic polynucleotide sequence
caccagggcttctagcca

SEQ ID NO: 5230 - DNA, 18 bp, Artificial sequence
  synthetic polynucleotide sequence
aggcacagagtcggagga

SEQ ID NO: 5231 - DNA, 18 bp, Artificial sequence
  synthetic polynucleotide sequence
gctcacggacccggacga

SEQ ID NO: 5232 - DNA, 18 bp, Artificial sequence
  synthetic polynucleotide sequence
ccaggccctggaagtcga

SEQ ID NO: 5233 - DNA, 18 bp, Artificial sequence
  synthetic polynucleotide sequence
gcagaaggagcagcgaga

SEQ ID NO: 5234 - DNA, 18 bp, Artificial sequence
  synthetic polynucleotide sequence
tgaagcgcttgagaggca

SEQ ID NO: 5235 - DNA, 18 bp, Artificial sequence
  synthetic polynucleotide sequence
cttgaacacgactgagca

SEQ ID NO: 5236 - DNA, 18 bp, Artificial sequence
  synthetic polynucleotide sequence
aaggtccgaagcacacca

SEQ ID NO: 5237 - DNA, 18 bp, Artificial sequence
  synthetic polynucleotide sequence
ggggctcctatgacccaa

SEQ ID NO: 5238 - DNA, 18 bp, Artificial sequence
  synthetic polynucleotide sequence
gcgaacagccctgaggga

SEQ ID NO: 5239 - DNA, 18 bp, Artificial sequence
  synthetic polynucleotide sequence
gctcgtccagccaaagca

SEQ ID NO: 5240 - DNA, 18 bp, Artificial sequence
  synthetic polynucleotide sequence
taggacacaacaccccca

SEQ ID NO: 5241 - DNA, 18 bp, Artificial sequence
  synthetic polynucleotide sequence
gatcttgggaagcgggca

SEQ ID NO: 5242 - DNA, 18 bp, Artificial sequence
  synthetic polynucleotide sequence
accccgtgcaaggccaca

SEQ ID NO: 5243 - DNA, 18 bp, Artificial sequence
  synthetic polynucleotide sequence
gcagctggaccagcacca

SEQ ID NO: 5244 - DNA, 18 bp, Artificial sequence
  synthetic polynucleotide sequence
ccagctctggcaagagga

SEQ ID NO: 5245 - DNA, 18 bp, Artificial sequence
  synthetic polynucleotide sequence
gagccctgtccacagcaa

SEQ ID NO: 5246 - DNA, 18 bp, Artificial sequence
  synthetic polynucleotide sequence
tgccgacgagatgggaca

SEQ ID NO: 5247 - DNA, 18 bp, Artificial sequence
  synthetic polynucleotide sequence
gcagcttggacccagaca

SEQ ID NO: 5248 - DNA, 18 bp, Artificial sequence
  synthetic polynucleotide sequence
tcagagggaaggtcacca

SEQ ID NO: 5249 - DNA, 18 bp, Artificial sequence
  synthetic polynucleotide sequence
aaggctggaggagaacca

SEQ ID NO: 5250 - DNA, 18 bp, Artificial sequence
  synthetic polynucleotide sequence
gagactggcagggggaga

SEQ ID NO: 5251 - DNA, 18 bp, Artificial sequence
  synthetic polynucleotide sequence
gtccgctggagaaagcta

SEQ ID NO: 5252 - DNA, 18 bp, Artificial sequence
  synthetic polynucleotide sequence
caggatgctgtacgggca

SEQ ID NO: 5253 - DNA, 18 bp, Artificial sequence
  synthetic polynucleotide sequence
cctgcagatgcacccaga

SEQ ID NO: 5254 - DNA, 18 bp, Artificial sequence
  synthetic polynucleotide sequence
ggatggccactacacgca

SEQ ID NO: 5255 - DNA, 19 bp, Artificial sequence
  synthetic polynucleotide sequence
ccaagctatacagccgaca

SEQ ID NO: 5256 - DNA, 17 bp, Artificial sequence
  synthetic polynucleotide sequence
gatagccaccactcgca

SEQ ID NO: 5257 - DNA, 18 bp, Artificial sequence
  synthetic polynucleotide sequence
ctacccaagccattggaa

SEQ ID NO: 5258 - DNA, 18 bp, Artificial sequence
  synthetic polynucleotide sequence
tcaccccaggcttcggga

SEQ ID NO: 5259 - DNA, 18 bp, Artificial sequence
  synthetic polynucleotide sequence
agctgagcaggcggcaga

SEQ ID NO: 5260 - DNA, 18 bp, Artificial sequence
  synthetic polynucleotide sequence
gcggtggcggagatgcga

SEQ ID NO: 5261 - DNA, 18 bp, Artificial sequence
  synthetic polynucleotide sequence
cgatggcaccagcaagga

SEQ ID NO: 5262 - DNA, 18 bp, Artificial sequence
  synthetic polynucleotide sequence
ggtgaagcccacgtacca

SEQ ID NO: 5263 - DNA, 18 bp, Artificial sequence
  synthetic polynucleotide sequence
cagtgccaaacagcggca

SEQ ID NO: 5264 - DNA, 18 bp, Artificial sequence
  synthetic polynucleotide sequence
cctctgggaccatgggca

SEQ ID NO: 5265 - DNA, 18 bp, Artificial sequence
  synthetic polynucleotide sequence
gccacttcaaggacccca

SEQ ID NO: 5266 - DNA, 20 bp, Artificial sequence
  synthetic polynucleotide sequence
gccaggtaacggttagcaca

SEQ ID NO: 5267 - DNA, 18 bp, Artificial sequence
  synthetic polynucleotide sequence
ttaccagtccgaagccca

SEQ ID NO: 5268 - DNA, 18 bp, Artificial sequence
  synthetic polynucleotide sequence
gcaggcctggtagtggca

SEQ ID NO: 5269 - DNA, 18 bp, Artificial sequence
  synthetic polynucleotide sequence
caacacctacgcctcaca

SEQ ID NO: 5270 - DNA, 18 bp, Artificial sequence
  synthetic polynucleotide sequence
gggcaggaagtgggcgga

SEQ ID NO: 5271 - DNA, 18 bp, Artificial sequence
  synthetic polynucleotide sequence
cgggtacgacgtctacca

SEQ ID NO: 5272 - DNA, 18 bp, Artificial sequence
  synthetic polynucleotide sequence
cgttcctccgggacagga

SEQ ID NO: 5273 - DNA, 18 bp, Artificial sequence
  synthetic polynucleotide sequence
accacagggaccacgaga

SEQ ID NO: 5274 - DNA, 18 bp, Artificial sequence
  synthetic polynucleotide sequence
cccagtctcgaagcctga

SEQ ID NO: 5275 - DNA, 18 bp, Artificial sequence
  synthetic polynucleotide sequence
cctccaggcgctccccga

SEQ ID NO: 5276 - DNA, 18 bp, Artificial sequence
  synthetic polynucleotide sequence
gctgctcatggccacgaa

SEQ ID NO: 5277 - DNA, 18 bp, Artificial sequence
  synthetic polynucleotide sequence
actccatgcaagtgccaa

SEQ ID NO: 5278 - DNA, 18 bp, Artificial sequence
  synthetic polynucleotide sequence
attcagggccacatacca

SEQ ID NO: 5279 - DNA, 18 bp, Artificial sequence
  synthetic polynucleotide sequence
ccacgaggagaaccccta

SEQ ID NO: 5280 - DNA, 18 bp, Artificial sequence
  synthetic polynucleotide sequence
cgaagagggcacttctca

SEQ ID NO: 5281 - DNA, 18 bp, Artificial sequence
  synthetic polynucleotide sequence
cacagtggtacctgagga

SEQ ID NO: 5282 - DNA, 18 bp, Artificial sequence
  synthetic polynucleotide sequence
ccacaattccaactgcca

SEQ ID NO: 5283 - DNA, 18 bp, Artificial sequence
  synthetic polynucleotide sequence
caacggcaaaggcaagga

SEQ ID NO: 5284 - DNA, 18 bp, Artificial sequence
  synthetic polynucleotide sequence
ccttgcgggtgaaggcca

SEQ ID NO: 5285 - DNA, 18 bp, Artificial sequence
  synthetic polynucleotide sequence
ctgggtcagtccgaagca

SEQ ID NO: 5286 - DNA, 18 bp, Artificial sequence
  synthetic polynucleotide sequence
agctgcctccgcctgaga

SEQ ID NO: 5287 - DNA, 18 bp, Artificial sequence
  synthetic polynucleotide sequence
ctgagcaggaggagggca

SEQ ID NO: 5288 - DNA, 18 bp, Artificial sequence
  synthetic polynucleotide sequence
gagcgcagattccgggca

SEQ ID NO: 5289 - DNA, 18 bp, Artificial sequence
  synthetic polynucleotide sequence
gccgcaacacagaccaga

SEQ ID NO: 5290 - DNA, 18 bp, Artificial sequence
  synthetic polynucleotide sequence
catggtgaaggcgcctca

SEQ ID NO: 5291 - DNA, 18 bp, Artificial sequence
  synthetic polynucleotide sequence
tggaccagtactccccca

SEQ ID NO: 5292 - DNA, 18 bp, Artificial sequence
  synthetic polynucleotide sequence
gcagcggctcatgagaga

SEQ ID NO: 5293 - DNA, 18 bp, Artificial sequence
  synthetic polynucleotide sequence
aaggctgaactccgagca

SEQ ID NO: 5294 - DNA, 18 bp, Artificial sequence
  synthetic polynucleotide sequence
ctgcaacaagactagcca

SEQ ID NO: 5295 - DNA, 18 bp, Artificial sequence
  synthetic polynucleotide sequence
tggcggaagcagtgggaa

SEQ ID NO: 5296 - DNA, 18 bp, Artificial sequence
  synthetic polynucleotide sequence
atgacatagagaggccca

SEQ ID NO: 5297 - DNA, 18 bp, Artificial sequence
  synthetic polynucleotide sequence
cgccaactgcacacacga

SEQ ID NO: 5298 - DNA, 18 bp, Artificial sequence
  synthetic polynucleotide sequence
gctcgaaaggcgccgaca

SEQ ID NO: 5299 - DNA, 18 bp, Artificial sequence
  synthetic polynucleotide sequence
ccgggtgtacacacacca

SEQ ID NO: 5300 - DNA, 18 bp, Artificial sequence
  synthetic polynucleotide sequence
acagctcctccaccggga

SEQ ID NO: 5301 - DNA, 18 bp, Artificial sequence
  synthetic polynucleotide sequence
gccttggcgccaacacca

SEQ ID NO: 5302 - DNA, 18 bp, Artificial sequence
  synthetic polynucleotide sequence
caggctagtggccgagga

SEQ ID NO: 5303 - DNA, 18 bp, Artificial sequence
  synthetic polynucleotide sequence
gctgacaagtaccgccta

SEQ ID NO: 5304 - DNA, 18 bp, Artificial sequence
  synthetic polynucleotide sequence
gagatggccagcgtgaca

SEQ ID NO: 5305 - DNA, 18 bp, Artificial sequence
  synthetic polynucleotide sequence
agaaaggctgggacgaca

SEQ ID NO: 5306 - DNA, 18 bp, Artificial sequence
  synthetic polynucleotide sequence
cgaccgcaatcccaggga

SEQ ID NO: 5307 - DNA, 18 bp, Artificial sequence
  synthetic polynucleotide sequence
cagcacgtgggacagaga

SEQ ID NO: 5308 - DNA, 18 bp, Artificial sequence
  synthetic polynucleotide sequence
ataccaccacccatgcca

SEQ ID NO: 5309 - DNA, 21 bp, Artificial sequence
  synthetic polynucleotide sequence
ctataatggcacagctggaga

SEQ ID NO: 5310 - DNA, 18 bp, Artificial sequence
  synthetic polynucleotide sequence
cagcccacagttcccaga

SEQ ID NO: 5311 - DNA, 18 bp, Artificial sequence
  synthetic polynucleotide sequence
cccaggtagctgagggca

SEQ ID NO: 5312 - DNA, 18 bp, Artificial sequence
  synthetic polynucleotide sequence
atgagacgcgccaagcca

SEQ ID NO: 5313 - DNA, 18 bp, Artificial sequence
  synthetic polynucleotide sequence
ccaagtcatggggaacca

SEQ ID NO: 5314 - DNA, 18 bp, Artificial sequence
  synthetic polynucleotide sequence
ctgaagcatcccccagca

SEQ ID NO: 5315 - DNA, 18 bp, Artificial sequence
  synthetic polynucleotide sequence
ccagggacaaacccacca

SEQ ID NO: 5316 - DNA, 18 bp, Artificial sequence
  synthetic polynucleotide sequence
ggtcagggtccgcacaga

SEQ ID NO: 5317 - DNA, 18 bp, Artificial sequence
  synthetic polynucleotide sequence
cccgctgcggccagtgga

SEQ ID NO: 5318 - DNA, 18 bp, Artificial sequence
  synthetic polynucleotide sequence
aaggtgagagaggtccca

SEQ ID NO: 5319 - DNA, 18 bp, Artificial sequence
  synthetic polynucleotide sequence
ctggatgcaagaacccca

SEQ ID NO: 5320 - DNA, 18 bp, Artificial sequence
  synthetic polynucleotide sequence
ggccagattcacggagca

SEQ ID NO: 5321 - DNA, 18 bp, Artificial sequence
  synthetic polynucleotide sequence
accaaccccatcagcgga

SEQ ID NO: 5322 - DNA, 18 bp, Artificial sequence
  synthetic polynucleotide sequence
tgaggaagccacgcccca

SEQ ID NO: 5323 - DNA, 18 bp, Artificial sequence
  synthetic polynucleotide sequence
cgtcaagtcagccaccca

SEQ ID NO: 5324 - DNA, 18 bp, Artificial sequence
  synthetic polynucleotide sequence
aggtgccaaccaagccca

SEQ ID NO: 5325 - DNA, 18 bp, Artificial sequence
  synthetic polynucleotide sequence
gagcaggctcaacgagga

SEQ ID NO: 5326 - DNA, 18 bp, Artificial sequence
  synthetic polynucleotide sequence
gtccctgagccccacaga

SEQ ID NO: 5327 - DNA, 18 bp, Artificial sequence
  synthetic polynucleotide sequence
gcccatcaccatccgcaa

SEQ ID NO: 5328 - DNA, 18 bp, Artificial sequence
  synthetic polynucleotide sequence
cacttggcgatgaagcga

SEQ ID NO: 5329 - DNA, 18 bp, Artificial sequence
  synthetic polynucleotide sequence
tcagccgagtagaaggca

SEQ ID NO: 5330 - DNA, 18 bp, Artificial sequence
  synthetic polynucleotide sequence
acagtcggaggaggtgga

SEQ ID NO: 5331 - DNA, 18 bp, Artificial sequence
  synthetic polynucleotide sequence
gaacaaccaggccaagga

SEQ ID NO: 5332 - DNA, 18 bp, Artificial sequence
  synthetic polynucleotide sequence
ccagggccatgcctccca

SEQ ID NO: 5333 - DNA, 18 bp, Artificial sequence
  synthetic polynucleotide sequence
cgaccggctcgtaagcaa

SEQ ID NO: 5334 - DNA, 18 bp, Artificial sequence
  synthetic polynucleotide sequence
acacgcacactgactgca

SEQ ID NO: 5335 - DNA, 18 bp, Artificial sequence
  synthetic polynucleotide sequence
gctactcccgcaaccaca

SEQ ID NO: 5336 - DNA, 18 bp, Artificial sequence
  synthetic polynucleotide sequence
cgttcccccatgcaggca

SEQ ID NO: 5337 - DNA, 18 bp, Artificial sequence
  synthetic polynucleotide sequence
gcctatggaaaacgggga

SEQ ID NO: 5338 - DNA, 18 bp, Artificial sequence
  synthetic polynucleotide sequence
gcaatcagctccacgtca

SEQ ID NO: 5339 - DNA, 18 bp, Artificial sequence
  synthetic polynucleotide sequence
tgtgggtcagagagccaa

SEQ ID NO: 5340 - DNA, 18 bp, Artificial sequence
  synthetic polynucleotide sequence
gctccacatcgaagacga

SEQ ID NO: 5341 - DNA, 18 bp, Artificial sequence
  synthetic polynucleotide sequence
catcaagggctgggacca

SEQ ID NO: 5342 - DNA, 18 bp, Artificial sequence
  synthetic polynucleotide sequence
accctagctcggatggga

SEQ ID NO: 5343 - DNA, 18 bp, Artificial sequence
  synthetic polynucleotide sequence
tgggggaggtgtgccaca

SEQ ID NO: 5344 - DNA, 18 bp, Artificial sequence
  synthetic polynucleotide sequence
ccagtgcaacctccacga

SEQ ID NO: 5345 - DNA, 18 bp, Artificial sequence
  synthetic polynucleotide sequence
tcatcaaggcatgggaca

SEQ ID NO: 5346 - DNA, 18 bp, Artificial sequence
  synthetic polynucleotide sequence
agggagactgccagccga

SEQ ID NO: 5347 - DNA, 18 bp, Artificial sequence
  synthetic polynucleotide sequence
gctactctcggaaccgca

SEQ ID NO: 5348 - DNA, 18 bp, Artificial sequence
  synthetic polynucleotide sequence
aggtgaggcgggaccaca

SEQ ID NO: 5349 - DNA, 18 bp, Artificial sequence
  synthetic polynucleotide sequence
atcgtggaggtccacgca

SEQ ID NO: 5350 - DNA, 18 bp, Artificial sequence
  synthetic polynucleotide sequence
ggctcccactggtcacca

SEQ ID NO: 5351 - DNA, 18 bp, Artificial sequence
  synthetic polynucleotide sequence
cctcccaccacagcagga

SEQ ID NO: 5352 - DNA, 18 bp, Artificial sequence
  synthetic polynucleotide sequence
acgctgcagtccaccgga

SEQ ID NO: 5353 - DNA, 18 bp, Artificial sequence
  synthetic polynucleotide sequence
ggaagccttccacggcaa

SEQ ID NO: 5354 - DNA, 18 bp, Artificial sequence
  synthetic polynucleotide sequence
acagtgcggcactcagca

SEQ ID NO: 5355 - DNA, 18 bp, Artificial sequence
  synthetic polynucleotide sequence
tgcccaacttccccagca

SEQ ID NO: 5356 - DNA, 18 bp, Artificial sequence
  synthetic polynucleotide sequence
ccctcaataccaggccca

SEQ ID NO: 5357 - DNA, 18 bp, Artificial sequence
  synthetic polynucleotide sequence
gtctgagctggagccaga

SEQ ID NO: 5358 - DNA, 18 bp, Artificial sequence
  synthetic polynucleotide sequence
tgccataggcggacacca

SEQ ID NO: 5359 - DNA, 18 bp, Artificial sequence
  synthetic polynucleotide sequence
tcaccagcctccaggaga

SEQ ID NO: 5360 - DNA, 18 bp, Artificial sequence
  synthetic polynucleotide sequence
tcgatggagtggacgcca

SEQ ID NO: 5361 - DNA, 18 bp, Artificial sequence
  synthetic polynucleotide sequence
caaaatcggggaggcgga

SEQ ID NO: 5362 - DNA, 18 bp, Artificial sequence
  synthetic polynucleotide sequence
gcagggcctctagcacca

SEQ ID NO: 5363 - DNA, 18 bp, Artificial sequence
  synthetic polynucleotide sequence
cctgactgggatggcaga

SEQ ID NO: 5364 - DNA, 18 bp, Artificial sequence
  synthetic polynucleotide sequence
ggtgaagagagagagcca

SEQ ID NO: 5365 - DNA, 18 bp, Artificial sequence
  synthetic polynucleotide sequence
ctggcacccctgtaacca

SEQ ID NO: 5366 - DNA, 18 bp, Artificial sequence
  synthetic polynucleotide sequence
caaccaaggtgctagcca

SEQ ID NO: 5367 - DNA, 18 bp, Artificial sequence
  synthetic polynucleotide sequence
aggatgtcagctggcaga

SEQ ID NO: 5368 - DNA, 18 bp, Artificial sequence
  synthetic polynucleotide sequence
gcggagagagtagcccca

SEQ ID NO: 5369 - DNA, 17 bp, Artificial sequence
  synthetic polynucleotide sequence
ctcgggactcagtggga

SEQ ID NO: 5370 - DNA, 19 bp, Artificial sequence
  synthetic polynucleotide sequence
catcttggacccagcgaca

SEQ ID NO: 5371 - DNA, 18 bp, Artificial sequence
  synthetic polynucleotide sequence
tgaagctgggcagcctga

SEQ ID NO: 5372 - DNA, 18 bp, Artificial sequence
  synthetic polynucleotide sequence
ggagggaccaagaaccca

SEQ ID NO: 5373 - DNA, 18 bp, Artificial sequence
  synthetic polynucleotide sequence
tcctgccctggacacaga

SEQ ID NO: 5374 - DNA, 18 bp, Artificial sequence
  synthetic polynucleotide sequence
caggaggcagtgtcagca

SEQ ID NO: 5375 - DNA, 18 bp, Artificial sequence
  synthetic polynucleotide sequence
ccaagtccactgaccgga

SEQ ID NO: 5376 - DNA, 18 bp, Artificial sequence
  synthetic polynucleotide sequence
ccttcacgtccagcagca

SEQ ID NO: 5377 - DNA, 18 bp, Artificial sequence
  synthetic polynucleotide sequence
gctcctaacggatccaca

SEQ ID NO: 5378 - DNA, 18 bp, Artificial sequence
  synthetic polynucleotide sequence
ctgggccagtcaagcgga

SEQ ID NO: 5379 - DNA, 18 bp, Artificial sequence
  synthetic polynucleotide sequence
gcaatgtactgccacgaa

SEQ ID NO: 5380 - DNA, 18 bp, Artificial sequence
  synthetic polynucleotide sequence
agtagacgacttgggaca

SEQ ID NO: 5381 - DNA, 18 bp, Artificial sequence
  synthetic polynucleotide sequence
atgagctcccagcaagca

SEQ ID NO: 5382 - DNA, 18 bp, Artificial sequence
  synthetic polynucleotide sequence
tcaaggaaggggtaggca

SEQ ID NO: 5383 - DNA, 18 bp, Artificial sequence
  synthetic polynucleotide sequence
gctccagggaggatgaca

SEQ ID NO: 5384 - DNA, 18 bp, Artificial sequence
  synthetic polynucleotide sequence
agggctgaatcaagccta

SEQ ID NO: 5385 - DNA, 18 bp, Artificial sequence
  synthetic polynucleotide sequence
cctacaaccagctgcaga

SEQ ID NO: 5386 - DNA, 18 bp, Artificial sequence
  synthetic polynucleotide sequence
gcacctgcagcttggaga

SEQ ID NO: 5387 - DNA, 18 bp, Artificial sequence
  synthetic polynucleotide sequence
gctggagagttcaaggca

SEQ ID NO: 5388 - DNA, 18 bp, Artificial sequence
  synthetic polynucleotide sequence
tcaatagcagtgacccca

SEQ ID NO: 5389 - DNA, 18 bp, Artificial sequence
  synthetic polynucleotide sequence
catcatcggggaccacga

SEQ ID NO: 5390 - DNA, 18 bp, Artificial sequence
  synthetic polynucleotide sequence
tgggcagacataccagga

SEQ ID NO: 5391 - DNA, 18 bp, Artificial sequence
  synthetic polynucleotide sequence
gcacacctgtgaccagca

SEQ ID NO: 5392 - DNA, 18 bp, Artificial sequence
  synthetic polynucleotide sequence
gtcggaagctgagaccca

SEQ ID NO: 5393 - DNA, 18 bp, Artificial sequence
  synthetic polynucleotide sequence
ccaccggaagatccccaa

SEQ ID NO: 5394 - DNA, 18 bp, Artificial sequence
  synthetic polynucleotide sequence
tcgcatggtgcccaagga

SEQ ID NO: 5395 - DNA, 18 bp, Artificial sequence
  synthetic polynucleotide sequence
ccctccctgccataggga

SEQ ID NO: 5396 - DNA, 18 bp, Artificial sequence
  synthetic polynucleotide sequence
cgaatgcgggtccagcca

SEQ ID NO: 5397 - DNA, 18 bp, Artificial sequence
  synthetic polynucleotide sequence
gactgccatggacggcaa

SEQ ID NO: 5398 - DNA, 18 bp, Artificial sequence
  synthetic polynucleotide sequence
ctgacaggctcctgacga

SEQ ID NO: 5399 - DNA, 18 bp, Artificial sequence
  synthetic polynucleotide sequence
gcccaaggggagaaagga

SEQ ID NO: 5400 - DNA, 18 bp, Artificial sequence
  synthetic polynucleotide sequence
ggccacagcagtgacaga

SEQ ID NO: 5401 - DNA, 18 bp, Artificial sequence
  synthetic polynucleotide sequence
agcagcacaaggaagaga

SEQ ID NO: 5402 - DNA, 18 bp, Artificial sequence
  synthetic polynucleotide sequence
caggacataggagggcga

SEQ ID NO: 5403 - DNA, 18 bp, Artificial sequence
  synthetic polynucleotide sequence
cccaggttcgaggaggga

SEQ ID NO: 5404 - DNA, 20 bp, Artificial sequence
  synthetic polynucleotide sequence
ctcactgaacttggaagcaa

SEQ ID NO: 5405 - DNA, 18 bp, Artificial sequence
  synthetic polynucleotide sequence
gcaactacagccgaggga

SEQ ID NO: 5406 - DNA, 18 bp, Artificial sequence
  synthetic polynucleotide sequence
gccccactcatggctgca

SEQ ID NO: 5407 - DNA, 18 bp, Artificial sequence
  synthetic polynucleotide sequence
ggcaaccccaacgaggaa

SEQ ID NO: 5408 - DNA, 18 bp, Artificial sequence
  synthetic polynucleotide sequence
gttgcagcatcagggcca

SEQ ID NO: 5409 - DNA, 18 bp, Artificial sequence
  synthetic polynucleotide sequence
ggagtgcccagcccagga

SEQ ID NO: 5410 - DNA, 18 bp, Artificial sequence
  synthetic polynucleotide sequence
ctggccgtgcagcaggca

SEQ ID NO: 5411 - DNA, 18 bp, Artificial sequence
  synthetic polynucleotide sequence
aaagccagccctgagcga

SEQ ID NO: 5412 - DNA, 18 bp, Artificial sequence
  synthetic polynucleotide sequence
atggggcagagctggcga

SEQ ID NO: 5413 - DNA, 18 bp, Artificial sequence
  synthetic polynucleotide sequence
caagcggagacagaccaa

SEQ ID NO: 5414 - DNA, 18 bp, Artificial sequence
  synthetic polynucleotide sequence
ggtcattgaggagaggca

SEQ ID NO: 5415 - DNA, 18 bp, Artificial sequence
  synthetic polynucleotide sequence
cccttccagaccagccaa

SEQ ID NO: 5416 - DNA, 18 bp, Artificial sequence
  synthetic polynucleotide sequence
gagggcgagttcagggga

SEQ ID NO: 5417 - DNA, 18 bp, Artificial sequence
  synthetic polynucleotide sequence
cccccacactcatgacca

SEQ ID NO: 5418 - DNA, 18 bp, Artificial sequence
  synthetic polynucleotide sequence
agcgaggagggttggaga

SEQ ID NO: 5419 - DNA, 18 bp, Artificial sequence
  synthetic polynucleotide sequence
gtgaggagcccctgcaca

SEQ ID NO: 5420 - DNA, 18 bp, Artificial sequence
  synthetic polynucleotide sequence
gcggtgagccttggagca

SEQ ID NO: 5421 - DNA, 18 bp, Artificial sequence
  synthetic polynucleotide sequence
cctgaaaggggaccccca

SEQ ID NO: 5422 - DNA, 18 bp, Artificial sequence
  synthetic polynucleotide sequence
gggcaacgtagagccgta

SEQ ID NO: 5423 - DNA, 18 bp, Artificial sequence
  synthetic polynucleotide sequence
accaccaccaaccccaca

SEQ ID NO: 5424 - DNA, 18 bp, Artificial sequence
  synthetic polynucleotide sequence
ggagtacaccccctggta

SEQ ID NO: 5425 - DNA, 18 bp, Artificial sequence
  synthetic polynucleotide sequence
actgcaacctgcaagcca

SEQ ID NO: 5426 - DNA, 18 bp, Artificial sequence
  synthetic polynucleotide sequence
gccgtgactcagggacga

SEQ ID NO: 5427 - DNA, 18 bp, Artificial sequence
  synthetic polynucleotide sequence
cagcggggacctgaacca

SEQ ID NO: 5428 - DNA, 18 bp, Artificial sequence
  synthetic polynucleotide sequence
aatccccagccggtggga

SEQ ID NO: 5429 - DNA, 18 bp, Artificial sequence
  synthetic polynucleotide sequence
cagttcggagcgctggga

SEQ ID NO: 5430 - DNA, 18 bp, Artificial sequence
  synthetic polynucleotide sequence
ccaccgggataagcggca

SEQ ID NO: 5431 - DNA, 18 bp, Artificial sequence
  synthetic polynucleotide sequence
cagccgagctgcaaggca

SEQ ID NO: 5432 - DNA, 18 bp, Artificial sequence
  synthetic polynucleotide sequence
gcatggaagaggacgcca

SEQ ID NO: 5433 - DNA, 18 bp, Artificial sequence
  synthetic polynucleotide sequence
gactgagccctgagccca

SEQ ID NO: 5434 - DNA, 18 bp, Artificial sequence
  synthetic polynucleotide sequence
gaggttggtgagcgggga

SEQ ID NO: 5435 - DNA, 18 bp, Artificial sequence
  synthetic polynucleotide sequence
ctacgccaccaatccgca

SEQ ID NO: 5436 - DNA, 18 bp, Artificial sequence
  synthetic polynucleotide sequence
cgtggcggaagtagcaga

SEQ ID NO: 5437 - DNA, 18 bp, Artificial sequence
  synthetic polynucleotide sequence
ccaccctcatcagcacca

SEQ ID NO: 5438 - DNA, 18 bp, Artificial sequence
  synthetic polynucleotide sequence
ctggaccaattgagccga

SEQ ID NO: 5439 - DNA, 18 bp, Artificial sequence
  synthetic polynucleotide sequence
ctcagccctgccagccca

SEQ ID NO: 5440 - DNA, 18 bp, Artificial sequence
  synthetic polynucleotide sequence
gtggtcccagtaagagca

SEQ ID NO: 5441 - DNA, 18 bp, Artificial sequence
  synthetic polynucleotide sequence
gcacatcaggtccaccca

SEQ ID NO: 5442 - DNA, 18 bp, Artificial sequence
  synthetic polynucleotide sequence
ctcagtccgcatccggca

SEQ ID NO: 5443 - DNA, 18 bp, Artificial sequence
  synthetic polynucleotide sequence
acctatggcagccaggca

SEQ ID NO: 5444 - DNA, 18 bp, Artificial sequence
  synthetic polynucleotide sequence
ggacgcccgttaactgca

SEQ ID NO: 5445 - DNA, 18 bp, Artificial sequence
  synthetic polynucleotide sequence
gcgacttggacctggaca

SEQ ID NO: 5446 - DNA, 18 bp, Artificial sequence
  synthetic polynucleotide sequence
gaggcctgcttagcacca

SEQ ID NO: 5447 - DNA, 18 bp, Artificial sequence
  synthetic polynucleotide sequence
ccttccgtccacgaagca

SEQ ID NO: 5448 - DNA, 18 bp, Artificial sequence
  synthetic polynucleotide sequence
gaggtgagattgagccca

SEQ ID NO: 5449 - DNA, 18 bp, Artificial sequence
  synthetic polynucleotide sequence
gaagagctgaacggggca

SEQ ID NO: 5450 - DNA, 18 bp, Artificial sequence
  synthetic polynucleotide sequence
caggatgcacggcttgca

SEQ ID NO: 5451 - DNA, 19 bp, Artificial sequence
  synthetic polynucleotide sequence
atcctgccacctggaagaa

SEQ ID NO: 5452 - DNA, 19 bp, Artificial sequence
  synthetic polynucleotide sequence
cggaactccagctcatcca

SEQ ID NO: 5453 - DNA, 18 bp, Artificial sequence
  synthetic polynucleotide sequence
gctcaaccccaacagcga

SEQ ID NO: 5454 - DNA, 18 bp, Artificial sequence
  synthetic polynucleotide sequence
ggaagggcttgcgcagga

SEQ ID NO: 5455 - DNA, 18 bp, Artificial sequence
  synthetic polynucleotide sequence
tggagcaccgccaccaca

SEQ ID NO: 5456 - DNA, 18 bp, Artificial sequence
  synthetic polynucleotide sequence
tctccagctgggccagca

SEQ ID NO: 5457 - DNA, 18 bp, Artificial sequence
  synthetic polynucleotide sequence
aaagggcctcctcaccca

SEQ ID NO: 5458 - DNA, 18 bp, Artificial sequence
  synthetic polynucleotide sequence
gctccagcagcttcagga

SEQ ID NO: 5459 - DNA, 18 bp, Artificial sequence
  synthetic polynucleotide sequence
cctggaccaacgacccta

SEQ ID NO: 5460 - DNA, 18 bp, Artificial sequence
  synthetic polynucleotide sequence
tggctataagggccacca

SEQ ID NO: 5461 - DNA, 17 bp, Artificial sequence
  synthetic polynucleotide sequence
ggcccagaaccaccgca

SEQ ID NO: 5462 - DNA, 17 bp, Artificial sequence
  synthetic polynucleotide sequence
ggggtgccaccccagga

SEQ ID NO: 5463 - DNA, 18 bp, Artificial sequence
  synthetic polynucleotide sequence
actacgaatggggacaca

SEQ ID NO: 5464 - DNA, 18 bp, Artificial sequence
  synthetic polynucleotide sequence
aagccaccacagcagcga

SEQ ID NO: 5465 - DNA, 18 bp, Artificial sequence
  synthetic polynucleotide sequence
tcaaggaggccgtgcgaa

SEQ ID NO: 5466 - DNA, 18 bp, Artificial sequence
  synthetic polynucleotide sequence
gcgaagggggttcatgca

SEQ ID NO: 5467 - DNA, 18 bp, Artificial sequence
  synthetic polynucleotide sequence
cccagcaggatgtggaca

SEQ ID NO: 5468 - DNA, 18 bp, Artificial sequence
  synthetic polynucleotide sequence
ccccacttgagaagggga

SEQ ID NO: 5469 - DNA, 18 bp, Artificial sequence
  synthetic polynucleotide sequence
gtcccccacagacacaga

SEQ ID NO: 5470 - DNA, 18 bp, Artificial sequence
  synthetic polynucleotide sequence
ggaactggaactgggcca

SEQ ID NO: 5471 - DNA, 18 bp, Artificial sequence
  synthetic polynucleotide sequence
ccctgggagctccacaca

SEQ ID NO: 5472 - DNA, 18 bp, Artificial sequence
  synthetic polynucleotide sequence
cgcccaacaacaagtcca

SEQ ID NO: 5473 - DNA, 18 bp, Artificial sequence
  synthetic polynucleotide sequence
tccccagtcacagaggca

SEQ ID NO: 5474 - DNA, 18 bp, Artificial sequence
  synthetic polynucleotide sequence
accaccagccctcatgca

SEQ ID NO: 5475 - DNA, 18 bp, Artificial sequence
  synthetic polynucleotide sequence
ccttgcagaacagcccca

SEQ ID NO: 5476 - DNA, 18 bp, Artificial sequence
  synthetic polynucleotide sequence
gaatggacgtagtgggga

SEQ ID NO: 5477 - DNA, 18 bp, Artificial sequence
  synthetic polynucleotide sequence
ctactccaagcaggccga

SEQ ID NO: 5478 - DNA, 18 bp, Artificial sequence
  synthetic polynucleotide sequence
atccggctggacaccaca

SEQ ID NO: 5479 - DNA, 18 bp, Artificial sequence
  synthetic polynucleotide sequence
ctgccaaggaagggcaga

SEQ ID NO: 5480 - DNA, 18 bp, Artificial sequence
  synthetic polynucleotide sequence
cttgcaacctgcccagga

SEQ ID NO: 5481 - DNA, 18 bp, Artificial sequence
  synthetic polynucleotide sequence
ggcagagatggaggagga

SEQ ID NO: 5482 - DNA, 18 bp, Artificial sequence
  synthetic polynucleotide sequence
ccaccttcagtggccaca

SEQ ID NO: 5483 - DNA, 18 bp, Artificial sequence
  synthetic polynucleotide sequence
ctgaaagcagcacaccaa

SEQ ID NO: 5484 - DNA, 18 bp, Artificial sequence
  synthetic polynucleotide sequence
gaacaggggttggcccta

SEQ ID NO: 5485 - DNA, 18 bp, Artificial sequence
  synthetic polynucleotide sequence
acttccagcacgagccca

SEQ ID NO: 5486 - DNA, 18 bp, Artificial sequence
  synthetic polynucleotide sequence
cgatggcctcgggagaga

SEQ ID NO: 5487 - DNA, 18 bp, Artificial sequence
  synthetic polynucleotide sequence
tacggagcctcctgcaga

SEQ ID NO: 5488 - DNA, 18 bp, Artificial sequence
  synthetic polynucleotide sequence
ggagactgaacttcagca

SEQ ID NO: 5489 - DNA, 18 bp, Artificial sequence
  synthetic polynucleotide sequence
gagggcgtccaatggcaa

SEQ ID NO: 5490 - DNA, 18 bp, Artificial sequence
  synthetic polynucleotide sequence
gcccgtgaccttgcggca

SEQ ID NO: 5491 - DNA, 18 bp, Artificial sequence
  synthetic polynucleotide sequence
agctgaccaacatcacca

SEQ ID NO: 5492 - DNA, 18 bp, Artificial sequence
  synthetic polynucleotide sequence
gtgtagcagtagccagca

SEQ ID NO: 5493 - DNA, 18 bp, Artificial sequence
  synthetic polynucleotide sequence
tgacaccaggatcgccaa

SEQ ID NO: 5494 - DNA, 18 bp, Artificial sequence
  synthetic polynucleotide sequence
acacagtgatgaggggca

SEQ ID NO: 5495 - DNA, 18 bp, Artificial sequence
  synthetic polynucleotide sequence
gtccagtaccaaggcaga

SEQ ID NO: 5496 - DNA, 18 bp, Artificial sequence
  synthetic polynucleotide sequence
caatagatctgcccagca

SEQ ID NO: 5497 - DNA, 18 bp, Artificial sequence
  synthetic polynucleotide sequence
ccagtggctggaagctga

SEQ ID NO: 5498 - DNA, 18 bp, Artificial sequence
  synthetic polynucleotide sequence
tcactggagtccaggcga

SEQ ID NO: 5499 - DNA, 18 bp, Artificial sequence
  synthetic polynucleotide sequence
ccgcaagtcctgtgagca

SEQ ID NO: 5500 - DNA, 18 bp, Artificial sequence
  synthetic polynucleotide sequence
cgctcgacacaccacgca

SEQ ID NO: 5501 - DNA, 18 bp, Artificial sequence
  synthetic polynucleotide sequence
cagccagcactgagcaga

SEQ ID NO: 5502 - DNA, 18 bp, Artificial sequence
  synthetic polynucleotide sequence
aggacagcttagccggca

SEQ ID NO: 5503 - DNA, 18 bp, Artificial sequence
  synthetic polynucleotide sequence
gctgcaaacctgacagca

SEQ ID NO: 5504 - DNA, 18 bp, Artificial sequence
  synthetic polynucleotide sequence
agtggccatctggagaga

SEQ ID NO: 5505 - DNA, 18 bp, Artificial sequence
  synthetic polynucleotide sequence
ctgccgagaagcacagga

SEQ ID NO: 5506 - DNA, 18 bp, Artificial sequence
  synthetic polynucleotide sequence
acagggagtccaggccca

SEQ ID NO: 5507 - DNA, 18 bp, Artificial sequence
  synthetic polynucleotide sequence
caagaagatgggtgacca

SEQ ID NO: 5508 - DNA, 18 bp, Artificial sequence
  synthetic polynucleotide sequence
agatactcgcccagccca

SEQ ID NO: 5509 - DNA, 18 bp, Artificial sequence
  synthetic polynucleotide sequence
gcagactccattgcccca

SEQ ID NO: 5510 - DNA, 18 bp, Artificial sequence
  synthetic polynucleotide sequence
tgggagtcatgcacacga

SEQ ID NO: 5511 - DNA, 18 bp, Artificial sequence
  synthetic polynucleotide sequence
gcacagccaccaccagca

SEQ ID NO: 5512 - DNA, 18 bp, Artificial sequence
  synthetic polynucleotide sequence
ggaggagccccagtcgga

SEQ ID NO: 5513 - DNA, 18 bp, Artificial sequence
  synthetic polynucleotide sequence
gggaacagctctccggaa

SEQ ID NO: 5514 - DNA, 18 bp, Artificial sequence
  synthetic polynucleotide sequence
ccactccccatcagacca

SEQ ID NO: 5515 - DNA, 18 bp, Artificial sequence
  synthetic polynucleotide sequence
ggtgaaactactgggcca

SEQ ID NO: 5516 - DNA, 18 bp, Artificial sequence
  synthetic polynucleotide sequence
ggctagagcccagcccca

SEQ ID NO: 5517 - DNA, 18 bp, Artificial sequence
  synthetic polynucleotide sequence
tgccagcctcatgcccca

SEQ ID NO: 5518 - DNA, 18 bp, Artificial sequence
  synthetic polynucleotide sequence
ccgagtggacatgcacga

SEQ ID NO: 5519 - DNA, 18 bp, Artificial sequence
  synthetic polynucleotide sequence
gcgagtgggtcctagaga

SEQ ID NO: 5520 - DNA, 18 bp, Artificial sequence
  synthetic polynucleotide sequence
ggagggcagtgctggaca

SEQ ID NO: 5521 - DNA, 18 bp, Artificial sequence
  synthetic polynucleotide sequence
tcagactgtgacccacca

SEQ ID NO: 5522 - DNA, 18 bp, Artificial sequence
  synthetic polynucleotide sequence
gcatccatagaggctgga

SEQ ID NO: 5523 - DNA, 18 bp, Artificial sequence
  synthetic polynucleotide sequence
ggctacaggacacagcca

SEQ ID NO: 5524 - DNA, 18 bp, Artificial sequence
  synthetic polynucleotide sequence
aaccgcggtacacgggca

SEQ ID NO: 5525 - DNA, 18 bp, Artificial sequence
  synthetic polynucleotide sequence
accgcagcgactccgaca

SEQ ID NO: 5526 - DNA, 18 bp, Artificial sequence
  synthetic polynucleotide sequence
acaccgcccaggccacca

SEQ ID NO: 5527 - DNA, 18 bp, Artificial sequence
  synthetic polynucleotide sequence
gaactcgcagcacctgga

SEQ ID NO: 5528 - DNA, 18 bp, Artificial sequence
  synthetic polynucleotide sequence
ggaggaggcacttgggaa

SEQ ID NO: 5529 - DNA, 18 bp, Artificial sequence
  synthetic polynucleotide sequence
ccgactacatcaccgaga

SEQ ID NO: 5530 - DNA, 18 bp, Artificial sequence
  synthetic polynucleotide sequence
tgaaggagcgaggccgca

SEQ ID NO: 5531 - DNA, 18 bp, Artificial sequence
  synthetic polynucleotide sequence
ggcatgaatgagagccga

SEQ ID NO: 5532 - DNA, 18 bp, Artificial sequence
  synthetic polynucleotide sequence
gtgggtagcggtcacaga

SEQ ID NO: 5533 - DNA, 18 bp, Artificial sequence
  synthetic polynucleotide sequence
atgctcaccaaccccgaa

SEQ ID NO: 5534 - DNA, 18 bp, Artificial sequence
  synthetic polynucleotide sequence
gatttccagccacaccaa

SEQ ID NO: 5535 - DNA, 18 bp, Artificial sequence
  synthetic polynucleotide sequence
cacccttccagaaatgga

SEQ ID NO: 5536 - DNA, 18 bp, Artificial sequence
  synthetic polynucleotide sequence
agccataaggcacttgga

SEQ ID NO: 5537 - DNA, 18 bp, Artificial sequence
  synthetic polynucleotide sequence
gaccttgcagacaagcca

SEQ ID NO: 5538 - DNA, 18 bp, Artificial sequence
  synthetic polynucleotide sequence
tctgcggccagcagctca

SEQ ID NO: 5539 - DNA, 18 bp, Artificial sequence
  synthetic polynucleotide sequence
tgatcgagacagccgaca

SEQ ID NO: 5540 - DNA, 18 bp, Artificial sequence
  synthetic polynucleotide sequence
acgacctcgaccccctga

SEQ ID NO: 5541 - DNA, 18 bp, Artificial sequence
  synthetic polynucleotide sequence
cagtccctgcagatcgga

SEQ ID NO: 5542 - DNA, 18 bp, Artificial sequence
  synthetic polynucleotide sequence
tgctcagcacgatgagga

SEQ ID NO: 5543 - DNA, 19 bp, Artificial sequence
  synthetic polynucleotide sequence
gcaataagaagcgcaggca

SEQ ID NO: 5544 - DNA, 17 bp, Artificial sequence
  synthetic polynucleotide sequence
gggaggcgccagaggca

SEQ ID NO: 5545 - DNA, 18 bp, Artificial sequence
  synthetic polynucleotide sequence
ccccagaccctcaagcca

SEQ ID NO: 5546 - DNA, 18 bp, Artificial sequence
  synthetic polynucleotide sequence
attccggcataaccggga

SEQ ID NO: 5547 - DNA, 18 bp, Artificial sequence
  synthetic polynucleotide sequence
tggggccaaagtcaggaa

SEQ ID NO: 5548 - DNA, 18 bp, Artificial sequence
  synthetic polynucleotide sequence
ggaggtggacccaaggta

SEQ ID NO: 5549 - DNA, 18 bp, Artificial sequence
  synthetic polynucleotide sequence
gagactgggaaatgggca

SEQ ID NO: 5550 - DNA, 18 bp, Artificial sequence
  synthetic polynucleotide sequence
ccactgcatagagctgga

SEQ ID NO: 5551 - DNA, 18 bp, Artificial sequence
  synthetic polynucleotide sequence
gggaccagtgggaacgca

SEQ ID NO: 5552 - DNA, 18 bp, Artificial sequence
  synthetic polynucleotide sequence
tgccggaccagatccaga

SEQ ID NO: 5553 - DNA, 18 bp, Artificial sequence
  synthetic polynucleotide sequence
agaaggagggctgcacca

SEQ ID NO: 5554 - DNA, 18 bp, Artificial sequence
  synthetic polynucleotide sequence
agcacacgccgctcagca

SEQ ID NO: 5555 - DNA, 18 bp, Artificial sequence
  synthetic polynucleotide sequence
gaaggagccccagtggca

SEQ ID NO: 5556 - DNA, 18 bp, Artificial sequence
  synthetic polynucleotide sequence
caatcacgcacatgcaga

SEQ ID NO: 5557 - DNA, 18 bp, Artificial sequence
  synthetic polynucleotide sequence
tccccgcagtgaaaacca

SEQ ID NO: 5558 - DNA, 18 bp, Artificial sequence
  synthetic polynucleotide sequence
acgaacccggtgagggca

SEQ ID NO: 5559 - DNA, 18 bp, Artificial sequence
  synthetic polynucleotide sequence
ccgcagcgtcatcaagca

SEQ ID NO: 5560 - DNA, 18 bp, Artificial sequence
  synthetic polynucleotide sequence
cgtacaggtagcaggcca

SEQ ID NO: 5561 - DNA, 18 bp, Artificial sequence
  synthetic polynucleotide sequence
gcacaggagctacagcaa

SEQ ID NO: 5562 - DNA, 18 bp, Artificial sequence
  synthetic polynucleotide sequence
ggcgaggcaggttcacca

SEQ ID NO: 5563 - DNA, 18 bp, Artificial sequence
  synthetic polynucleotide sequence
catgaagtggggccacga

SEQ ID NO: 5564 - DNA, 18 bp, Artificial sequence
  synthetic polynucleotide sequence
agacgaacagaggcgcca

SEQ ID NO: 5565 - DNA, 18 bp, Artificial sequence
  synthetic polynucleotide sequence
gctacgtgggcaaccaga

SEQ ID NO: 5566 - DNA, 18 bp, Artificial sequence
  synthetic polynucleotide sequence
gcttgatgaccgagcgga

SEQ ID NO: 5567 - DNA, 18 bp, Artificial sequence
  synthetic polynucleotide sequence
cgggccacagagcagcca

SEQ ID NO: 5568 - DNA, 17 bp, Artificial sequence
  synthetic polynucleotide sequence
ggagctccacacccaga

SEQ ID NO: 5569 - DNA, 18 bp, Artificial sequence
  synthetic polynucleotide sequence
cgcacggctactcacaga

SEQ ID NO: 5570 - DNA, 18 bp, Artificial sequence
  synthetic polynucleotide sequence
ctccagcaccagtgacga

SEQ ID NO: 5571 - DNA, 18 bp, Artificial sequence
  synthetic polynucleotide sequence
cgtgaggctggtgagcaa

SEQ ID NO: 5572 - DNA, 18 bp, Artificial sequence
  synthetic polynucleotide sequence
taatgcgcaactccacca

SEQ ID NO: 5573 - DNA, 18 bp, Artificial sequence
  synthetic polynucleotide sequence
cagggatattaggcgcaa

SEQ ID NO: 5574 - DNA, 18 bp, Artificial sequence
  synthetic polynucleotide sequence
atgccaccccttggagga

SEQ ID NO: 5575 - DNA, 18 bp, Artificial sequence
  synthetic polynucleotide sequence
acccccatcccaagtcga

SEQ ID NO: 5576 - DNA, 18 bp, Artificial sequence
  synthetic polynucleotide sequence
ggggatgacactgacgga

SEQ ID NO: 5577 - DNA, 18 bp, Artificial sequence
  synthetic polynucleotide sequence
accccgactggatccaca

SEQ ID NO: 5578 - DNA, 18 bp, Artificial sequence
  synthetic polynucleotide sequence
aggcacagagcaaccgga

SEQ ID NO: 5579 - DNA, 18 bp, Artificial sequence
  synthetic polynucleotide sequence
ccatctggaaccgggaca

SEQ ID NO: 5580 - DNA, 18 bp, Artificial sequence
  synthetic polynucleotide sequence
ctccatggccaccagaca

SEQ ID NO: 5581 - DNA, 18 bp, Artificial sequence
  synthetic polynucleotide sequence
ctggaagtgctggagcga

SEQ ID NO: 5582 - DNA, 18 bp, Artificial sequence
  synthetic polynucleotide sequence
cagggacaccgttggaga

SEQ ID NO: 5583 - DNA, 18 bp, Artificial sequence
  synthetic polynucleotide sequence
gccctatgatcaagccca

SEQ ID NO: 5584 - DNA, 18 bp, Artificial sequence
  synthetic polynucleotide sequence
acactgctgcctgagcca

SEQ ID NO: 5585 - DNA, 18 bp, Artificial sequence
  synthetic polynucleotide sequence
ccatctccacccagagca

SEQ ID NO: 5586 - DNA, 18 bp, Artificial sequence
  synthetic polynucleotide sequence
gctggaagtccagggcca

SEQ ID NO: 5587 - DNA, 18 bp, Artificial sequence
  synthetic polynucleotide sequence
cggacagggtccccgtga

SEQ ID NO: 5588 - DNA, 18 bp, Artificial sequence
  synthetic polynucleotide sequence
gccaacagtaaggtcaga

SEQ ID NO: 5589 - DNA, 18 bp, Artificial sequence
  synthetic polynucleotide sequence
ccgacagggttccggtga

SEQ ID NO: 5590 - DNA, 18 bp, Artificial sequence
  synthetic polynucleotide sequence
tccacatgaactgagcca

SEQ ID NO: 5591 - DNA, 17 bp, Artificial sequence
  synthetic polynucleotide sequence
gaatagccgcagggaca

SEQ ID NO: 5592 - DNA, 15 bp, Artificial sequence
  synthetic polynucleotide sequence
cagcctcagccacca

SEQ ID NO: 5593 - DNA, 18 bp, Artificial sequence
  synthetic polynucleotide sequence
ccgcactcaacgacagca

SEQ ID NO: 5594 - DNA, 18 bp, Artificial sequence
  synthetic polynucleotide sequence
cggcacgaataccaggca

SEQ ID NO: 5595 - DNA, 18 bp, Artificial sequence
  synthetic polynucleotide sequence
cctgcggatcacagagga

SEQ ID NO: 5596 - DNA, 18 bp, Artificial sequence
  synthetic polynucleotide sequence
agtgggcaagcatgggca

SEQ ID NO: 5597 - DNA, 21 bp, Artificial sequence
  synthetic polynucleotide sequence
gccaatcaatcggaaaggaga

SEQ ID NO: 5598 - DNA, 19 bp, Artificial sequence
  synthetic polynucleotide sequence
cagttcttgcaggcacaga

SEQ ID NO: 5599 - DNA, 18 bp, Artificial sequence
  synthetic polynucleotide sequence
cagcccgactgagaccaa

SEQ ID NO: 5600 - DNA, 18 bp, Artificial sequence
  synthetic polynucleotide sequence
gtggcccaatagaccaga

SEQ ID NO: 5601 - DNA, 18 bp, Artificial sequence
  synthetic polynucleotide sequence
ccatgaccacactaagca

SEQ ID NO: 5602 - DNA, 18 bp, Artificial sequence
  synthetic polynucleotide sequence
tgcactggagcagcggga

SEQ ID NO: 5603 - DNA, 18 bp, Artificial sequence
  synthetic polynucleotide sequence
ccaaagtggcctacgcca

SEQ ID NO: 5604 - DNA, 18 bp, Artificial sequence
  synthetic polynucleotide sequence
actctatcagcgccgaga

SEQ ID NO: 5605 - DNA, 18 bp, Artificial sequence
  synthetic polynucleotide sequence
aggagtccgtcccagcaa

SEQ ID NO: 5606 - DNA, 18 bp, Artificial sequence
  synthetic polynucleotide sequence
tgacagctgcgaactcga

SEQ ID NO: 5607 - DNA, 18 bp, Artificial sequence
  synthetic polynucleotide sequence
accgcaagcccctgagca

SEQ ID NO: 5608 - DNA, 18 bp, Artificial sequence
  synthetic polynucleotide sequence
gggaggcacgcctgcgga

SEQ ID NO: 5609 - DNA, 18 bp, Artificial sequence
  synthetic polynucleotide sequence
cgatggacccccatgaga

SEQ ID NO: 5610 - DNA, 18 bp, Artificial sequence
  synthetic polynucleotide sequence
agtcccatcacagcctca

SEQ ID NO: 5611 - DNA, 18 bp, Artificial sequence
  synthetic polynucleotide sequence
tcgggagaccttgcccaa

SEQ ID NO: 5612 - DNA, 18 bp, Artificial sequence
  synthetic polynucleotide sequence
actccagaagggccagga

SEQ ID NO: 5613 - DNA, 18 bp, Artificial sequence
  synthetic polynucleotide sequence
tggacgtgaggaacgcca

SEQ ID NO: 5614 - DNA, 18 bp, Artificial sequence
  synthetic polynucleotide sequence
tgtctccacccccaccga

SEQ ID NO: 5615 - DNA, 18 bp, Artificial sequence
  synthetic polynucleotide sequence
cccggacctctctaggga

SEQ ID NO: 5616 - DNA, 18 bp, Artificial sequence
  synthetic polynucleotide sequence
actccaacagagcgcaga

SEQ ID NO: 5617 - DNA, 18 bp, Artificial sequence
  synthetic polynucleotide sequence
cttggagggaaggaagga

SEQ ID NO: 5618 - DNA, 19 bp, Artificial sequence
  synthetic polynucleotide sequence
aaccaagttgaacagggca

SEQ ID NO: 5619 - DNA, 18 bp, Artificial sequence
  synthetic polynucleotide sequence
gtgtctggacggcaagga

SEQ ID NO: 5620 - DNA, 18 bp, Artificial sequence
  synthetic polynucleotide sequence
ggcagaaggcagtgggga

SEQ ID NO: 5621 - DNA, 18 bp, Artificial sequence
  synthetic polynucleotide sequence
acgccagcaagaacagca

SEQ ID NO: 5622 - DNA, 18 bp, Artificial sequence
  synthetic polynucleotide sequence
cgtaggacacgcgtggca

SEQ ID NO: 5623 - DNA, 18 bp, Artificial sequence
  synthetic polynucleotide sequence
acagcgctggatggacca

SEQ ID NO: 5624 - DNA, 18 bp, Artificial sequence
  synthetic polynucleotide sequence
gcatacaggaccgtgcca

SEQ ID NO: 5625 - DNA, 18 bp, Artificial sequence
  synthetic polynucleotide sequence
tcggaaagcctcagccca

SEQ ID NO: 5626 - DNA, 18 bp, Artificial sequence
  synthetic polynucleotide sequence
tctgaggtggaggggaga

SEQ ID NO: 5627 - DNA, 18 bp, Artificial sequence
  synthetic polynucleotide sequence
tcacaacggtgctgacca

SEQ ID NO: 5628 - DNA, 18 bp, Artificial sequence
  synthetic polynucleotide sequence
aggtagttgacggccgca

SEQ ID NO: 5629 - DNA, 18 bp, Artificial sequence
  synthetic polynucleotide sequence
tgggtaccccagaagcca

SEQ ID NO: 5630 - DNA, 18 bp, Artificial sequence
  synthetic polynucleotide sequence
cttcaccactcaggccca

SEQ ID NO: 5631 - DNA, 18 bp, Artificial sequence
  synthetic polynucleotide sequence
tcaccacagtgctgacca

SEQ ID NO: 5632 - DNA, 18 bp, Artificial sequence
  synthetic polynucleotide sequence
agagggagctgacccaca

SEQ ID NO: 5633 - DNA, 18 bp, Artificial sequence
  synthetic polynucleotide sequence
gctctctgaccaccccga

SEQ ID NO: 5634 - DNA, 18 bp, Artificial sequence
  synthetic polynucleotide sequence
tgacctgtgcgaacccca

SEQ ID NO: 5635 - DNA, 18 bp, Artificial sequence
  synthetic polynucleotide sequence
gtgccacagctggaacca

SEQ ID NO: 5636 - DNA, 18 bp, Artificial sequence
  synthetic polynucleotide sequence
ggagagcagagcactgca

SEQ ID NO: 5637 - DNA, 18 bp, Artificial sequence
  synthetic polynucleotide sequence
ggtgtacgaagcggccaa

SEQ ID NO: 5638 - DNA, 18 bp, Artificial sequence
  synthetic polynucleotide sequence
acgcctggatcagggtga

SEQ ID NO: 5639 - DNA, 18 bp, Artificial sequence
  synthetic polynucleotide sequence
tgaatgtggacccagaca

SEQ ID NO: 5640 - DNA, 18 bp, Artificial sequence
  synthetic polynucleotide sequence
gcatgcccgacacccgca

SEQ ID NO: 5641 - DNA, 18 bp, Artificial sequence
  synthetic polynucleotide sequence
gcgagaacgacatcgaca

SEQ ID NO: 5642 - DNA, 18 bp, Artificial sequence
  synthetic polynucleotide sequence
caaggcgggatccttcca

SEQ ID NO: 5643 - DNA, 18 bp, Artificial sequence
  synthetic polynucleotide sequence
agcaactcaacgtcagga

SEQ ID NO: 5644 - DNA, 18 bp, Artificial sequence
  synthetic polynucleotide sequence
cggcccttgacctgcaga

SEQ ID NO: 5645 - DNA, 18 bp, Artificial sequence
  synthetic polynucleotide sequence
cctcaccagcaagcggga

SEQ ID NO: 5646 - DNA, 18 bp, Artificial sequence
  synthetic polynucleotide sequence
aggaggcggtcgagggca

SEQ ID NO: 5647 - DNA, 18 bp, Artificial sequence
  synthetic polynucleotide sequence
ccatccaggacgaggcca

SEQ ID NO: 5648 - DNA, 18 bp, Artificial sequence
  synthetic polynucleotide sequence
ggatctcgggcgtgagca

SEQ ID NO: 5649 - DNA, 18 bp, Artificial sequence
  synthetic polynucleotide sequence
ccacacgcagatcagaga

SEQ ID NO: 5650 - DNA, 18 bp, Artificial sequence
  synthetic polynucleotide sequence
gccggaggttgtaaccca

SEQ ID NO: 5651 - DNA, 18 bp, Artificial sequence
  synthetic polynucleotide sequence
ccagccgcaaggtggaca

SEQ ID NO: 5652 - DNA, 18 bp, Artificial sequence
  synthetic polynucleotide sequence
agtactggacctcgggca

SEQ ID NO: 5653 - DNA, 18 bp, Artificial sequence
  synthetic polynucleotide sequence
ataagcagggcctcagca

SEQ ID NO: 5654 - DNA, 18 bp, Artificial sequence
  synthetic polynucleotide sequence
gtggacatagagagccca

SEQ ID NO: 5655 - DNA, 18 bp, Artificial sequence
  synthetic polynucleotide sequence
tgagccctcccacatgca

SEQ ID NO: 5656 - DNA, 18 bp, Artificial sequence
  synthetic polynucleotide sequence
cgcccacaatccaggtca

SEQ ID NO: 5657 - DNA, 18 bp, Artificial sequence
  synthetic polynucleotide sequence
tggcacaggtgtccggga

SEQ ID NO: 5658 - DNA, 18 bp, Artificial sequence
  synthetic polynucleotide sequence
gtagatccggcagccaca

SEQ ID NO: 5659 - DNA, 18 bp, Artificial sequence
  synthetic polynucleotide sequence
ctgcccagagctggacca

SEQ ID NO: 5660 - DNA, 18 bp, Artificial sequence
  synthetic polynucleotide sequence
agtgtcaccgtgcagcca

SEQ ID NO: 5661 - DNA, 18 bp, Artificial sequence
  synthetic polynucleotide sequence
tacagcgaggctgcgcga

SEQ ID NO: 5662 - DNA, 18 bp, Artificial sequence
  synthetic polynucleotide sequence
ctgatccagctcggggca

SEQ ID NO: 5663 - DNA, 18 bp, Artificial sequence
  synthetic polynucleotide sequence
ggagggtggccaaccgaa

SEQ ID NO: 5664 - DNA, 18 bp, Artificial sequence
  synthetic polynucleotide sequence
ggacgccatttgacagca

SEQ ID NO: 5665 - DNA, 18 bp, Artificial sequence
  synthetic polynucleotide sequence
gcacgtcactgcaggcca

SEQ ID NO: 5666 - DNA, 18 bp, Artificial sequence
  synthetic polynucleotide sequence
gggaggaggttgaggcca

SEQ ID NO: 5667 - DNA, 18 bp, Artificial sequence
  synthetic polynucleotide sequence
atcgctcaccaagacaca

SEQ ID NO: 5668 - DNA, 18 bp, Artificial sequence
  synthetic polynucleotide sequence
tggccaagagaggctcca

SEQ ID NO: 5669 - DNA, 18 bp, Artificial sequence
  synthetic polynucleotide sequence
cttaagcgggtggccgaa

SEQ ID NO: 5670 - DNA, 18 bp, Artificial sequence
  synthetic polynucleotide sequence
agttaagggagctgcgga

SEQ ID NO: 5671 - DNA, 18 bp, Artificial sequence
  synthetic polynucleotide sequence
gggatgtgacagagagga

SEQ ID NO: 5672 - DNA, 18 bp, Artificial sequence
  synthetic polynucleotide sequence
agcatcccgaagaagcca

SEQ ID NO: 5673 - DNA, 18 bp, Artificial sequence
  synthetic polynucleotide sequence
aggaggaaaggagacaga

SEQ ID NO: 5674 - DNA, 18 bp, Artificial sequence
  synthetic polynucleotide sequence
atgaccaacatgggagca

SEQ ID NO: 5675 - DNA, 18 bp, Artificial sequence
  synthetic polynucleotide sequence
ctgacatcgcccagggca

SEQ ID NO: 5676 - DNA, 18 bp, Artificial sequence
  synthetic polynucleotide sequence
cctctgagctccgaggca

SEQ ID NO: 5677 - DNA, 18 bp, Artificial sequence
  synthetic polynucleotide sequence
aaagggtggcggaggaca

SEQ ID NO: 5678 - DNA, 18 bp, Artificial sequence
  synthetic polynucleotide sequence
ccgcccttcaagtcagca

SEQ ID NO: 5679 - DNA, 18 bp, Artificial sequence
  synthetic polynucleotide sequence
tggacttgggggaaacca

SEQ ID NO: 5680 - DNA, 18 bp, Artificial sequence
  synthetic polynucleotide sequence
gccttcagctgaacgaga

SEQ ID NO: 5681 - DNA, 18 bp, Artificial sequence
  synthetic polynucleotide sequence
ggcaacctcacccagcaa

SEQ ID NO: 5682 - DNA, 18 bp, Artificial sequence
  synthetic polynucleotide sequence
ggagcccttaagtcagga

SEQ ID NO: 5683 - DNA, 18 bp, Artificial sequence
  synthetic polynucleotide sequence
cgactgcagctgagggaa

SEQ ID NO: 5684 - DNA, 18 bp, Artificial sequence
  synthetic polynucleotide sequence
ctcacccacatccaggca

SEQ ID NO: 5685 - DNA, 18 bp, Artificial sequence
  synthetic polynucleotide sequence
ttccaggcaacaccccca

SEQ ID NO: 5686 - DNA, 18 bp, Artificial sequence
  synthetic polynucleotide sequence
gccagggtctgtcaggca

SEQ ID NO: 5687 - DNA, 18 bp, Artificial sequence
  synthetic polynucleotide sequence
aggggctgattcgagcaa

SEQ ID NO: 5688 - DNA, 18 bp, Artificial sequence
  synthetic polynucleotide sequence
tggcaatggcatgcagca

SEQ ID NO: 5689 - DNA, 18 bp, Artificial sequence
  synthetic polynucleotide sequence
ggagccttcgactgggaa

SEQ ID NO: 5690 - DNA, 18 bp, Artificial sequence
  synthetic polynucleotide sequence
cctccagccataacagga

SEQ ID NO: 5691 - DNA, 18 bp, Artificial sequence
  synthetic polynucleotide sequence
acagccctccaagaggaa

SEQ ID NO: 5692 - DNA, 18 bp, Artificial sequence
  synthetic polynucleotide sequence
atgctgagcatgcccaga

SEQ ID NO: 5693 - DNA, 18 bp, Artificial sequence
  synthetic polynucleotide sequence
ccaccagggcctcttcca

SEQ ID NO: 5694 - DNA, 18 bp, Artificial sequence
  synthetic polynucleotide sequence
gcaggtagccgaagacga

SEQ ID NO: 5695 - DNA, 18 bp, Artificial sequence
  synthetic polynucleotide sequence
ctgtacgacacgtaccca

SEQ ID NO: 5696 - DNA, 18 bp, Artificial sequence
  synthetic polynucleotide sequence
ccaggaggtgaggttgca

SEQ ID NO: 5697 - DNA, 18 bp, Artificial sequence
  synthetic polynucleotide sequence
tctgcctggccaagggga

SEQ ID NO: 5698 - DNA, 18 bp, Artificial sequence
  synthetic polynucleotide sequence
ctcgcatccatcgaggca

SEQ ID NO: 5699 - DNA, 18 bp, Artificial sequence
  synthetic polynucleotide sequence
gctgccacagagcaggca

SEQ ID NO: 5700 - DNA, 18 bp, Artificial sequence
  synthetic polynucleotide sequence
agccttggaggacggcga

SEQ ID NO: 5701 - DNA, 18 bp, Artificial sequence
  synthetic polynucleotide sequence
aagacagtggacgggcca

SEQ ID NO: 5702 - DNA, 18 bp, Artificial sequence
  synthetic polynucleotide sequence
atggctgagtagggggca

SEQ ID NO: 5703 - DNA, 18 bp, Artificial sequence
  synthetic polynucleotide sequence
cccagactctgcaagcca

SEQ ID NO: 5704 - DNA, 18 bp, Artificial sequence
  synthetic polynucleotide sequence
gtcagcactgggaaggca

SEQ ID NO: 5705 - DNA, 19 bp, Artificial sequence
  synthetic polynucleotide sequence
ctgagggaccgtgactcaa

SEQ ID NO: 5706 - DNA, 18 bp, Artificial sequence
  synthetic polynucleotide sequence
gaggatacctggcctcca

SEQ ID NO: 5707 - DNA, 18 bp, Artificial sequence
  synthetic polynucleotide sequence
agacctggaggatcccca

SEQ ID NO: 5708 - DNA, 18 bp, Artificial sequence
  synthetic polynucleotide sequence
accacaaggacagcgcca

SEQ ID NO: 5709 - DNA, 18 bp, Artificial sequence
  synthetic polynucleotide sequence
gcaccgtcattgaggaca

SEQ ID NO: 5710 - DNA, 18 bp, Artificial sequence
  synthetic polynucleotide sequence
ccttgaccgactcgcaga

SEQ ID NO: 5711 - DNA, 18 bp, Artificial sequence
  synthetic polynucleotide sequence
tcggccgtgtcaccagca

SEQ ID NO: 5712 - DNA, 18 bp, Artificial sequence
  synthetic polynucleotide sequence
cagctcctcatgcagcca

SEQ ID NO: 5713 - DNA, 18 bp, Artificial sequence
  synthetic polynucleotide sequence
aagagcctggcggacgaa

SEQ ID NO: 5714 - DNA, 18 bp, Artificial sequence
  synthetic polynucleotide sequence
aggcatagcggctggcga

SEQ ID NO: 5715 - DNA, 18 bp, Artificial sequence
  synthetic polynucleotide sequence
ctggagcagcagggccca

SEQ ID NO: 5716 - DNA, 18 bp, Artificial sequence
  synthetic polynucleotide sequence
gccacgaggtgtggggga

SEQ ID NO: 5717 - DNA, 18 bp, Artificial sequence
  synthetic polynucleotide sequence
ctgggaggcacaggagca

SEQ ID NO: 5718 - DNA, 18 bp, Artificial sequence
  synthetic polynucleotide sequence
ccagtaggggtccaggga

SEQ ID NO: 5719 - DNA, 18 bp, Artificial sequence
  synthetic polynucleotide sequence
ggcggagtgcttcgagga

SEQ ID NO: 5720 - DNA, 18 bp, Artificial sequence
  synthetic polynucleotide sequence
tgggcgtcggagtgggca

SEQ ID NO: 5721 - DNA, 18 bp, Artificial sequence
  synthetic polynucleotide sequence
cactggaggacttcccca

SEQ ID NO: 5722 - DNA, 18 bp, Artificial sequence
  synthetic polynucleotide sequence
agtggctgaagggcgaga

SEQ ID NO: 5723 - DNA, 18 bp, Artificial sequence
  synthetic polynucleotide sequence
agagcaccaatcccgaga

SEQ ID NO: 5724 - DNA, 18 bp, Artificial sequence
  synthetic polynucleotide sequence
ggaatccggtcgcacgga

SEQ ID NO: 5725 - DNA, 18 bp, Artificial sequence
  synthetic polynucleotide sequence
ctcacaggctgcagccaa

SEQ ID NO: 5726 - DNA, 18 bp, Artificial sequence
  synthetic polynucleotide sequence
tgtgcggcactgggcaca

SEQ ID NO: 5727 - DNA, 18 bp, Artificial sequence
  synthetic polynucleotide sequence
gcctgttccccaacacca

SEQ ID NO: 5728 - DNA, 18 bp, Artificial sequence
  synthetic polynucleotide sequence
tccagtcggtccagccga

SEQ ID NO: 5729 - DNA, 18 bp, Artificial sequence
  synthetic polynucleotide sequence
gctatcccgagtcagcca

SEQ ID NO: 5730 - DNA, 18 bp, Artificial sequence
  synthetic polynucleotide sequence
agccgatgcactccagca

SEQ ID NO: 5731 - DNA, 18 bp, Artificial sequence
  synthetic polynucleotide sequence
ggagaccatcagccagca

SEQ ID NO: 5732 - DNA, 18 bp, Artificial sequence
  synthetic polynucleotide sequence
gcctgcgctcatagggga

SEQ ID NO: 5733 - DNA, 18 bp, Artificial sequence
  synthetic polynucleotide sequence
ccaagaagccaggccaca

SEQ ID NO: 5734 - DNA, 18 bp, Artificial sequence
  synthetic polynucleotide sequence
ggaggacggccagggcga

SEQ ID NO: 5735 - DNA, 18 bp, Artificial sequence
  synthetic polynucleotide sequence
gggaaccatcaaccagca

SEQ ID NO: 5736 - DNA, 18 bp, Artificial sequence
  synthetic polynucleotide sequence
cggatgcacaaccgagga

SEQ ID NO: 5737 - DNA, 18 bp, Artificial sequence
  synthetic polynucleotide sequence
ccccacctctctaagcca

SEQ ID NO: 5738 - DNA, 18 bp, Artificial sequence
  synthetic polynucleotide sequence
tgcttagaagcacagcca

SEQ ID NO: 5739 - DNA, 19 bp, Artificial sequence
  synthetic polynucleotide sequence
tgagagggaggccattgaa

SEQ ID NO: 5740 - DNA, 19 bp, Artificial sequence
  synthetic polynucleotide sequence
aagccgagcaataatccga

SEQ ID NO: 5741 - DNA, 18 bp, Artificial sequence
  synthetic polynucleotide sequence
cccatccaagccaaacca

SEQ ID NO: 5742 - DNA, 18 bp, Artificial sequence
  synthetic polynucleotide sequence
aggtgctgcacaggagca

SEQ ID NO: 5743 - DNA, 18 bp, Artificial sequence
  synthetic polynucleotide sequence
gagctgcctgaacacaca

SEQ ID NO: 5744 - DNA, 18 bp, Artificial sequence
  synthetic polynucleotide sequence
catctggaagctcgggga

SEQ ID NO: 5745 - DNA, 18 bp, Artificial sequence
  synthetic polynucleotide sequence
ggccagcatattcagaca

SEQ ID NO: 5746 - DNA, 18 bp, Artificial sequence
  synthetic polynucleotide sequence
caccatcctgtccagcaa

SEQ ID NO: 5747 - DNA, 18 bp, Artificial sequence
  synthetic polynucleotide sequence
acagcggaagtgacccca

SEQ ID NO: 5748 - DNA, 18 bp, Artificial sequence
  synthetic polynucleotide sequence
atcttcacaccgagccca

SEQ ID NO: 5749 - DNA, 18 bp, Artificial sequence
  synthetic polynucleotide sequence
tggtgaaaggccgaggaa

SEQ ID NO: 5750 - DNA, 18 bp, Artificial sequence
  synthetic polynucleotide sequence
cagcatgtctgcggccaa

SEQ ID NO: 5751 - DNA, 18 bp, Artificial sequence
  synthetic polynucleotide sequence
gcggaacaccagcaacca

SEQ ID NO: 5752 - DNA, 18 bp, Artificial sequence
  synthetic polynucleotide sequence
gccaatctagggaggcca

SEQ ID NO: 5753 - DNA, 18 bp, Artificial sequence
  synthetic polynucleotide sequence
tcagcaaacttgcgagga

SEQ ID NO: 5754 - DNA, 18 bp, Artificial sequence
  synthetic polynucleotide sequence
accactaccccgactcca

SEQ ID NO: 5755 - DNA, 18 bp, Artificial sequence
  synthetic polynucleotide sequence
tcaaccgcatgcgcgaga

SEQ ID NO: 5756 - DNA, 18 bp, Artificial sequence
  synthetic polynucleotide sequence
agcttgtacacggagcca

SEQ ID NO: 5757 - DNA, 18 bp, Artificial sequence
  synthetic polynucleotide sequence
acctcacggaggtgcaga

SEQ ID NO: 5758 - DNA, 18 bp, Artificial sequence
  synthetic polynucleotide sequence
tcagcaaggtctgaccca

SEQ ID NO: 5759 - DNA, 18 bp, Artificial sequence
  synthetic polynucleotide sequence
gagcgaggactggagcca

SEQ ID NO: 5760 - DNA, 18 bp, Artificial sequence
  synthetic polynucleotide sequence
gagcaacatgctgggcca

SEQ ID NO: 5761 - DNA, 18 bp, Artificial sequence
  synthetic polynucleotide sequence
gggcacaggtaaaaccaa

SEQ ID NO: 5762 - DNA, 18 bp, Artificial sequence
  synthetic polynucleotide sequence
gcagtagccacagcggca

SEQ ID NO: 5763 - DNA, 18 bp, Artificial sequence
  synthetic polynucleotide sequence
ccagtcaaagggagagca

SEQ ID NO: 5764 - DNA, 18 bp, Artificial sequence
  synthetic polynucleotide sequence
caggctcaatgagacgga

SEQ ID NO: 5765 - DNA, 18 bp, Artificial sequence
  synthetic polynucleotide sequence
gggccaccatccaaagga

SEQ ID NO: 5766 - DNA, 18 bp, Artificial sequence
  synthetic polynucleotide sequence
atgcacactgagcgcaca

SEQ ID NO: 5767 - DNA, 18 bp, Artificial sequence
  synthetic polynucleotide sequence
accacgctgttggacgga

SEQ ID NO: 5768 - DNA, 18 bp, Artificial sequence
  synthetic polynucleotide sequence
tggaggacgaagttagca

SEQ ID NO: 5769 - DNA, 18 bp, Artificial sequence
  synthetic polynucleotide sequence
cgacagctcacccaggaa

SEQ ID NO: 5770 - DNA, 18 bp, Artificial sequence
  synthetic polynucleotide sequence
caggccaatggaatctga

SEQ ID NO: 5771 - DNA, 18 bp, Artificial sequence
  synthetic polynucleotide sequence
aggagcatccatcgcaca

SEQ ID NO: 5772 - DNA, 18 bp, Artificial sequence
  synthetic polynucleotide sequence
cagccacgtctgtaccca

SEQ ID NO: 5773 - DNA, 18 bp, Artificial sequence
  synthetic polynucleotide sequence
caggcgtggagttggaca

SEQ ID NO: 5774 - DNA, 18 bp, Artificial sequence
  synthetic polynucleotide sequence
cacaatcgcccagtccca

SEQ ID NO: 5775 - DNA, 18 bp, Artificial sequence
  synthetic polynucleotide sequence
cgccgcttgggctcgcaa

SEQ ID NO: 5776 - DNA, 18 bp, Artificial sequence
  synthetic polynucleotide sequence
gcgggtcgagggtcacca

SEQ ID NO: 5777 - DNA, 18 bp, Artificial sequence
  synthetic polynucleotide sequence
caggaagaagggccagga

SEQ ID NO: 5778 - DNA, 18 bp, Artificial sequence
  synthetic polynucleotide sequence
ggttggatggacgaacga

SEQ ID NO: 5779 - DNA, 18 bp, Artificial sequence
  synthetic polynucleotide sequence
cccaccaagatgtcccca

SEQ ID NO: 5780 - DNA, 18 bp, Artificial sequence
  synthetic polynucleotide sequence
agccacagcgatccacca

SEQ ID NO: 5781 - DNA, 18 bp, Artificial sequence
  synthetic polynucleotide sequence
ccgtcgcagtcggaccaa

SEQ ID NO: 5782 - DNA, 18 bp, Artificial sequence
  synthetic polynucleotide sequence
gcccaggtcttccagcga

SEQ ID NO: 5783 - DNA, 18 bp, Artificial sequence
  synthetic polynucleotide sequence
caaggacggctccacaga

SEQ ID NO: 5784 - DNA, 18 bp, Artificial sequence
  synthetic polynucleotide sequence
catcgtcagccaagggga

SEQ ID NO: 5785 - DNA, 18 bp, Artificial sequence
  synthetic polynucleotide sequence
agccatccctgtccccaa

SEQ ID NO: 5786 - DNA, 18 bp, Artificial sequence
  synthetic polynucleotide sequence
ggtcagtgagaagggaca

SEQ ID NO: 5787 - DNA, 18 bp, Artificial sequence
  synthetic polynucleotide sequence
ggctgagtcccatcagca

SEQ ID NO: 5788 - DNA, 18 bp, Artificial sequence
  synthetic polynucleotide sequence
agccacacgactccacga

SEQ ID NO: 5789 - DNA, 18 bp, Artificial sequence
  synthetic polynucleotide sequence
tcgccatggcaagcggca

SEQ ID NO: 5790 - DNA, 18 bp, Artificial sequence
  synthetic polynucleotide sequence
gtcgcatacaccctcgca

SEQ ID NO: 5791 - DNA, 18 bp, Artificial sequence
  synthetic polynucleotide sequence
agcccaccaaccatgcca

SEQ ID NO: 5792 - DNA, 18 bp, Artificial sequence
  synthetic polynucleotide sequence
gcgcgctggcacacagca

SEQ ID NO: 5793 - DNA, 18 bp, Artificial sequence
  synthetic polynucleotide sequence
gtcagctgaagtgggaca

SEQ ID NO: 5794 - DNA, 18 bp, Artificial sequence
  synthetic polynucleotide sequence
actggagagccataccga

SEQ ID NO: 5795 - DNA, 18 bp, Artificial sequence
  synthetic polynucleotide sequence
gagaggccagaggggcaa

SEQ ID NO: 5796 - DNA, 18 bp, Artificial sequence
  synthetic polynucleotide sequence
atcgcaagagccgctgca

SEQ ID NO: 5797 - DNA, 18 bp, Artificial sequence
  synthetic polynucleotide sequence
gcgagcttcgagaaggca

SEQ ID NO: 5798 - DNA, 18 bp, Artificial sequence
  synthetic polynucleotide sequence
gtgctggacagctgcaga

SEQ ID NO: 5799 - DNA, 18 bp, Artificial sequence
  synthetic polynucleotide sequence
ccgtgaaaccccaaggga

SEQ ID NO: 5800 - DNA, 18 bp, Artificial sequence
  synthetic polynucleotide sequence
ggtccaagagctggcaca

SEQ ID NO: 5801 - DNA, 18 bp, Artificial sequence
  synthetic polynucleotide sequence
ccaaagggagtccctgga

SEQ ID NO: 5802 - DNA, 18 bp, Artificial sequence
  synthetic polynucleotide sequence
aggtgaacctggatggga

SEQ ID NO: 5803 - DNA, 5 bp, Artificial sequence
  synthetic polynucleotide sequence
wdrmr

SEQ ID NO: 5804 - DNA, 5 bp, Artificial sequence
  synthetic polynucleotide sequence
rvrmr

SEQ ID NO: 5805 - DNA, 18 bp, Artificial sequence
  synthetic polynucleotide sequence
tgagcctggagcagcaca

SEQ ID NO: 5806 - DNA, 18 bp, Artificial sequence
  synthetic polynucleotide sequence
tgacaggggtagggccga

SEQ ID NO: 5807 - DNA, 18 bp, Artificial sequence
  synthetic polynucleotide sequence
cacgggctgctcaagaca

SEQ ID NO: 5808 - DNA, 18 bp, Artificial sequence
  synthetic polynucleotide sequence
ctgcagagcctaccacca

SEQ ID NO: 5809 - DNA, 18 bp, Artificial sequence
  synthetic polynucleotide sequence
ccggtggaagaaaaagca

SEQ ID NO: 5810 - DNA, 18 bp, Artificial sequence
  synthetic polynucleotide sequence
acagctcgtccggggtga

SEQ ID NO: 5811 - DNA, 18 bp, Artificial sequence
  synthetic polynucleotide sequence
cctggagctctacacgca

SEQ ID NO: 5812 - DNA, 18 bp, Artificial sequence
  synthetic polynucleotide sequence
gcttcagctccccagcca

SEQ ID NO: 5813 - DNA, 18 bp, Artificial sequence
  synthetic polynucleotide sequence
gcacagtcatgaccccca

SEQ ID NO: 5814 - DNA, 18 bp, Artificial sequence
  synthetic polynucleotide sequence
acggtcacatcggagcca

SEQ ID NO: 5815 - DNA, 18 bp, Artificial sequence
  synthetic polynucleotide sequence
cacgtctgtccaggagca

SEQ ID NO: 5816 - DNA, 18 bp, Artificial sequence
  synthetic polynucleotide sequence
gacagcacggtcaaggca

SEQ ID NO: 5817 - DNA, 18 bp, Artificial sequence
  synthetic polynucleotide sequence
aggtgtcctccacaggca

SEQ ID NO: 5818 - DNA, 18 bp, Artificial sequence
  synthetic polynucleotide sequence
gccgggagagccaggaca

SEQ ID NO: 5819 - DNA, 18 bp, Artificial sequence
  synthetic polynucleotide sequence
ccaccagccttctccaca

SEQ ID NO: 5820 - DNA, 18 bp, Artificial sequence
  synthetic polynucleotide sequence
ggaacacgatgttgcgga

SEQ ID NO: 5821 - DNA, 18 bp, Artificial sequence
  synthetic polynucleotide sequence
cacttctcccagacggga

SEQ ID NO: 5822 - DNA, 18 bp, Artificial sequence
  synthetic polynucleotide sequence
tcccagacaggctgggga

SEQ ID NO: 5823 - DNA, 18 bp, Artificial sequence
  synthetic polynucleotide sequence
tgagtgaagacctgggca

SEQ ID NO: 5824 - DNA, 18 bp, Artificial sequence
  synthetic polynucleotide sequence
ggtactcaccagcaggca

SEQ ID NO: 5825 - DNA, 18 bp, Artificial sequence
  synthetic polynucleotide sequence
tgacctcagacgctcaga

SEQ ID NO: 5826 - DNA, 18 bp, Artificial sequence
  synthetic polynucleotide sequence
cagtgaagttcagcggca

SEQ ID NO: 5827 - DNA, 18 bp, Artificial sequence
  synthetic polynucleotide sequence
ctgcccaacgtcacgaca

SEQ ID NO: 5828 - DNA, 18 bp, Artificial sequence
  synthetic polynucleotide sequence
tggcttgcaccacagcga

SEQ ID NO: 5829 - DNA, 18 bp, Artificial sequence
  synthetic polynucleotide sequence
gccagaaccagacccaga

SEQ ID NO: 5830 - DNA, 18 bp, Artificial sequence
  synthetic polynucleotide sequence
tccgagacggcgtacaca

SEQ ID NO: 5831 - DNA, 18 bp, Artificial sequence
  synthetic polynucleotide sequence
gggaggaaacacaacaga

SEQ ID NO: 5832 - DNA, 18 bp, Artificial sequence
  synthetic polynucleotide sequence
acaccaggctgttggcga

SEQ ID NO: 5833 - DNA, 18 bp, Artificial sequence
  synthetic polynucleotide sequence
actgcttcaggaaggaca

SEQ ID NO: 5834 - DNA, 18 bp, Artificial sequence
  synthetic polynucleotide sequence
gccctccacagagcggca

SEQ ID NO: 5835 - DNA, 18 bp, Artificial sequence
  synthetic polynucleotide sequence
gctgctcccagtcaagga

SEQ ID NO: 5836 - DNA, 18 bp, Artificial sequence
  synthetic polynucleotide sequence
caccaaccactcgcacca

SEQ ID NO: 5837 - DNA, 18 bp, Artificial sequence
  synthetic polynucleotide sequence
agagctgcatggtacaca

SEQ ID NO: 5838 - DNA, 18 bp, Artificial sequence
  synthetic polynucleotide sequence
agacgagacccaggccca

SEQ ID NO: 5839 - DNA, 18 bp, Artificial sequence
  synthetic polynucleotide sequence
gaggcctgggacaggaga

SEQ ID NO: 5840 - DNA, 18 bp, Artificial sequence
  synthetic polynucleotide sequence
tcaggcaagggcaaggca

SEQ ID NO: 5841 - DNA, 18 bp, Artificial sequence
  synthetic polynucleotide sequence
gtcgtcaggtagacagca

SEQ ID NO: 5842 - DNA, 18 bp, Artificial sequence
  synthetic polynucleotide sequence
gcttctgcagcagggcca

SEQ ID NO: 5843 - DNA, 18 bp, Artificial sequence
  synthetic polynucleotide sequence
tggagccagctcagggca

SEQ ID NO: 5844 - DNA, 18 bp, Artificial sequence
  synthetic polynucleotide sequence
agccctggaaggaaccca

SEQ ID NO: 5845 - DNA, 18 bp, Artificial sequence
  synthetic polynucleotide sequence
agccctgaacaccagaga

SEQ ID NO: 5846 - DNA, 18 bp, Artificial sequence
  synthetic polynucleotide sequence
ctagagctcggggctgca

SEQ ID NO: 5847 - DNA, 18 bp, Artificial sequence
  synthetic polynucleotide sequence
cccttgggacaccaacga

SEQ ID NO: 5848 - DNA, 18 bp, Artificial sequence
  synthetic polynucleotide sequence
tggtccctgagcgaggca

SEQ ID NO: 5849 - DNA, 18 bp, Artificial sequence
  synthetic polynucleotide sequence
caagaccctgctggccaa

SEQ ID NO: 5850 - DNA, 18 bp, Artificial sequence
  synthetic polynucleotide sequence
agagagcctgcatggcga

SEQ ID NO: 5851 - DNA, 18 bp, Artificial sequence
  synthetic polynucleotide sequence
gcacctgcagtaccagca

SEQ ID NO: 5852 - DNA, 18 bp, Artificial sequence
  synthetic polynucleotide sequence
gccagtatctggcacgga

SEQ ID NO: 5853 - DNA, 18 bp, Artificial sequence
  synthetic polynucleotide sequence
cgacacagaggtgcccaa

SEQ ID NO: 5854 - DNA, 18 bp, Artificial sequence
  synthetic polynucleotide sequence
cctcagtgtaacggccca

SEQ ID NO: 5855 - DNA, 18 bp, Artificial sequence
  synthetic polynucleotide sequence
gggctccttccacagcaa

SEQ ID NO: 5856 - DNA, 18 bp, Artificial sequence
  synthetic polynucleotide sequence
tggcaggccccagctcca

SEQ ID NO: 5857 - DNA, 18 bp, Artificial sequence
  synthetic polynucleotide sequence
cacggatgaggatcagca

SEQ ID NO: 5858 - DNA, 18 bp, Artificial sequence
  synthetic polynucleotide sequence
tcttccagggagccgcca

SEQ ID NO: 5859 - DNA, 18 bp, Artificial sequence
  synthetic polynucleotide sequence
gtcaggtggacgaagtga

SEQ ID NO: 5860 - DNA, 18 bp, Artificial sequence
  synthetic polynucleotide sequence
atccgaagcaagcggtca

SEQ ID NO: 5861 - DNA, 18 bp, Artificial sequence
  synthetic polynucleotide sequence
attcctcgccgagaagga

SEQ ID NO: 5862 - DNA, 18 bp, Artificial sequence
  synthetic polynucleotide sequence
ccatccactctggaggga

SEQ ID NO: 5863 - DNA, 18 bp, Artificial sequence
  synthetic polynucleotide sequence
actccccaagatctacca

SEQ ID NO: 5864 - DNA, 18 bp, Artificial sequence
  synthetic polynucleotide sequence
tgcaggagctgggagcca

SEQ ID NO: 5865 - DNA, 18 bp, Artificial sequence
  synthetic polynucleotide sequence
gcatccaccaaatggaga

SEQ ID NO: 5866 - DNA, 18 bp, Artificial sequence
  synthetic polynucleotide sequence
ggccaactcttccggcga

SEQ ID NO: 5867 - DNA, 18 bp, Artificial sequence
  synthetic polynucleotide sequence
agccaagaaccccagcga

SEQ ID NO: 5868 - DNA, 18 bp, Artificial sequence
  synthetic polynucleotide sequence
gatccagcaagcaggcca

SEQ ID NO: 5869 - DNA, 18 bp, Artificial sequence
  synthetic polynucleotide sequence
ggaacggtaccgcaggga

SEQ ID NO: 5870 - DNA, 18 bp, Artificial sequence
  synthetic polynucleotide sequence
cacactggcggaggacga

SEQ ID NO: 5871 - DNA, 18 bp, Artificial sequence
  synthetic polynucleotide sequence
acccttaccatgcgacca

SEQ ID NO: 5872 - DNA, 18 bp, Artificial sequence
  synthetic polynucleotide sequence
aggaggagacataggcga

SEQ ID NO: 5873 - DNA, 18 bp, Artificial sequence
  synthetic polynucleotide sequence
ggtggcagagaaggcaga

SEQ ID NO: 5874 - DNA, 18 bp, Artificial sequence
  synthetic polynucleotide sequence
acagggactcctgcggca

SEQ ID NO: 5875 - DNA, 18 bp, Artificial sequence
  synthetic polynucleotide sequence
ccagaaacacggggacca

SEQ ID NO: 5876 - DNA, 18 bp, Artificial sequence
  synthetic polynucleotide sequence
cgcggcatattgaagcca

SEQ ID NO: 5877 - DNA, 18 bp, Artificial sequence
  synthetic polynucleotide sequence
accaggacgagcaggaga

SEQ ID NO: 5878 - DNA, 18 bp, Artificial sequence
  synthetic polynucleotide sequence
gacgctgaagacggcgga

SEQ ID NO: 5879 - DNA, 18 bp, Artificial sequence
  synthetic polynucleotide sequence
atccgggcagatggagga

SEQ ID NO: 5880 - DNA, 18 bp, Artificial sequence
  synthetic polynucleotide sequence
aacccaacagcaaggcca

SEQ ID NO: 5881 - DNA, 18 bp, Artificial sequence
  synthetic polynucleotide sequence
cacctcccaagggcctga

SEQ ID NO: 5882 - DNA, 18 bp, Artificial sequence
  synthetic polynucleotide sequence
ttggaatcccacgacaca

SEQ ID NO: 5883 - DNA, 18 bp, Artificial sequence
  synthetic polynucleotide sequence
caagcaacaatggtggca

SEQ ID NO: 5884 - DNA, 18 bp, Artificial sequence
  synthetic polynucleotide sequence
tcgggagagcaccctgga

SEQ ID NO: 5885 - DNA, 18 bp, Artificial sequence
  synthetic polynucleotide sequence
ccgacacatcagccctca

SEQ ID NO: 5886 - DNA, 18 bp, Artificial sequence
  synthetic polynucleotide sequence
agagaggtcgttcccaca

SEQ ID NO: 5887 - DNA, 18 bp, Artificial sequence
  synthetic polynucleotide sequence
cagacttgccccaggaca

SEQ ID NO: 5888 - DNA, 18 bp, Artificial sequence
  synthetic polynucleotide sequence
cacgaacgtcacagcaca

SEQ ID NO: 5889 - DNA, 18 bp, Artificial sequence
  synthetic polynucleotide sequence
gcctgttgaagccaccaa

SEQ ID NO: 5890 - DNA, 18 bp, Artificial sequence
  synthetic polynucleotide sequence
ccagaaggagcttgagga

SEQ ID NO: 5891 - DNA, 18 bp, Artificial sequence
  synthetic polynucleotide sequence
cggcgattacacggccaa

SEQ ID NO: 5892 - DNA, 18 bp, Artificial sequence
  synthetic polynucleotide sequence
acttgagggcgtcccaca

SEQ ID NO: 5893 - DNA, 18 bp, Artificial sequence
  synthetic polynucleotide sequence
agaaaggtggctggccaa

SEQ ID NO: 5894 - DNA, 18 bp, Artificial sequence
  synthetic polynucleotide sequence
cccttgggccatggcaga

SEQ ID NO: 5895 - DNA, 18 bp, Artificial sequence
  synthetic polynucleotide sequence
ccactgagtcggaggaca

SEQ ID NO: 5896 - DNA, 18 bp, Artificial sequence
  synthetic polynucleotide sequence
ggtcagggagtgtggaga

SEQ ID NO: 5897 - DNA, 18 bp, Artificial sequence
  synthetic polynucleotide sequence
gcaggaagccaaggagca

SEQ ID NO: 5898 - DNA, 18 bp, Artificial sequence
  synthetic polynucleotide sequence
gatctggctccaagcgga

SEQ ID NO: 5899 - DNA, 18 bp, Artificial sequence
  synthetic polynucleotide sequence
gggtctgactccacagga

SEQ ID NO: 5900 - DNA, 18 bp, Artificial sequence
  synthetic polynucleotide sequence
taggggcctgactggaga

SEQ ID NO: 5901 - DNA, 18 bp, Artificial sequence
  synthetic polynucleotide sequence
ctcaccaggggtcaacca

SEQ ID NO: 5902 - DNA, 19 bp, Artificial sequence
  synthetic polynucleotide sequence
ctcagagcacccgagaaca

SEQ ID NO: 5903 - DNA, 18 bp, Artificial sequence
  synthetic polynucleotide sequence
cgagggcagcaaaaccga

SEQ ID NO: 5904 - DNA, 18 bp, Artificial sequence
  synthetic polynucleotide sequence
tctgcgggtggacgacca

SEQ ID NO: 5905 - DNA, 18 bp, Artificial sequence
  synthetic polynucleotide sequence
aatacacggctgaagcca

SEQ ID NO: 5906 - DNA, 18 bp, Artificial sequence
  synthetic polynucleotide sequence
gggcacagacccagtcca

SEQ ID NO: 5907 - DNA, 18 bp, Artificial sequence
  synthetic polynucleotide sequence
ctggacacttcacggcca

SEQ ID NO: 5908 - DNA, 18 bp, Artificial sequence
  synthetic polynucleotide sequence
ggacccgtcacttgcgga

SEQ ID NO: 5909 - DNA, 18 bp, Artificial sequence
  synthetic polynucleotide sequence
ccatgcgcaccttcacca

SEQ ID NO: 5910 - DNA, 18 bp, Artificial sequence
  synthetic polynucleotide sequence
gtcgatccagcggcagca

SEQ ID NO: 5911 - DNA, 18 bp, Artificial sequence
  synthetic polynucleotide sequence
gggcacacagaccagcta

SEQ ID NO: 5912 - DNA, 18 bp, Artificial sequence
  synthetic polynucleotide sequence
aggcatcgaacaacagga

SEQ ID NO: 5913 - DNA, 18 bp, Artificial sequence
  synthetic polynucleotide sequence
catgctacgagtgaagga

SEQ ID NO: 5914 - DNA, 18 bp, Artificial sequence
  synthetic polynucleotide sequence
tggagagcgcccaggcta

SEQ ID NO: 5915 - DNA, 18 bp, Artificial sequence
  synthetic polynucleotide sequence
caacgccaggaagctgga

SEQ ID NO: 5916 - DNA, 18 bp, Artificial sequence
  synthetic polynucleotide sequence
caggatctgactgaggca

SEQ ID NO: 5917 - DNA, 18 bp, Artificial sequence
  synthetic polynucleotide sequence
tacacggtgggctacgca

SEQ ID NO: 5918 - DNA, 18 bp, Artificial sequence
  synthetic polynucleotide sequence
caggcggcagctcagaga

SEQ ID NO: 5919 - DNA, 18 bp, Artificial sequence
  synthetic polynucleotide sequence
tccccagaggagatgcga

SEQ ID NO: 5920 - DNA, 18 bp, Artificial sequence
  synthetic polynucleotide sequence
tgaggaaggccatgggga

SEQ ID NO: 5921 - DNA, 18 bp, Artificial sequence
  synthetic polynucleotide sequence
cactcccacaaccgccaa

SEQ ID NO: 5922 - DNA, 18 bp, Artificial sequence
  synthetic polynucleotide sequence
tgaggaaggccaatggga

SEQ ID NO: 5923 - DNA, 18 bp, Artificial sequence
  synthetic polynucleotide sequence
gcacccgtacaagtggca

SEQ ID NO: 5924 - DNA, 18 bp, Artificial sequence
  synthetic polynucleotide sequence
gctccagatggaatcgca

SEQ ID NO: 5925 - DNA, 18 bp, Artificial sequence
  synthetic polynucleotide sequence
tcaccatgaccacccaga

SEQ ID NO: 5926 - DNA, 18 bp, Artificial sequence
  synthetic polynucleotide sequence
tggcagcatactccagca

SEQ ID NO: 5927 - DNA, 18 bp, Artificial sequence
  synthetic polynucleotide sequence
cacaacccttgccgctga

SEQ ID NO: 5928 - DNA, 18 bp, Artificial sequence
  synthetic polynucleotide sequence
caactgcatactccacca

SEQ ID NO: 5929 - DNA, 18 bp, Artificial sequence
  synthetic polynucleotide sequence
gacgccggagcagcccca

SEQ ID NO: 5930 - DNA, 18 bp, Artificial sequence
  synthetic polynucleotide sequence
aatcgcggacgccgtgca

SEQ ID NO: 5931 - DNA, 18 bp, Artificial sequence
  synthetic polynucleotide sequence
aaagagctggtggcctca

SEQ ID NO: 5932 - DNA, 18 bp, Artificial sequence
  synthetic polynucleotide sequence
gggatcagacgttcgcaa

SEQ ID NO: 5933 - DNA, 18 bp, Artificial sequence
  synthetic polynucleotide sequence
acggtgggatctgcccca

SEQ ID NO: 5934 - DNA, 18 bp, Artificial sequence
  synthetic polynucleotide sequence
acttggctggcaggccca

SEQ ID NO: 5935 - DNA, 18 bp, Artificial sequence
  synthetic polynucleotide sequence
gcggatgcaggtggagca

SEQ ID NO: 5936 - DNA, 18 bp, Artificial sequence
  synthetic polynucleotide sequence
cgaacatgacgggcagga

SEQ ID NO: 5937 - DNA, 18 bp, Artificial sequence
  synthetic polynucleotide sequence
cagtcacatccaggacga

SEQ ID NO: 5938 - DNA, 18 bp, Artificial sequence
  synthetic polynucleotide sequence
ccagggtctccaccccga

SEQ ID NO: 5939 - DNA, 18 bp, Artificial sequence
  synthetic polynucleotide sequence
gcagtgcagcgacgccta

SEQ ID NO: 5940 - DNA, 18 bp, Artificial sequence
  synthetic polynucleotide sequence
tggctccgggacacgcca

SEQ ID NO: 5941 - DNA, 18 bp, Artificial sequence
  synthetic polynucleotide sequence
tccacacctgcccaccaa

SEQ ID NO: 5942 - DNA, 18 bp, Artificial sequence
  synthetic polynucleotide sequence
ggaggaggaggaagagga

SEQ ID NO: 5943 - DNA, 18 bp, Artificial sequence
  synthetic polynucleotide sequence
cggcagagttccaagaca

SEQ ID NO: 5944 - DNA, 18 bp, Artificial sequence
  synthetic polynucleotide sequence
gcctggcagaacgctcca

SEQ ID NO: 5945 - DNA, 18 bp, Artificial sequence
  synthetic polynucleotide sequence
gcatacgcattccccgga

SEQ ID NO: 5946 - DNA, 18 bp, Artificial sequence
  synthetic polynucleotide sequence
aaggggtcgcagttggca

SEQ ID NO: 5947 - DNA, 18 bp, Artificial sequence
  synthetic polynucleotide sequence
gtggcaaacccaaggcca

SEQ ID NO: 5948 - DNA, 18 bp, Artificial sequence
  synthetic polynucleotide sequence
ccctcaggccccaggaga

SEQ ID NO: 5949 - DNA, 18 bp, Artificial sequence
  synthetic polynucleotide sequence
agagcccctgcgtaccta

SEQ ID NO: 5950 - DNA, 18 bp, Artificial sequence
  synthetic polynucleotide sequence
tggtgagccaactgggca

SEQ ID NO: 5951 - DNA, 18 bp, Artificial sequence
  synthetic polynucleotide sequence
tgcgggcagaacaggaca

SEQ ID NO: 5952 - DNA, 18 bp, Artificial sequence
  synthetic polynucleotide sequence
caagtaggtcgaagccga

SEQ ID NO: 5953 - DNA, 18 bp, Artificial sequence
  synthetic polynucleotide sequence
atgaggagcttgagggca

SEQ ID NO: 5954 - DNA, 18 bp, Artificial sequence
  synthetic polynucleotide sequence
acatccaacaggactgga

SEQ ID NO: 5955 - DNA, 18 bp, Artificial sequence
  synthetic polynucleotide sequence
gcaagccggaacaacaga

SEQ ID NO: 5956 - DNA, 18 bp, Artificial sequence
  synthetic polynucleotide sequence
caggcctcagtgaggtca

SEQ ID NO: 5957 - DNA, 18 bp, Artificial sequence
  synthetic polynucleotide sequence
cagtaccctggagcagca

SEQ ID NO: 5958 - DNA, 18 bp, Artificial sequence
  synthetic polynucleotide sequence
cgcacagcttggaagcca

SEQ ID NO: 5959 - DNA, 18 bp, Artificial sequence
  synthetic polynucleotide sequence
ctggccaagcacacccca

SEQ ID NO: 5960 - DNA, 18 bp, Artificial sequence
  synthetic polynucleotide sequence
cccacgatgctatgcaga

SEQ ID NO: 5961 - DNA, 18 bp, Artificial sequence
  synthetic polynucleotide sequence
gtcactgaggcagaagca

SEQ ID NO: 5962 - DNA, 18 bp, Artificial sequence
  synthetic polynucleotide sequence
ccagcccacaatgcagga

SEQ ID NO: 5963 - DNA, 18 bp, Artificial sequence
  synthetic polynucleotide sequence
tgagaggaacggacggaa

SEQ ID NO: 5964 - DNA, 18 bp, Artificial sequence
  synthetic polynucleotide sequence
tggacctcagtcccccga

SEQ ID NO: 5965 - DNA, 18 bp, Artificial sequence
  synthetic polynucleotide sequence
gcctcagagggaaagaca

SEQ ID NO: 5966 - DNA, 18 bp, Artificial sequence
  synthetic polynucleotide sequence
aggtacacgtagagcgga

SEQ ID NO: 5967 - DNA, 18 bp, Artificial sequence
  synthetic polynucleotide sequence
caccgtgcagaacagaga

SEQ ID NO: 5968 - DNA, 18 bp, Artificial sequence
  synthetic polynucleotide sequence
gagggcctcttcaacaga

SEQ ID NO: 5969 - DNA, 18 bp, Artificial sequence
  synthetic polynucleotide sequence
ccatggcagcccaaggaa

SEQ ID NO: 5970 - DNA, 18 bp, Artificial sequence
  synthetic polynucleotide sequence
cgacgccggtcataggca

SEQ ID NO: 5971 - DNA, 18 bp, Artificial sequence
  synthetic polynucleotide sequence
ttacgacaggaggaggga

SEQ ID NO: 5972 - DNA, 18 bp, Artificial sequence
  synthetic polynucleotide sequence
ccaacatccaccatccga

SEQ ID NO: 5973 - DNA, 18 bp, Artificial sequence
  synthetic polynucleotide sequence
ccgacgcctcttcagcca

SEQ ID NO: 5974 - DNA, 18 bp, Artificial sequence
  synthetic polynucleotide sequence
cgagcaccgagtcccgca

SEQ ID NO: 5975 - DNA, 18 bp, Artificial sequence
  synthetic polynucleotide sequence
ctgagcggaagaagtgga

SEQ ID NO: 5976 - DNA, 18 bp, Artificial sequence
  synthetic polynucleotide sequence
agctagaaccaggtcgta

SEQ ID NO: 5977 - DNA, 18 bp, Artificial sequence
  synthetic polynucleotide sequence
gcgtaaagaccacgggga

SEQ ID NO: 5978 - DNA, 18 bp, Artificial sequence
  synthetic polynucleotide sequence
cgctcagaccgctgacca

SEQ ID NO: 5979 - DNA, 18 bp, Artificial sequence
  synthetic polynucleotide sequence
ggaagctgccagggcaga

SEQ ID NO: 5980 - DNA, 18 bp, Artificial sequence
  synthetic polynucleotide sequence
aagcaagcttgtacccca

SEQ ID NO: 5981 - DNA, 18 bp, Artificial sequence
  synthetic polynucleotide sequence
cgcctacatccaagcaca

SEQ ID NO: 5982 - DNA, 18 bp, Artificial sequence
  synthetic polynucleotide sequence
cgtcgaacaccacctgga

SEQ ID NO: 5983 - DNA, 18 bp, Artificial sequence
  synthetic polynucleotide sequence
tgatggaccccagagaga

SEQ ID NO: 5984 - DNA, 18 bp, Artificial sequence
  synthetic polynucleotide sequence
ggcgcacgtgaagtggga

SEQ ID NO: 5985 - DNA, 17 bp, Artificial sequence
  synthetic polynucleotide sequence
gactatgtgccgagcga

SEQ ID NO: 5986 - DNA, 15 bp, Artificial sequence
  synthetic polynucleotide sequence
ggccacccacgtcaa

SEQ ID NO: 5987 - DNA, 18 bp, Artificial sequence
  synthetic polynucleotide sequence
agaaggcgcacctcagca

SEQ ID NO: 5988 - DNA, 18 bp, Artificial sequence
  synthetic polynucleotide sequence
tgagctcgaggaactgca

SEQ ID NO: 5989 - DNA, 18 bp, Artificial sequence
  synthetic polynucleotide sequence
caccaccggctctgacga

SEQ ID NO: 5990 - DNA, 18 bp, Artificial sequence
  synthetic polynucleotide sequence
agtcgtcgtagccagcga

SEQ ID NO: 5991 - DNA, 18 bp, Artificial sequence
  synthetic polynucleotide sequence
caaggcagaaccacccca

SEQ ID NO: 5992 - DNA, 18 bp, Artificial sequence
  synthetic polynucleotide sequence
caatggtcacctgccaca

SEQ ID NO: 5993 - DNA, 18 bp, Artificial sequence
  synthetic polynucleotide sequence
gcccagcagaccaccaca

SEQ ID NO: 5994 - DNA, 18 bp, Artificial sequence
  synthetic polynucleotide sequence
gtggcatcatcagagcca

SEQ ID NO: 5995 - DNA, 18 bp, Artificial sequence
  synthetic polynucleotide sequence
ggacgtggagagcgggca

SEQ ID NO: 5996 - DNA, 17 bp, Artificial sequence
  synthetic polynucleotide sequence
gcactggccggagcgca

SEQ ID NO: 5997 - DNA, 18 bp, Artificial sequence
  synthetic polynucleotide sequence
gtggaagccatgggtgca

SEQ ID NO: 5998 - DNA, 18 bp, Artificial sequence
  synthetic polynucleotide sequence
tgagatggagcgcaccca

SEQ ID NO: 5999 - DNA, 18 bp, Artificial sequence
  synthetic polynucleotide sequence
atagcccaggcaaggaga

SEQ ID NO: 6000 - DNA, 18 bp, Artificial sequence
  synthetic polynucleotide sequence
ggacatgaggtccgctga

SEQ ID NO: 6001 - DNA, 18 bp, Artificial sequence
  synthetic polynucleotide sequence
gtccaaggcagctgcaga

SEQ ID NO: 6002 - DNA, 18 bp, Artificial sequence
  synthetic polynucleotide sequence
aagccggaacaggggtca

SEQ ID NO: 6003 - DNA, 18 bp, Artificial sequence
  synthetic polynucleotide sequence
aagccgggattgagcgca

SEQ ID NO: 6004 - DNA, 18 bp, Artificial sequence
  synthetic polynucleotide sequence
aggcagggactccgacca

SEQ ID NO: 6005 - DNA, 18 bp, Artificial sequence
  synthetic polynucleotide sequence
ggacctgacagaaaagga

SEQ ID NO: 6006 - DNA, 18 bp, Artificial sequence
  synthetic polynucleotide sequence
cagtggatcctcgccaga

SEQ ID NO: 6007 - DNA, 20 bp, Artificial sequence
  synthetic polynucleotide sequence
caaaggcatccctgaggaca

SEQ ID NO: 6008 - DNA, 18 bp, Artificial sequence
  synthetic polynucleotide sequence
ccctgggggtctaggaga

SEQ ID NO: 6009 - DNA, 18 bp, Artificial sequence
  synthetic polynucleotide sequence
ccaggctgatgctcgaca

SEQ ID NO: 6010 - DNA, 18 bp, Artificial sequence
  synthetic polynucleotide sequence
gtccaagatgtaggggga

SEQ ID NO: 6011 - DNA, 18 bp, Artificial sequence
  synthetic polynucleotide sequence
cggagaaactgcccagca

SEQ ID NO: 6012 - DNA, 17 bp, Artificial sequence
  synthetic polynucleotide sequence
agcgaggagccggcaga

SEQ ID NO: 6013 - DNA, 18 bp, Artificial sequence
  synthetic polynucleotide sequence
gcgagcatggtgcgggca

SEQ ID NO: 6014 - DNA, 18 bp, Artificial sequence
  synthetic polynucleotide sequence
ggtagtaggagagccgga

SEQ ID NO: 6015 - DNA, 18 bp, Artificial sequence
  synthetic polynucleotide sequence
ctgcttcagaaccggcca

SEQ ID NO: 6016 - DNA, 18 bp, Artificial sequence
  synthetic polynucleotide sequence
gcataagcccatcgacca

SEQ ID NO: 6017 - DNA, 18 bp, Artificial sequence
  synthetic polynucleotide sequence
aggagggagtgaaccaca

SEQ ID NO: 6018 - DNA, 18 bp, Artificial sequence
  synthetic polynucleotide sequence
tgtacaaggggtccacca

SEQ ID NO: 6019 - DNA, 18 bp, Artificial sequence
  synthetic polynucleotide sequence
cgagtgggagatcgccaa

SEQ ID NO: 6020 - DNA, 18 bp, Artificial sequence
  synthetic polynucleotide sequence
gctcggacacatgggcca

SEQ ID NO: 6021 - DNA, 18 bp, Artificial sequence
  synthetic polynucleotide sequence
ggaaagagagatgccgaa

SEQ ID NO: 6022 - DNA, 18 bp, Artificial sequence
  synthetic polynucleotide sequence
caggtctcggaggggaga

SEQ ID NO: 6023 - DNA, 18 bp, Artificial sequence
  synthetic polynucleotide sequence
cctcagctcagcccagga

SEQ ID NO: 6024 - DNA, 18 bp, Artificial sequence
  synthetic polynucleotide sequence
gcatcacttgggaggcca

SEQ ID NO: 6025 - DNA, 18 bp, Artificial sequence
  synthetic polynucleotide sequence
gcaacctccccactctga

SEQ ID NO: 6026 - DNA, 18 bp, Artificial sequence
  synthetic polynucleotide sequence
acatcccatccagtggca

SEQ ID NO: 6027 - DNA, 18 bp, Artificial sequence
  synthetic polynucleotide sequence
ctgcagacccagaccaga

SEQ ID NO: 6028 - DNA, 18 bp, Artificial sequence
  synthetic polynucleotide sequence
aacccctggagtgcgaca

SEQ ID NO: 6029 - DNA, 18 bp, Artificial sequence
  synthetic polynucleotide sequence
cagcgaggagcagcagca

SEQ ID NO: 6030 - DNA, 18 bp, Artificial sequence
  synthetic polynucleotide sequence
ccacggagggcacccgga

SEQ ID NO: 6031 - DNA, 18 bp, Artificial sequence
  synthetic polynucleotide sequence
agcgcctcgaacagcaga

SEQ ID NO: 6032 - DNA, 18 bp, Artificial sequence
  synthetic polynucleotide sequence
ggaacatttcgcagacga

SEQ ID NO: 6033 - DNA, 18 bp, Artificial sequence
  synthetic polynucleotide sequence
ggaagccctaaggaggga

SEQ ID NO: 6034 - DNA, 18 bp, Artificial sequence
  synthetic polynucleotide sequence
ctgtgtagcgacagcaga

SEQ ID NO: 6035 - DNA, 19 bp, Artificial sequence
  synthetic polynucleotide sequence
agactacagcagtggcaca

SEQ ID NO: 6036 - DNA, 17 bp, Artificial sequence
  synthetic polynucleotide sequence
agggtctgtcaggagga

SEQ ID NO: 6037 - DNA, 18 bp, Artificial sequence
  synthetic polynucleotide sequence
cctctgcatggagaccca

SEQ ID NO: 6038 - DNA, 18 bp, Artificial sequence
  synthetic polynucleotide sequence
gtaagtaggaggcctcga

SEQ ID NO: 6039 - DNA, 18 bp, Artificial sequence
  synthetic polynucleotide sequence
aaggagccagaggcagca

SEQ ID NO: 6040 - DNA, 18 bp, Artificial sequence
  synthetic polynucleotide sequence
ccacaagccgcaacacca

SEQ ID NO: 6041 - DNA, 18 bp, Artificial sequence
  synthetic polynucleotide sequence
aggagcctcagagggaca

SEQ ID NO: 6042 - DNA, 18 bp, Artificial sequence
  synthetic polynucleotide sequence
cccccgaagcctcttcca

SEQ ID NO: 6043 - DNA, 18 bp, Artificial sequence
  synthetic polynucleotide sequence
caggaagggtccaacaga

SEQ ID NO: 6044 - DNA, 18 bp, Artificial sequence
  synthetic polynucleotide sequence
ctgcaggctcggatcaca

SEQ ID NO: 6045 - DNA, 18 bp, Artificial sequence
  synthetic polynucleotide sequence
cgacaacaacttcagcga

SEQ ID NO: 6046 - DNA, 18 bp, Artificial sequence
  synthetic polynucleotide sequence
caccaacgggggaggtga

SEQ ID NO: 6047 - DNA, 18 bp, Artificial sequence
  synthetic polynucleotide sequence
acgactctgacaccacca

SEQ ID NO: 6048 - DNA, 18 bp, Artificial sequence
  synthetic polynucleotide sequence
aagcccagcatgttggca

SEQ ID NO: 6049 - DNA, 18 bp, Artificial sequence
  synthetic polynucleotide sequence
tgacccaactccggagca

SEQ ID NO: 6050 - DNA, 18 bp, Artificial sequence
  synthetic polynucleotide sequence
tagcgaatggcccaggca

SEQ ID NO: 6051 - DNA, 18 bp, Artificial sequence
  synthetic polynucleotide sequence
ccggaacagtggaaggaa

SEQ ID NO: 6052 - DNA, 18 bp, Artificial sequence
  synthetic polynucleotide sequence
gctcctacacgctcacca

SEQ ID NO: 6053 - DNA, 18 bp, Artificial sequence
  synthetic polynucleotide sequence
cactcggagaggtgcaca

SEQ ID NO: 6054 - DNA, 18 bp, Artificial sequence
  synthetic polynucleotide sequence
agccaagccaggaggaca

SEQ ID NO: 6055 - DNA, 18 bp, Artificial sequence
  synthetic polynucleotide sequence
catgaccgctgaacccca

SEQ ID NO: 6056 - DNA, 18 bp, Artificial sequence
  synthetic polynucleotide sequence
cagacagacactggccga

SEQ ID NO: 6057 - DNA, 18 bp, Artificial sequence
  synthetic polynucleotide sequence
caggctaccagctgggca

SEQ ID NO: 6058 - DNA, 18 bp, Artificial sequence
  synthetic polynucleotide sequence
gtggcacacagcaggcca

SEQ ID NO: 6059 - DNA, 18 bp, Artificial sequence
  synthetic polynucleotide sequence
atccaaggagcaccagca

SEQ ID NO: 6060 - DNA, 18 bp, Artificial sequence
  synthetic polynucleotide sequence
ggttctggaacaggacca

SEQ ID NO: 6061 - DNA, 18 bp, Artificial sequence
  synthetic polynucleotide sequence
cttcaggcacgctggaga

SEQ ID NO: 6062 - DNA, 18 bp, Artificial sequence
  synthetic polynucleotide sequence
ggccatcccgttccagca

SEQ ID NO: 6063 - DNA, 18 bp, Artificial sequence
  synthetic polynucleotide sequence
gtctgaaggctgcagcca

SEQ ID NO: 6064 - DNA, 18 bp, Artificial sequence
  synthetic polynucleotide sequence
gccaggatcaggagacca

SEQ ID NO: 6065 - DNA, 18 bp, Artificial sequence
  synthetic polynucleotide sequence
ctccgaaggacaacgaga

SEQ ID NO: 6066 - DNA, 18 bp, Artificial sequence
  synthetic polynucleotide sequence
ccaggaagaagaagcaca

SEQ ID NO: 6067 - DNA, 18 bp, Artificial sequence
  synthetic polynucleotide sequence
caaccacagcagctggca

SEQ ID NO: 6068 - DNA, 18 bp, Artificial sequence
  synthetic polynucleotide sequence
gctcggaagggaggacca

SEQ ID NO: 6069 - DNA, 18 bp, Artificial sequence
  synthetic polynucleotide sequence
aggcactcaatctgggca

SEQ ID NO: 6070 - DNA, 18 bp, Artificial sequence
  synthetic polynucleotide sequence
aaggcttagtgagcgcca

SEQ ID NO: 6071 - DNA, 18 bp, Artificial sequence
  synthetic polynucleotide sequence
cacgtccaacgaggagga

SEQ ID NO: 6072 - DNA, 18 bp, Artificial sequence
  synthetic polynucleotide sequence
ggccgagtgatgtccaca

SEQ ID NO: 6073 - DNA, 18 bp, Artificial sequence
  synthetic polynucleotide sequence
ggatgcctgaacaaccaa

SEQ ID NO: 6074 - DNA, 18 bp, Artificial sequence
  synthetic polynucleotide sequence
aagcggctaacagtggga

SEQ ID NO: 6075 - DNA, 18 bp, Artificial sequence
  synthetic polynucleotide sequence
gtgcaagaggtggacaca

SEQ ID NO: 6076 - DNA, 18 bp, Artificial sequence
  synthetic polynucleotide sequence
ctccaagaaggtggcaga

SEQ ID NO: 6077 - DNA, 18 bp, Artificial sequence
  synthetic polynucleotide sequence
gctgtggagacaacacca

SEQ ID NO: 6078 - DNA, 18 bp, Artificial sequence
  synthetic polynucleotide sequence
ccccgcagctctctagga

SEQ ID NO: 6079 - DNA, 18 bp, Artificial sequence
  synthetic polynucleotide sequence
cacagcatcttgccgcca

SEQ ID NO: 6080 - DNA, 18 bp, Artificial sequence
  synthetic polynucleotide sequence
caggcgagtacgacgtga

SEQ ID NO: 6081 - DNA, 18 bp, Artificial sequence
  synthetic polynucleotide sequence
acgagcggtactacgaca

SEQ ID NO: 6082 - DNA, 18 bp, Artificial sequence
  synthetic polynucleotide sequence
cagcgtggctgacacgga

SEQ ID NO: 6083 - DNA, 18 bp, Artificial sequence
  synthetic polynucleotide sequence
gggctcccacgtggcaca

SEQ ID NO: 6084 - DNA, 18 bp, Artificial sequence
  synthetic polynucleotide sequence
tggtgcagcactgagaga

SEQ ID NO: 6085 - DNA, 18 bp, Artificial sequence
  synthetic polynucleotide sequence
tgctgatggcccaggaga

SEQ ID NO: 6086 - DNA, 18 bp, Artificial sequence
  synthetic polynucleotide sequence
ctggccgagcttgcacca

SEQ ID NO: 6087 - DNA, 18 bp, Artificial sequence
  synthetic polynucleotide sequence
ggtgtgagacacacgcca

SEQ ID NO: 6088 - DNA, 18 bp, Artificial sequence
  synthetic polynucleotide sequence
ctggaccgggatgaggaa

SEQ ID NO: 6089 - DNA, 18 bp, Artificial sequence
  synthetic polynucleotide sequence
ccaagacggtggagggga

SEQ ID NO: 6090 - DNA, 18 bp, Artificial sequence
  synthetic polynucleotide sequence
ccagggtgggacattgca

SEQ ID NO: 6091 - DNA, 18 bp, Artificial sequence
  synthetic polynucleotide sequence
cggacagatgaaggccga

SEQ ID NO: 6092 - DNA, 18 bp, Artificial sequence
  synthetic polynucleotide sequence
cccagcaccaccatcaca

SEQ ID NO: 6093 - DNA, 18 bp, Artificial sequence
  synthetic polynucleotide sequence
gccactcgcatgtacgca

SEQ ID NO: 6094 - DNA, 18 bp, Artificial sequence
  synthetic polynucleotide sequence
ctcaagtgcagaacgcca

SEQ ID NO: 6095 - DNA, 18 bp, Artificial sequence
  synthetic polynucleotide sequence
agggagcattcccacgga

SEQ ID NO: 6096 - DNA, 18 bp, Artificial sequence
  synthetic polynucleotide sequence
cccagggtgaggttcaca

SEQ ID NO: 6097 - DNA, 18 bp, Artificial sequence
  synthetic polynucleotide sequence
agctcaccattcaccaca

SEQ ID NO: 6098 - DNA, 18 bp, Artificial sequence
  synthetic polynucleotide sequence
cagcaactgaggaccgga

SEQ ID NO: 6099 - DNA, 18 bp, Artificial sequence
  synthetic polynucleotide sequence
ccaccgaggagggcacga

SEQ ID NO: 6100 - DNA, 18 bp, Artificial sequence
  synthetic polynucleotide sequence
gaacagcgagtttgagga

SEQ ID NO: 6101 - DNA, 18 bp, Artificial sequence
  synthetic polynucleotide sequence
catcaacagccagggcca

SEQ ID NO: 6102 - DNA, 18 bp, Artificial sequence
  synthetic polynucleotide sequence
cctgcatggggatcacga

SEQ ID NO: 6103 - DNA, 18 bp, Artificial sequence
  synthetic polynucleotide sequence
gacatcgtgacgtgccaa

SEQ ID NO: 6104 - DNA, 18 bp, Artificial sequence
  synthetic polynucleotide sequence
agcctcgatgatcaggca

SEQ ID NO: 6105 - DNA, 18 bp, Artificial sequence
  synthetic polynucleotide sequence
cctgaggcatcctccaga

SEQ ID NO: 6106 - DNA, 18 bp, Artificial sequence
  synthetic polynucleotide sequence
ggcagaggcatggcacca

SEQ ID NO: 6107 - DNA, 18 bp, Artificial sequence
  synthetic polynucleotide sequence
agggccacttcctggaca

SEQ ID NO: 6108 - DNA, 18 bp, Artificial sequence
  synthetic polynucleotide sequence
gcagcatgcccaccagca

SEQ ID NO: 6109 - DNA, 18 bp, Artificial sequence
  synthetic polynucleotide sequence
ctctggcacagaacccca

SEQ ID NO: 6110 - DNA, 18 bp, Artificial sequence
  synthetic polynucleotide sequence
ggaagtgcgtggtcacca

SEQ ID NO: 6111 - DNA, 18 bp, Artificial sequence
  synthetic polynucleotide sequence
cgtggcaacagctcgaca

SEQ ID NO: 6112 - DNA, 18 bp, Artificial sequence
  synthetic polynucleotide sequence
cgctgaagacactgcaca

SEQ ID NO: 6113 - DNA, 18 bp, Artificial sequence
  synthetic polynucleotide sequence
ggatggggctagaagcaa

SEQ ID NO: 6114 - DNA, 18 bp, Artificial sequence
  synthetic polynucleotide sequence
acaccactaaggcaggca

SEQ ID NO: 6115 - DNA, 18 bp, Artificial sequence
  synthetic polynucleotide sequence
ccgggtactactacgcca

SEQ ID NO: 6116 - DNA, 18 bp, Artificial sequence
  synthetic polynucleotide sequence
gggcagcgcttaagccca

SEQ ID NO: 6117 - DNA, 18 bp, Artificial sequence
  synthetic polynucleotide sequence
gctgcactcacctcacca

SEQ ID NO: 6118 - DNA, 18 bp, Artificial sequence
  synthetic polynucleotide sequence
ccagcacggcgaaggaca

SEQ ID NO: 6119 - DNA, 18 bp, Artificial sequence
  synthetic polynucleotide sequence
acctgaacccaggcacca

SEQ ID NO: 6120 - DNA, 18 bp, Artificial sequence
  synthetic polynucleotide sequence
tctgaaggcacaggacca

SEQ ID NO: 6121 - DNA, 18 bp, Artificial sequence
  synthetic polynucleotide sequence
tccgggaggagatcacca

SEQ ID NO: 6122 - DNA, 18 bp, Artificial sequence
  synthetic polynucleotide sequence
ctcaggggacccaaggga

SEQ ID NO: 6123 - DNA, 18 bp, Artificial sequence
  synthetic polynucleotide sequence
gctgcaagatctaccgaa

SEQ ID NO: 6124 - DNA, 18 bp, Artificial sequence
  synthetic polynucleotide sequence
gaaggaccattagccaca

SEQ ID NO: 6125 - DNA, 18 bp, Artificial sequence
  synthetic polynucleotide sequence
actcctcagaaccagtga

SEQ ID NO: 6126 - DNA, 18 bp, Artificial sequence
  synthetic polynucleotide sequence
taacaacggactgggcca

SEQ ID NO: 6127 - DNA, 18 bp, Artificial sequence
  synthetic polynucleotide sequence
tgaccctgaccacgacca

SEQ ID NO: 6128 - DNA, 18 bp, Artificial sequence
  synthetic polynucleotide sequence
atgaccaagtagcaccca

SEQ ID NO: 6129 - DNA, 18 bp, Artificial sequence
  synthetic polynucleotide sequence
tggagggccctgagccca

SEQ ID NO: 6130 - DNA, 18 bp, Artificial sequence
  synthetic polynucleotide sequence
cggcaggctgtcagcaca

SEQ ID NO: 6131 - DNA, 19 bp, Artificial sequence
  synthetic polynucleotide sequence
caccgctttgcctacacga

SEQ ID NO: 6132 - DNA, 18 bp, Artificial sequence
  synthetic polynucleotide sequence
agagggtgcaccacagca

SEQ ID NO: 6133 - DNA, 18 bp, Artificial sequence
  synthetic polynucleotide sequence
cgaacggtgaggaggaca

SEQ ID NO: 6134 - DNA, 18 bp, Artificial sequence
  synthetic polynucleotide sequence
aaggcagccaggagagca

SEQ ID NO: 6135 - DNA, 18 bp, Artificial sequence
  synthetic polynucleotide sequence
gctgcgccaacccgctca

SEQ ID NO: 6136 - DNA, 18 bp, Artificial sequence
  synthetic polynucleotide sequence
ccggcaacggaacacgga

SEQ ID NO: 6137 - DNA, 18 bp, Artificial sequence
  synthetic polynucleotide sequence
cgcaagggcattgccaca

SEQ ID NO: 6138 - DNA, 18 bp, Artificial sequence
  synthetic polynucleotide sequence
tgtaggtggcagggagca

SEQ ID NO: 6139 - DNA, 18 bp, Artificial sequence
  synthetic polynucleotide sequence
cataggcacctgcgccca

SEQ ID NO: 6140 - DNA, 18 bp, Artificial sequence
  synthetic polynucleotide sequence
gtcgccacagatggacca

SEQ ID NO: 6141 - DNA, 18 bp, Artificial sequence
  synthetic polynucleotide sequence
ggtgtgagaccgtcagga

SEQ ID NO: 6142 - DNA, 18 bp, Artificial sequence
  synthetic polynucleotide sequence
tggtgacaaggcaggcca

SEQ ID NO: 6143 - DNA, 19 bp, Artificial sequence
  synthetic polynucleotide sequence
gcaaccggaaagtctacca

SEQ ID NO: 6144 - DNA, 19 bp, Artificial sequence
  synthetic polynucleotide sequence
atgcagcgaatcagcaaca

SEQ ID NO: 6145 - DNA, 18 bp, Artificial sequence
  synthetic polynucleotide sequence
cgatgtgaccacagagca

SEQ ID NO: 6146 - DNA, 18 bp, Artificial sequence
  synthetic polynucleotide sequence
ccttgctggacaggagga

SEQ ID NO: 6147 - DNA, 18 bp, Artificial sequence
  synthetic polynucleotide sequence
ccagaccctggaagggga

SEQ ID NO: 6148 - DNA, 18 bp, Artificial sequence
  synthetic polynucleotide sequence
gggatgtagctcagggca

SEQ ID NO: 6149 - DNA, 18 bp, Artificial sequence
  synthetic polynucleotide sequence
ctgaaggtggtcaagcca

SEQ ID NO: 6150 - DNA, 18 bp, Artificial sequence
  synthetic polynucleotide sequence
gaatcaccagcacggcca

SEQ ID NO: 6151 - DNA, 18 bp, Artificial sequence
  synthetic polynucleotide sequence
gtgatagggagaaccgca

SEQ ID NO: 6152 - DNA, 18 bp, Artificial sequence
  synthetic polynucleotide sequence
gaagatggccaaccccca

SEQ ID NO: 6153 - DNA, 18 bp, Artificial sequence
  synthetic polynucleotide sequence
gtagagggaggagccgaa

SEQ ID NO: 6154 - DNA, 18 bp, Artificial sequence
  synthetic polynucleotide sequence
cgaagcccaacagccaca

SEQ ID NO: 6155 - DNA, 18 bp, Artificial sequence
  synthetic polynucleotide sequence
cacgggctggaagagaca

SEQ ID NO: 6156 - DNA, 18 bp, Artificial sequence
  synthetic polynucleotide sequence
cccagccattggcagcca

SEQ ID NO: 6157 - DNA, 18 bp, Artificial sequence
  synthetic polynucleotide sequence
ctgcgtgacacaaggcca

SEQ ID NO: 6158 - DNA, 18 bp, Artificial sequence
  synthetic polynucleotide sequence
ggtcatccaggccaccca

SEQ ID NO: 6159 - DNA, 18 bp, Artificial sequence
  synthetic polynucleotide sequence
tgctcctcaccacagcca

SEQ ID NO: 6160 - DNA, 18 bp, Artificial sequence
  synthetic polynucleotide sequence
gaagaggacgaaggccca

SEQ ID NO: 6161 - DNA, 18 bp, Artificial sequence
  synthetic polynucleotide sequence
ggaccatgacctcagcca

SEQ ID NO: 6162 - DNA, 18 bp, Artificial sequence
  synthetic polynucleotide sequence
cacatcccgcacagggga

SEQ ID NO: 6163 - DNA, 18 bp, Artificial sequence
  synthetic polynucleotide sequence
gagagcgtgacagccaga

SEQ ID NO: 6164 - DNA, 19 bp, Artificial sequence
  synthetic polynucleotide sequence
ggagctgctggagatgaca

SEQ ID NO: 6165 - DNA, 18 bp, Artificial sequence
  synthetic polynucleotide sequence
cagatgcagccagcagga

SEQ ID NO: 6166 - DNA, 18 bp, Artificial sequence
  synthetic polynucleotide sequence
tggatgaaggggagccga

SEQ ID NO: 6167 - DNA, 18 bp, Artificial sequence
  synthetic polynucleotide sequence
ggtatcccccaacacgga

SEQ ID NO: 6168 - DNA, 18 bp, Artificial sequence
  synthetic polynucleotide sequence
ttagacgaagccctggca

SEQ ID NO: 6169 - DNA, 18 bp, Artificial sequence
  synthetic polynucleotide sequence
ggacgaggtgtaccagga

SEQ ID NO: 6170 - DNA, 18 bp, Artificial sequence
  synthetic polynucleotide sequence
ggaggtggagtggaagga

SEQ ID NO: 6171 - DNA, 18 bp, Artificial sequence
  synthetic polynucleotide sequence
gccagctcccagcgacga

SEQ ID NO: 6172 - DNA, 18 bp, Artificial sequence
  synthetic polynucleotide sequence
tcgttgcgacacaccgga

SEQ ID NO: 6173 - DNA, 18 bp, Artificial sequence
  synthetic polynucleotide sequence
gaaggacaagctccccta

SEQ ID NO: 6174 - DNA, 18 bp, Artificial sequence
  synthetic polynucleotide sequence
cggcgcacagggctccaa

SEQ ID NO: 6175 - DNA, 18 bp, Artificial sequence
  synthetic polynucleotide sequence
caggaagagcttgcacca

SEQ ID NO: 6176 - DNA, 18 bp, Artificial sequence
  synthetic polynucleotide sequence
ggcggtcagatgtaccca

SEQ ID NO: 6177 - DNA, 18 bp, Artificial sequence
  synthetic polynucleotide sequence
cagtgaggcaagaccgaa

SEQ ID NO: 6178 - DNA, 18 bp, Artificial sequence
  synthetic polynucleotide sequence
cgaactggttacacggga

SEQ ID NO: 6179 - DNA, 18 bp, Artificial sequence
  synthetic polynucleotide sequence
ggaccctgtaaaggtcca

SEQ ID NO: 6180 - DNA, 18 bp, Artificial sequence
  synthetic polynucleotide sequence
gcttcaagtacgccagga

SEQ ID NO: 6181 - DNA, 18 bp, Artificial sequence
  synthetic polynucleotide sequence
ggcgaggagtacatccaa

SEQ ID NO: 6182 - DNA, 18 bp, Artificial sequence
  synthetic polynucleotide sequence
agccactacctggacaca

SEQ ID NO: 6183 - DNA, 18 bp, Artificial sequence
  synthetic polynucleotide sequence
ctaccgagccctgcagca

SEQ ID NO: 6184 - DNA, 18 bp, Artificial sequence
  synthetic polynucleotide sequence
gggcaccagtaccggtga

SEQ ID NO: 6185 - DNA, 18 bp, Artificial sequence
  synthetic polynucleotide sequence
gtggccagtgactgccaa

SEQ ID NO: 6186 - DNA, 18 bp, Artificial sequence
  synthetic polynucleotide sequence
caacacgctgaagtggga

SEQ ID NO: 6187 - DNA, 18 bp, Artificial sequence
  synthetic polynucleotide sequence
caacgcccctacagacca

SEQ ID NO: 6188 - DNA, 18 bp, Artificial sequence
  synthetic polynucleotide sequence
cgagggagttctcggaga

SEQ ID NO: 6189 - DNA, 18 bp, Artificial sequence
  synthetic polynucleotide sequence
tcaggccagaaaagcaga

SEQ ID NO: 6190 - DNA, 18 bp, Artificial sequence
  synthetic polynucleotide sequence
gaagaggcagtggggcta

SEQ ID NO: 6191 - DNA, 18 bp, Artificial sequence
  synthetic polynucleotide sequence
tagcaaacagcggcacga

SEQ ID NO: 6192 - DNA, 18 bp, Artificial sequence
  synthetic polynucleotide sequence
acttgacagagagggaga

SEQ ID NO: 6193 - DNA, 18 bp, Artificial sequence
  synthetic polynucleotide sequence
catcctgccgagcgagga

SEQ ID NO: 6194 - DNA, 18 bp, Artificial sequence
  synthetic polynucleotide sequence
gcgtgcagcaatggcgca

SEQ ID NO: 6195 - DNA, 18 bp, Artificial sequence
  synthetic polynucleotide sequence
cgaaacttccacccccga

SEQ ID NO: 6196 - DNA, 18 bp, Artificial sequence
  synthetic polynucleotide sequence
ccaggagcctgatgagca

SEQ ID NO: 6197 - DNA, 18 bp, Artificial sequence
  synthetic polynucleotide sequence
gctgcaacagtcgcacca

SEQ ID NO: 6198 - DNA, 18 bp, Artificial sequence
  synthetic polynucleotide sequence
gggcttgcagaaggagca

SEQ ID NO: 6199 - DNA, 18 bp, Artificial sequence
  synthetic polynucleotide sequence
ccgagcgcaagtacctca

SEQ ID NO: 6200 - DNA, 18 bp, Artificial sequence
  synthetic polynucleotide sequence
gggcttgcagaaggcgca

SEQ ID NO: 6201 - DNA, 18 bp, Artificial sequence
  synthetic polynucleotide sequence
ccgacaccccatcagcaa

SEQ ID NO: 6202 - DNA, 18 bp, Artificial sequence
  synthetic polynucleotide sequence
cgccgtatgctgccgaga

SEQ ID NO: 6203 - DNA, 18 bp, Artificial sequence
  synthetic polynucleotide sequence
cctgaaggggctgaggaa

SEQ ID NO: 6204 - DNA, 18 bp, Artificial sequence
  synthetic polynucleotide sequence
gctcccccatgtccagca

SEQ ID NO: 6205 - DNA, 18 bp, Artificial sequence
  synthetic polynucleotide sequence
caacatcagcaggggcga

SEQ ID NO: 6206 - DNA, 18 bp, Artificial sequence
  synthetic polynucleotide sequence
gtcacatccagtccagca

SEQ ID NO: 6207 - DNA, 18 bp, Artificial sequence
  synthetic polynucleotide sequence
ccgagaccctgacacgaa

SEQ ID NO: 6208 - DNA, 18 bp, Artificial sequence
  synthetic polynucleotide sequence
aagggagccacagccaca

SEQ ID NO: 6209 - DNA, 18 bp, Artificial sequence
  synthetic polynucleotide sequence
tgcggaagtccaaaggga

SEQ ID NO: 6210 - DNA, 18 bp, Artificial sequence
  synthetic polynucleotide sequence
actgcgaggttaaccgca

SEQ ID NO: 6211 - DNA, 18 bp, Artificial sequence
  synthetic polynucleotide sequence
ggaaggacccagcgacca

SEQ ID NO: 6212 - DNA, 18 bp, Artificial sequence
  synthetic polynucleotide sequence
tcgctcaaccgtcaggaa

SEQ ID NO: 6213 - DNA, 18 bp, Artificial sequence
  synthetic polynucleotide sequence
ctgtgacctcaccagcca

SEQ ID NO: 6214 - DNA, 18 bp, Artificial sequence
  synthetic polynucleotide sequence
caccacaactccagggca

SEQ ID NO: 6215 - DNA, 18 bp, Artificial sequence
  synthetic polynucleotide sequence
acgtgcctgagcaccgaa

SEQ ID NO: 6216 - DNA, 18 bp, Artificial sequence
  synthetic polynucleotide sequence
tacccagattgagcccca

SEQ ID NO: 6217 - DNA, 18 bp, Artificial sequence
  synthetic polynucleotide sequence
gaagtggtggcgtgggaa

SEQ ID NO: 6218 - DNA, 18 bp, Artificial sequence
  synthetic polynucleotide sequence
accagtccggcagccaga

SEQ ID NO: 6219 - DNA, 18 bp, Artificial sequence
  synthetic polynucleotide sequence
agctgcaagaggaaggca

SEQ ID NO: 6220 - DNA, 18 bp, Artificial sequence
  synthetic polynucleotide sequence
ttctgaacccccagggca

SEQ ID NO: 6221 - DNA, 18 bp, Artificial sequence
  synthetic polynucleotide sequence
tcaaggatggggccacca

SEQ ID NO: 6222 - DNA, 18 bp, Artificial sequence
  synthetic polynucleotide sequence
gctgctcatgaaggccca

SEQ ID NO: 6223 - DNA, 18 bp, Artificial sequence
  synthetic polynucleotide sequence
ccagtacacgctgggcaa

SEQ ID NO: 6224 - DNA, 18 bp, Artificial sequence
  synthetic polynucleotide sequence
tggccgtgtaggaggaga

SEQ ID NO: 6225 - DNA, 18 bp, Artificial sequence
  synthetic polynucleotide sequence
acgccacggtgaagcaga

SEQ ID NO: 6226 - DNA, 18 bp, Artificial sequence
  synthetic polynucleotide sequence
aggcctcgaactccagca

SEQ ID NO: 6227 - DNA, 18 bp, Artificial sequence
  synthetic polynucleotide sequence
gcacagtgagaccagcga

SEQ ID NO: 6228 - DNA, 18 bp, Artificial sequence
  synthetic polynucleotide sequence
ggcctgaataggtgggca

SEQ ID NO: 6229 - DNA, 18 bp, Artificial sequence
  synthetic polynucleotide sequence
ccggacatcaccaccaca

SEQ ID NO: 6230 - DNA, 18 bp, Artificial sequence
  synthetic polynucleotide sequence
tggtgacaagggcccgga

SEQ ID NO: 6231 - DNA, 18 bp, Artificial sequence
  synthetic polynucleotide sequence
atggcatcgccctgcaca

SEQ ID NO: 6232 - DNA, 18 bp, Artificial sequence
  synthetic polynucleotide sequence
tgtagaagacgcccgcca

SEQ ID NO: 6233 - DNA, 18 bp, Artificial sequence
  synthetic polynucleotide sequence
gcggaccaccaatgggaa

SEQ ID NO: 6234 - DNA, 18 bp, Artificial sequence
  synthetic polynucleotide sequence
gctgcagctcctgacgga

SEQ ID NO: 6235 - DNA, 18 bp, Artificial sequence
  synthetic polynucleotide sequence
ccgacatgcacgcacaca

SEQ ID NO: 6236 - DNA, 18 bp, Artificial sequence
  synthetic polynucleotide sequence
agtcggcgtcgatggaga

SEQ ID NO: 6237 - DNA, 18 bp, Artificial sequence
  synthetic polynucleotide sequence
gccgtgggcatcaccaca

SEQ ID NO: 6238 - DNA, 18 bp, Artificial sequence
  synthetic polynucleotide sequence
ggaagcaggtgaagagca

SEQ ID NO: 6239 - DNA, 18 bp, Artificial sequence
  synthetic polynucleotide sequence
agcgcttagaagccggga

SEQ ID NO: 6240 - DNA, 18 bp, Artificial sequence
  synthetic polynucleotide sequence
cgcccttcacagtggaga

SEQ ID NO: 6241 - DNA, 18 bp, Artificial sequence
  synthetic polynucleotide sequence
ctgtaccgggacacacca

SEQ ID NO: 6242 - DNA, 18 bp, Artificial sequence
  synthetic polynucleotide sequence
atcgcagaggagaggcca

SEQ ID NO: 6243 - DNA, 18 bp, Artificial sequence
  synthetic polynucleotide sequence
cttcgaactgccccagga

SEQ ID NO: 6244 - DNA, 18 bp, Artificial sequence
  synthetic polynucleotide sequence
ggaagacaccacccagca

SEQ ID NO: 6245 - DNA, 18 bp, Artificial sequence
  synthetic polynucleotide sequence
gccctgctgaccaagaca

SEQ ID NO: 6246 - DNA, 18 bp, Artificial sequence
  synthetic polynucleotide sequence
gcaccaggatcagaccca

SEQ ID NO: 6247 - DNA, 18 bp, Artificial sequence
  synthetic polynucleotide sequence
ggtggacttccaggacca

SEQ ID NO: 6248 - DNA, 18 bp, Artificial sequence
  synthetic polynucleotide sequence
acacggtgcacgtgacca

SEQ ID NO: 6249 - DNA, 18 bp, Artificial sequence
  synthetic polynucleotide sequence
caagccagacctggagga

SEQ ID NO: 6250 - DNA, 18 bp, Artificial sequence
  synthetic polynucleotide sequence
agagggccgactcggaca

SEQ ID NO: 6251 - DNA, 18 bp, Artificial sequence
  synthetic polynucleotide sequence
agcctgccgtgtaagcca

SEQ ID NO: 6252 - DNA, 18 bp, Artificial sequence
  synthetic polynucleotide sequence
caccacagcccagggaga

SEQ ID NO: 6253 - DNA, 18 bp, Artificial sequence
  synthetic polynucleotide sequence
ctgccgagacaaccgaca

SEQ ID NO: 6254 - DNA, 18 bp, Artificial sequence
  synthetic polynucleotide sequence
gcggaagccagcaggaca

SEQ ID NO: 6255 - DNA, 18 bp, Artificial sequence
  synthetic polynucleotide sequence
ggccctgggcaatcagca

SEQ ID NO: 6256 - DNA, 18 bp, Artificial sequence
  synthetic polynucleotide sequence
cgttgagaacctggagca

SEQ ID NO: 6257 - DNA, 18 bp, Artificial sequence
  synthetic polynucleotide sequence
gaaccctgtcggagccaa

SEQ ID NO: 6258 - DNA, 18 bp, Artificial sequence
  synthetic polynucleotide sequence
ggtctcagagtgcgccca

SEQ ID NO: 6259 - DNA, 18 bp, Artificial sequence
  synthetic polynucleotide sequence
cacacgctctgtggagga

SEQ ID NO: 6260 - DNA, 18 bp, Artificial sequence
  synthetic polynucleotide sequence
ggatgtcccagatgcgga

SEQ ID NO: 6261 - DNA, 18 bp, Artificial sequence
  synthetic polynucleotide sequence
actgccgagggtcgggca

SEQ ID NO: 6262 - DNA, 18 bp, Artificial sequence
  synthetic polynucleotide sequence
tgcaggcagggcacctca

SEQ ID NO: 6263 - DNA, 17 bp, Artificial sequence
  synthetic polynucleotide sequence
gcacctccgcgaggaga

SEQ ID NO: 6264 - DNA, 17 bp, Artificial sequence
  synthetic polynucleotide sequence
gacgccttcgacgacga

SEQ ID NO: 6265 - DNA, 18 bp, Artificial sequence
  synthetic polynucleotide sequence
ccagaagactggagacca

SEQ ID NO: 6266 - DNA, 18 bp, Artificial sequence
  synthetic polynucleotide sequence
gaaggtggtgacagccga

SEQ ID NO: 6267 - DNA, 18 bp, Artificial sequence
  synthetic polynucleotide sequence
cggtactatagggcacca

SEQ ID NO: 6268 - DNA, 18 bp, Artificial sequence
  synthetic polynucleotide sequence
accaactgatccacacca

SEQ ID NO: 6269 - DNA, 18 bp, Artificial sequence
  synthetic polynucleotide sequence
gaggtacccctgtccaga

SEQ ID NO: 6270 - DNA, 18 bp, Artificial sequence
  synthetic polynucleotide sequence
gtgcaccagccttaggca

SEQ ID NO: 6271 - DNA, 18 bp, Artificial sequence
  synthetic polynucleotide sequence
gatggaggaggaagagga

SEQ ID NO: 6272 - DNA, 18 bp, Artificial sequence
  synthetic polynucleotide sequence
ggcccaagacaagtacca

SEQ ID NO: 6273 - DNA, 18 bp, Artificial sequence
  synthetic polynucleotide sequence
accccgatgtatcacgca

SEQ ID NO: 6274 - DNA, 18 bp, Artificial sequence
  synthetic polynucleotide sequence
cacacccaagtccctgca

SEQ ID NO: 6275 - DNA, 18 bp, Artificial sequence
  synthetic polynucleotide sequence
tgcagcaggagctaagca

SEQ ID NO: 6276 - DNA, 18 bp, Artificial sequence
  synthetic polynucleotide sequence
aaccggctaggggcagca

SEQ ID NO: 6277 - DNA, 18 bp, Artificial sequence
  synthetic polynucleotide sequence
acctctacgggaaagaca

SEQ ID NO: 6278 - DNA, 18 bp, Artificial sequence
  synthetic polynucleotide sequence
agaagttccaccaggcta

SEQ ID NO: 6279 - DNA, 18 bp, Artificial sequence
  synthetic polynucleotide sequence
gcagtcagcccaaaggaa

SEQ ID NO: 6280 - DNA, 18 bp, Artificial sequence
  synthetic polynucleotide sequence
cctgacatgatggcagca

SEQ ID NO: 6281 - DNA, 18 bp, Artificial sequence
  synthetic polynucleotide sequence
gcagcctgcagatacgga

SEQ ID NO: 6282 - DNA, 18 bp, Artificial sequence
  synthetic polynucleotide sequence
agcagctccatccggtca

SEQ ID NO: 6283 - DNA, 18 bp, Artificial sequence
  synthetic polynucleotide sequence
accatatgcagctgggca

SEQ ID NO: 6284 - DNA, 18 bp, Artificial sequence
  synthetic polynucleotide sequence
tgggaaggcgtccaagca

SEQ ID NO: 6285 - DNA, 18 bp, Artificial sequence
  synthetic polynucleotide sequence
tcgaagccaatggctgga

SEQ ID NO: 6286 - DNA, 18 bp, Artificial sequence
  synthetic polynucleotide sequence
tgcgagcgatgtagcgca

SEQ ID NO: 6287 - DNA, 18 bp, Artificial sequence
  synthetic polynucleotide sequence
gggagacagaagaggaga

SEQ ID NO: 6288 - DNA, 18 bp, Artificial sequence
  synthetic polynucleotide sequence
agtcagggctgtagcaga

SEQ ID NO: 6289 - DNA, 18 bp, Artificial sequence
  synthetic polynucleotide sequence
acagtcagggtcagctga

SEQ ID NO: 6290 - DNA, 18 bp, Artificial sequence
  synthetic polynucleotide sequence
cataggggtcatccggca

SEQ ID NO: 6291 - DNA, 18 bp, Artificial sequence
  synthetic polynucleotide sequence
gtcctggagaccagccaa

SEQ ID NO: 6292 - DNA, 18 bp, Artificial sequence
  synthetic polynucleotide sequence
cacatctcaacgctacca

SEQ ID NO: 6293 - DNA, 18 bp, Artificial sequence
  synthetic polynucleotide sequence
ctatgaggcgggcaagga

SEQ ID NO: 6294 - DNA, 18 bp, Artificial sequence
  synthetic polynucleotide sequence
aacgcatccaggcagcca

SEQ ID NO: 6295 - DNA, 18 bp, Artificial sequence
  synthetic polynucleotide sequence
cctcttccaggaggccca

SEQ ID NO: 6296 - DNA, 18 bp, Artificial sequence
  synthetic polynucleotide sequence
tggccagcacccagggca

SEQ ID NO: 6297 - DNA, 18 bp, Artificial sequence
  synthetic polynucleotide sequence
aggtggaacgcaacagga

SEQ ID NO: 6298 - DNA, 18 bp, Artificial sequence
  synthetic polynucleotide sequence
tcagctcctccagggcca

SEQ ID NO: 6299 - DNA, 18 bp, Artificial sequence
  synthetic polynucleotide sequence
taggagacgaggtgacca

SEQ ID NO: 6300 - DNA, 18 bp, Artificial sequence
  synthetic polynucleotide sequence
gtagggtagggggtgaga

SEQ ID NO: 6301 - DNA, 20 bp, Artificial sequence
  synthetic polynucleotide sequence
gggaaacagtcttcaggaga

SEQ ID NO: 6302 - DNA, 17 bp, Artificial sequence
  synthetic polynucleotide sequence
cctgaccctctgagcca

SEQ ID NO: 6303 - DNA, 18 bp, Artificial sequence
  synthetic polynucleotide sequence
gcctgaagggaagagcta

SEQ ID NO: 6304 - DNA, 18 bp, Artificial sequence
  synthetic polynucleotide sequence
gttggaacagaacctgga

SEQ ID NO: 6305 - DNA, 18 bp, Artificial sequence
  synthetic polynucleotide sequence
cgcaggagaagaagcgca

SEQ ID NO: 6306 - DNA, 18 bp, Artificial sequence
  synthetic polynucleotide sequence
cgccatgaagagggctga

SEQ ID NO: 6307 - DNA, 18 bp, Artificial sequence
  synthetic polynucleotide sequence
gcgtcaaaagaagcagga

SEQ ID NO: 6308 - DNA, 18 bp, Artificial sequence
  synthetic polynucleotide sequence
cccctgcatgtaggacca

SEQ ID NO: 6309 - DNA, 18 bp, Artificial sequence
  synthetic polynucleotide sequence
agaagacagtgcgttgca

SEQ ID NO: 6310 - DNA, 18 bp, Artificial sequence
  synthetic polynucleotide sequence
gagaaggcatctgaggca

SEQ ID NO: 6311 - DNA, 18 bp, Artificial sequence
  synthetic polynucleotide sequence
aggcacagctcaggccaa

SEQ ID NO: 6312 - DNA, 18 bp, Artificial sequence
  synthetic polynucleotide sequence
cagacaggttccgcacca

SEQ ID NO: 6313 - DNA, 18 bp, Artificial sequence
  synthetic polynucleotide sequence
cgcactcaccctgacgaa

SEQ ID NO: 6314 - DNA, 18 bp, Artificial sequence
  synthetic polynucleotide sequence
caagtggagggagctcca

SEQ ID NO: 6315 - DNA, 18 bp, Artificial sequence
  synthetic polynucleotide sequence
gcacacctggatcacaga

SEQ ID NO: 6316 - DNA, 18 bp, Artificial sequence
  synthetic polynucleotide sequence
taagaagcaccggagcca

SEQ ID NO: 6317 - DNA, 18 bp, Artificial sequence
  synthetic polynucleotide sequence
gcaatgacggggcagaga

SEQ ID NO: 6318 - DNA, 18 bp, Artificial sequence
  synthetic polynucleotide sequence
caggcctcttggagcgga

SEQ ID NO: 6319 - DNA, 18 bp, Artificial sequence
  synthetic polynucleotide sequence
gttgtagcccagaacaga

SEQ ID NO: 6320 - DNA, 18 bp, Artificial sequence
  synthetic polynucleotide sequence
gctcctactccagccaca

SEQ ID NO: 6321 - DNA, 18 bp, Artificial sequence
  synthetic polynucleotide sequence
catgcagcagctgacgga

SEQ ID NO: 6322 - DNA, 18 bp, Artificial sequence
  synthetic polynucleotide sequence
agtgtagcagcctgacca

SEQ ID NO: 6323 - DNA, 18 bp, Artificial sequence
  synthetic polynucleotide sequence
gagggggtcctggagcaa

SEQ ID NO: 6324 - DNA, 18 bp, Artificial sequence
  synthetic polynucleotide sequence
gatgtgcacccagggcca

SEQ ID NO: 6325 - DNA, 18 bp, Artificial sequence
  synthetic polynucleotide sequence
gctcaaagacctccagga

SEQ ID NO: 6326 - DNA, 18 bp, Artificial sequence
  synthetic polynucleotide sequence
tcaccagggatgggtgca

SEQ ID NO: 6327 - DNA, 18 bp, Artificial sequence
  synthetic polynucleotide sequence
aggcacagtgggcaccca

SEQ ID NO: 6328 - DNA, 18 bp, Artificial sequence
  synthetic polynucleotide sequence
gctggaagcctcctgcga

SEQ ID NO: 6329 - DNA, 18 bp, Artificial sequence
  synthetic polynucleotide sequence
ggtgatgtagcccagcaa

SEQ ID NO: 6330 - DNA, 18 bp, Artificial sequence
  synthetic polynucleotide sequence
atgggagtacactgggca

SEQ ID NO: 6331 - DNA, 18 bp, Artificial sequence
  synthetic polynucleotide sequence
cagctgtggcaagggcaa

SEQ ID NO: 6332 - DNA, 18 bp, Artificial sequence
  synthetic polynucleotide sequence
gatgacctgcagcggtga

SEQ ID NO: 6333 - DNA, 18 bp, Artificial sequence
  synthetic polynucleotide sequence
gaatcacgcatcagccca

SEQ ID NO: 6334 - DNA, 18 bp, Artificial sequence
  synthetic polynucleotide sequence
caggctggagctggggga

SEQ ID NO: 6335 - DNA, 18 bp, Artificial sequence
  synthetic polynucleotide sequence
gaagcagtgctgggcaga

SEQ ID NO: 6336 - DNA, 18 bp, Artificial sequence
  synthetic polynucleotide sequence
gctccagcatccgaagca

SEQ ID NO: 6337 - DNA, 18 bp, Artificial sequence
  synthetic polynucleotide sequence
cggcgacttcatcgagca

SEQ ID NO: 6338 - DNA, 18 bp, Artificial sequence
  synthetic polynucleotide sequence
gcacaccctgcaggtcca

SEQ ID NO: 6339 - DNA, 18 bp, Artificial sequence
  synthetic polynucleotide sequence
cagcacctccagcaggca

SEQ ID NO: 6340 - DNA, 18 bp, Artificial sequence
  synthetic polynucleotide sequence
tgccattgcgagtaggca

SEQ ID NO: 6341 - DNA, 18 bp, Artificial sequence
  synthetic polynucleotide sequence
gccgtacctgatgcacga

SEQ ID NO: 6342 - DNA, 18 bp, Artificial sequence
  synthetic polynucleotide sequence
tgacagccacagtgcgga

SEQ ID NO: 6343 - DNA, 18 bp, Artificial sequence
  synthetic polynucleotide sequence
ctgagcacgaaatcccca

SEQ ID NO: 6344 - DNA, 18 bp, Artificial sequence
  synthetic polynucleotide sequence
acatgtcctcccaagcca

SEQ ID NO: 6345 - DNA, 18 bp, Artificial sequence
  synthetic polynucleotide sequence
cagggcctccattgagca

SEQ ID NO: 6346 - DNA, 18 bp, Artificial sequence
  synthetic polynucleotide sequence
gtgtagagagtgcccgca

SEQ ID NO: 6347 - DNA, 18 bp, Artificial sequence
  synthetic polynucleotide sequence
cccccaccataatggaca

SEQ ID NO: 6348 - DNA, 18 bp, Artificial sequence
  synthetic polynucleotide sequence
gccggtacatgtagcgca

SEQ ID NO: 6349 - DNA, 19 bp, Artificial sequence
  synthetic polynucleotide sequence
gcactaacttcaggagcca

SEQ ID NO: 6350 - DNA, 18 bp, Artificial sequence
  synthetic polynucleotide sequence
cgagccatcgcccaccaa

SEQ ID NO: 6351 - DNA, 18 bp, Artificial sequence
  synthetic polynucleotide sequence
cgcaacatccgtgcacca

SEQ ID NO: 6352 - DNA, 18 bp, Artificial sequence
  synthetic polynucleotide sequence
gaggtggccgtgtccaca

SEQ ID NO: 6353 - DNA, 18 bp, Artificial sequence
  synthetic polynucleotide sequence
ccaccaacgacagaagga

SEQ ID NO: 6354 - DNA, 18 bp, Artificial sequence
  synthetic polynucleotide sequence
tgaggactggaggcctga

SEQ ID NO: 6355 - DNA, 19 bp, Artificial sequence
  synthetic polynucleotide sequence
atgctatgacccagccaca

SEQ ID NO: 6356 - DNA, 17 bp, Artificial sequence
  synthetic polynucleotide sequence
ggaggcttccagcacaa

SEQ ID NO: 6357 - DNA, 19 bp, Artificial sequence
  synthetic polynucleotide sequence
ccctgggaaaacactcaca

SEQ ID NO: 6358 - DNA, 17 bp, Artificial sequence
  synthetic polynucleotide sequence
ccccacgcacaactcaa

SEQ ID NO: 6359 - DNA, 19 bp, Artificial sequence
  synthetic polynucleotide sequence
gagagaaaggccaagtgga

SEQ ID NO: 6360 - DNA, 19 bp, Artificial sequence
  synthetic polynucleotide sequence
tgagacataaccccagcca

SEQ ID NO: 6361 - DNA, 16 bp, Artificial sequence
  synthetic polynucleotide sequence
ctgacaccctgcgaga

SEQ ID NO: 6362 - DNA, 22 bp, Artificial sequence
  synthetic polynucleotide sequence
ccagagactatagcgtggaaga

SEQ ID NO: 6363 - DNA, 16 bp, Artificial sequence
  synthetic polynucleotide sequence
cgcttctggaacggca

SEQ ID NO: 6364 - DNA, 19 bp, Artificial sequence
  synthetic polynucleotide sequence
ctggagctgaaggacagga

SEQ ID NO: 6365 - DNA, 18 bp, Artificial sequence
  synthetic polynucleotide sequence
tcaagcgcctggtcacca

SEQ ID NO: 6366 - DNA, 18 bp, Artificial sequence
  synthetic polynucleotide sequence
cttggctagccggaagga

SEQ ID NO: 6367 - DNA, 18 bp, Artificial sequence
  synthetic polynucleotide sequence
gcaggggccaaacaccaa

SEQ ID NO: 6368 - DNA, 18 bp, Artificial sequence
  synthetic polynucleotide sequence
gccttgatgggcagccca

SEQ ID NO: 6369 - DNA, 18 bp, Artificial sequence
  synthetic polynucleotide sequence
gtgggccgagtgcacaga

SEQ ID NO: 6370 - DNA, 18 bp, Artificial sequence
  synthetic polynucleotide sequence
ccgccgtaaggtactcca

SEQ ID NO: 6371 - DNA, 18 bp, Artificial sequence
  synthetic polynucleotide sequence
ggacagtgggaaggccaa

SEQ ID NO: 6372 - DNA, 18 bp, Artificial sequence
  synthetic polynucleotide sequence
tacacggcagcagtggca

SEQ ID NO: 6373 - DNA, 18 bp, Artificial sequence
  synthetic polynucleotide sequence
gaagggccactacgccga

SEQ ID NO: 6374 - DNA, 18 bp, Artificial sequence
  synthetic polynucleotide sequence
gccagctccaggatctca

SEQ ID NO: 6375 - DNA, 18 bp, Artificial sequence
  synthetic polynucleotide sequence
cacccaaccacagccgaa

SEQ ID NO: 6376 - DNA, 18 bp, Artificial sequence
  synthetic polynucleotide sequence
cggagccccactgaggga

SEQ ID NO: 6377 - DNA, 18 bp, Artificial sequence
  synthetic polynucleotide sequence
gcagagagccggcttgca

SEQ ID NO: 6378 - DNA, 18 bp, Artificial sequence
  synthetic polynucleotide sequence
gcgctgtacacagcggca

SEQ ID NO: 6379 - DNA, 18 bp, Artificial sequence
  synthetic polynucleotide sequence
gcttccagagcgcagcta

SEQ ID NO: 6380 - DNA, 18 bp, Artificial sequence
  synthetic polynucleotide sequence
tggcatggatagcacaca

SEQ ID NO: 6381 - DNA, 18 bp, Artificial sequence
  synthetic polynucleotide sequence
cgtcggtgcgctgcagga

SEQ ID NO: 6382 - DNA, 18 bp, Artificial sequence
  synthetic polynucleotide sequence
tagcgtggatggcacaca

SEQ ID NO: 6383 - DNA, 18 bp, Artificial sequence
  synthetic polynucleotide sequence
gggccaagtaccgagaga

SEQ ID NO: 6384 - DNA, 18 bp, Artificial sequence
  synthetic polynucleotide sequence
gtctgagagtgggacgca

SEQ ID NO: 6385 - DNA, 18 bp, Artificial sequence
  synthetic polynucleotide sequence
ctgcccactgcaccgaca

SEQ ID NO: 6386 - DNA, 18 bp, Artificial sequence
  synthetic polynucleotide sequence
ggacccatcaggcaagca

SEQ ID NO: 6387 - DNA, 18 bp, Artificial sequence
  synthetic polynucleotide sequence
ctgacaagcaggccagga

SEQ ID NO: 6388 - DNA, 18 bp, Artificial sequence
  synthetic polynucleotide sequence
caagcttcaacctgagga

SEQ ID NO: 6389 - DNA, 18 bp, Artificial sequence
  synthetic polynucleotide sequence
taggagccggttacccca

SEQ ID NO: 6390 - DNA, 18 bp, Artificial sequence
  synthetic polynucleotide sequence
catgccacccatccacga

SEQ ID NO: 6391 - DNA, 18 bp, Artificial sequence
  synthetic polynucleotide sequence
cacctgcagagggagaca

SEQ ID NO: 6392 - DNA, 18 bp, Artificial sequence
  synthetic polynucleotide sequence
gcgccatacagatccaca

SEQ ID NO: 6393 - DNA, 18 bp, Artificial sequence
  synthetic polynucleotide sequence
ggccactctgcagaccga

SEQ ID NO: 6394 - DNA, 18 bp, Artificial sequence
  synthetic polynucleotide sequence
gaggaaggacggatgcca

SEQ ID NO: 6395 - DNA, 18 bp, Artificial sequence
  synthetic polynucleotide sequence
ggtgtacgggggtgacga

SEQ ID NO: 6396 - DNA, 18 bp, Artificial sequence
  synthetic polynucleotide sequence
tagaacttcccgcagcca

SEQ ID NO: 6397 - DNA, 18 bp, Artificial sequence
  synthetic polynucleotide sequence
cgcagccacggaggacca

SEQ ID NO: 6398 - DNA, 19 bp, Artificial sequence
  synthetic polynucleotide sequence
cttacaacagagcgcacca

SEQ ID NO: 6399 - DNA, 18 bp, Artificial sequence
  synthetic polynucleotide sequence
gagacacccacttcccca

SEQ ID NO: 6400 - DNA, 18 bp, Artificial sequence
  synthetic polynucleotide sequence
cttgcagcacatcccaca

SEQ ID NO: 6401 - DNA, 18 bp, Artificial sequence
  synthetic polynucleotide sequence
ggagacgcactgagagca

SEQ ID NO: 6402 - DNA, 18 bp, Artificial sequence
  synthetic polynucleotide sequence
ccttggccagcacgtcca

SEQ ID NO: 6403 - DNA, 18 bp, Artificial sequence
  synthetic polynucleotide sequence
tggggctcgacaactcga

SEQ ID NO: 6404 - DNA, 18 bp, Artificial sequence
  synthetic polynucleotide sequence
aacacagccttggcgcca

SEQ ID NO: 6405 - DNA, 18 bp, Artificial sequence
  synthetic polynucleotide sequence
cggggtccgaactggcaa

SEQ ID NO: 6406 - DNA, 18 bp, Artificial sequence
  synthetic polynucleotide sequence
ggcagcctgtaagggcca

SEQ ID NO: 6407 - DNA, 18 bp, Artificial sequence
  synthetic polynucleotide sequence
ggagtcaggaactacgga

SEQ ID NO: 6408 - DNA, 18 bp, Artificial sequence
  synthetic polynucleotide sequence
gggtagcggacgctgcca

SEQ ID NO: 6409 - DNA, 18 bp, Artificial sequence
  synthetic polynucleotide sequence
gggatccgcagctacgga

SEQ ID NO: 6410 - DNA, 18 bp, Artificial sequence
  synthetic polynucleotide sequence
gcactggtctagccccga

SEQ ID NO: 6411 - DNA, 18 bp, Artificial sequence
  synthetic polynucleotide sequence
gatcgccaaggtgggaca

SEQ ID NO: 6412 - DNA, 18 bp, Artificial sequence
  synthetic polynucleotide sequence
taggatgcgggtgaacca

SEQ ID NO: 6413 - DNA, 18 bp, Artificial sequence
  synthetic polynucleotide sequence
caactacgggtatcgcca

SEQ ID NO: 6414 - DNA, 18 bp, Artificial sequence
  synthetic polynucleotide sequence
agcggtctagcagctgca

SEQ ID NO: 6415 - DNA, 18 bp, Artificial sequence
  synthetic polynucleotide sequence
cgaccccaaagggcgcaa

SEQ ID NO: 6416 - DNA, 18 bp, Artificial sequence
  synthetic polynucleotide sequence
gtgcagatgccacaagca

SEQ ID NO: 6417 - DNA, 18 bp, Artificial sequence
  synthetic polynucleotide sequence
aactcaggctggggagga

SEQ ID NO: 6418 - DNA, 18 bp, Artificial sequence
  synthetic polynucleotide sequence
aacatgcccaccagccca

SEQ ID NO: 6419 - DNA, 18 bp, Artificial sequence
  synthetic polynucleotide sequence
ccaaccgcatgctcagca

SEQ ID NO: 6420 - DNA, 18 bp, Artificial sequence
  synthetic polynucleotide sequence
ggaacaggccggagacca

SEQ ID NO: 6421 - DNA, 18 bp, Artificial sequence
  synthetic polynucleotide sequence
ggatgacctacgaagcga

SEQ ID NO: 6422 - DNA, 18 bp, Artificial sequence
  synthetic polynucleotide sequence
cctctaaggcagctggca

SEQ ID NO: 6423 - DNA, 18 bp, Artificial sequence
  synthetic polynucleotide sequence
ggagaagaaactggcaga

SEQ ID NO: 6424 - DNA, 18 bp, Artificial sequence
  synthetic polynucleotide sequence
gttgacaggctaccagca

SEQ ID NO: 6425 - DNA, 18 bp, Artificial sequence
  synthetic polynucleotide sequence
gagcaaagcacagcagca

SEQ ID NO: 6426 - DNA, 18 bp, Artificial sequence
  synthetic polynucleotide sequence
cgagctgcagtctagcca

SEQ ID NO: 6427 - DNA, 18 bp, Artificial sequence
  synthetic polynucleotide sequence
cccacgtcacctatcgga

SEQ ID NO: 6428 - DNA, 18 bp, Artificial sequence
  synthetic polynucleotide sequence
atacgccactgtcagaca

SEQ ID NO: 6429 - DNA, 17 bp, Artificial sequence
  synthetic polynucleotide sequence
caacgtggtgctcagga

SEQ ID NO: 6430 - DNA, 18 bp, Artificial sequence
  synthetic polynucleotide sequence
cggcagcagtagatccca

SEQ ID NO: 6431 - DNA, 18 bp, Artificial sequence
  synthetic polynucleotide sequence
atggcctatggaccccca

SEQ ID NO: 6432 - DNA, 18 bp, Artificial sequence
  synthetic polynucleotide sequence
gccaagaccctcctggga

SEQ ID NO: 6433 - DNA, 18 bp, Artificial sequence
  synthetic polynucleotide sequence
ggcaaagaattcacccca

SEQ ID NO: 6434 - DNA, 18 bp, Artificial sequence
  synthetic polynucleotide sequence
gggccagggcattagcca

SEQ ID NO: 6435 - DNA, 18 bp, Artificial sequence
  synthetic polynucleotide sequence
catggcaagaaggtgcta

SEQ ID NO: 6436 - DNA, 18 bp, Artificial sequence
  synthetic polynucleotide sequence
cacagtgcagctcactca

SEQ ID NO: 6437 - DNA, 18 bp, Artificial sequence
  synthetic polynucleotide sequence
ggccacaccaaacaagga

SEQ ID NO: 6438 - DNA, 18 bp, Artificial sequence
  synthetic polynucleotide sequence
actgggaggctcagccca

SEQ ID NO: 6439 - DNA, 18 bp, Artificial sequence
  synthetic polynucleotide sequence
ccacctgcacgcgtgcca

SEQ ID NO: 6440 - DNA, 18 bp, Artificial sequence
  synthetic polynucleotide sequence
gggcgagggttaccagca

SEQ ID NO: 6441 - DNA, 18 bp, Artificial sequence
  synthetic polynucleotide sequence
gcctgtggtggagaagga

SEQ ID NO: 6442 - DNA, 18 bp, Artificial sequence
  synthetic polynucleotide sequence
gctccaaggtcgcctcca

SEQ ID NO: 6443 - DNA, 18 bp, Artificial sequence
  synthetic polynucleotide sequence
cccgcacttcgacctgca

SEQ ID NO: 6444 - DNA, 18 bp, Artificial sequence
  synthetic polynucleotide sequence
tgaccgggtccacgcgca

SEQ ID NO: 6445 - DNA, 19 bp, Artificial sequence
  synthetic polynucleotide sequence
gccaagatcaagagagcca

SEQ ID NO: 6446 - DNA, 18 bp, Artificial sequence
  synthetic polynucleotide sequence
gaacgccaggtccaccga

SEQ ID NO: 6447 - DNA, 18 bp, Artificial sequence
  synthetic polynucleotide sequence
gagacaaatggaccggca

SEQ ID NO: 6448 - DNA, 18 bp, Artificial sequence
  synthetic polynucleotide sequence
acaccacggggtccagca

SEQ ID NO: 6449 - DNA, 18 bp, Artificial sequence
  synthetic polynucleotide sequence
aggactaccagttcacca

SEQ ID NO: 6450 - DNA, 18 bp, Artificial sequence
  synthetic polynucleotide sequence
tccaacgccaccaagcga

SEQ ID NO: 6451 - DNA, 18 bp, Artificial sequence
  synthetic polynucleotide sequence
tcactaccacgcaggcca

SEQ ID NO: 6452 - DNA, 18 bp, Artificial sequence
  synthetic polynucleotide sequence
gggtgatgatggccgaca

SEQ ID NO: 6453 - DNA, 18 bp, Artificial sequence
  synthetic polynucleotide sequence
gagtacacggctcgggaa

SEQ ID NO: 6454 - DNA, 18 bp, Artificial sequence
  synthetic polynucleotide sequence
cacgctccagagctcgga

SEQ ID NO: 6455 - DNA, 18 bp, Artificial sequence
  synthetic polynucleotide sequence
caggcatgagcaggagga

SEQ ID NO: 6456 - DNA, 18 bp, Artificial sequence
  synthetic polynucleotide sequence
gccacagccccagcccca

SEQ ID NO: 6457 - DNA, 18 bp, Artificial sequence
  synthetic polynucleotide sequence
accaacctgacccgggaa

SEQ ID NO: 6458 - DNA, 18 bp, Artificial sequence
  synthetic polynucleotide sequence
ccgtcacgggttgaggga

SEQ ID NO: 6459 - DNA, 18 bp, Artificial sequence
  synthetic polynucleotide sequence
tgcagcatgaccgggaga

SEQ ID NO: 6460 - DNA, 18 bp, Artificial sequence
  synthetic polynucleotide sequence
ggaagatggcagcaggca

SEQ ID NO: 6461 - DNA, 18 bp, Artificial sequence
  synthetic polynucleotide sequence
tggccctggatacggaga

SEQ ID NO: 6462 - DNA, 18 bp, Artificial sequence
  synthetic polynucleotide sequence
gggatggcgtcctcagga

SEQ ID NO: 6463 - DNA, 18 bp, Artificial sequence
  synthetic polynucleotide sequence
ggagaactccacacccca

SEQ ID NO: 6464 - DNA, 18 bp, Artificial sequence
  synthetic polynucleotide sequence
tcctctggggaggccaca

SEQ ID NO: 6465 - DNA, 18 bp, Artificial sequence
  synthetic polynucleotide sequence
gggcatcgtgaagcggga

SEQ ID NO: 6466 - DNA, 18 bp, Artificial sequence
  synthetic polynucleotide sequence
ccaatgagccccaggcca

SEQ ID NO: 6467 - DNA, 18 bp, Artificial sequence
  synthetic polynucleotide sequence
ccataaagccactgccga

SEQ ID NO: 6468 - DNA, 18 bp, Artificial sequence
  synthetic polynucleotide sequence
ccagcaactgaaccgcca

SEQ ID NO: 6469 - DNA, 18 bp, Artificial sequence
  synthetic polynucleotide sequence
cctcagcatccgagggca

SEQ ID NO: 6470 - DNA, 18 bp, Artificial sequence
  synthetic polynucleotide sequence
cgggcaacatttcggaca

SEQ ID NO: 6471 - DNA, 18 bp, Artificial sequence
  synthetic polynucleotide sequence
ggatccaccagctgagga

SEQ ID NO: 6472 - DNA, 18 bp, Artificial sequence
  synthetic polynucleotide sequence
ggggctcctgcacagaca

SEQ ID NO: 6473 - DNA, 18 bp, Artificial sequence
  synthetic polynucleotide sequence
gatgcccattgcccacga

SEQ ID NO: 6474 - DNA, 18 bp, Artificial sequence
  synthetic polynucleotide sequence
gcggtgacagagtagcca

SEQ ID NO: 6475 - DNA, 18 bp, Artificial sequence
  synthetic polynucleotide sequence
ggaccttggagctaggca

SEQ ID NO: 6476 - DNA, 18 bp, Artificial sequence
  synthetic polynucleotide sequence
aatggggacaccagggca

SEQ ID NO: 6477 - DNA, 18 bp, Artificial sequence
  synthetic polynucleotide sequence
ggacgtgcaccatggcaa

SEQ ID NO: 6478 - DNA, 18 bp, Artificial sequence
  synthetic polynucleotide sequence
acctcatccacagcccca

SEQ ID NO: 6479 - DNA, 18 bp, Artificial sequence
  synthetic polynucleotide sequence
acgatcacagctgcccaa

SEQ ID NO: 6480 - DNA, 18 bp, Artificial sequence
  synthetic polynucleotide sequence
tgtgcagggacacggtca

SEQ ID NO: 6481 - DNA, 18 bp, Artificial sequence
  synthetic polynucleotide sequence
ctggaacccacgcacaca

SEQ ID NO: 6482 - DNA, 18 bp, Artificial sequence
  synthetic polynucleotide sequence
aacagaggcagcagggga

SEQ ID NO: 6483 - DNA, 18 bp, Artificial sequence
  synthetic polynucleotide sequence
tccagtccaggccaggaa

SEQ ID NO: 6484 - DNA, 18 bp, Artificial sequence
  synthetic polynucleotide sequence
tgcaactgagggagcgca

SEQ ID NO: 6485 - DNA, 18 bp, Artificial sequence
  synthetic polynucleotide sequence
gcacatgacccagcccaa

SEQ ID NO: 6486 - DNA, 18 bp, Artificial sequence
  synthetic polynucleotide sequence
ggctaatgggcagtcgga

SEQ ID NO: 6487 - DNA, 18 bp, Artificial sequence
  synthetic polynucleotide sequence
gccaaggcaccttccaga

SEQ ID NO: 6488 - DNA, 18 bp, Artificial sequence
  synthetic polynucleotide sequence
ggagggtcttgggagcca

SEQ ID NO: 6489 - DNA, 18 bp, Artificial sequence
  synthetic polynucleotide sequence
cggcatgacggatccaga

SEQ ID NO: 6490 - DNA, 18 bp, Artificial sequence
  synthetic polynucleotide sequence
actgcagccaggtgacca

SEQ ID NO: 6491 - DNA, 18 bp, Artificial sequence
  synthetic polynucleotide sequence
aagtcccgagctgacgga

SEQ ID NO: 6492 - DNA, 18 bp, Artificial sequence
  synthetic polynucleotide sequence
ggttctccaggagcagca

SEQ ID NO: 6493 - DNA, 18 bp, Artificial sequence
  synthetic polynucleotide sequence
gatgtgcagacctgggca

SEQ ID NO: 6494 - DNA, 18 bp, Artificial sequence
  synthetic polynucleotide sequence
cagcatgagtaggaggca

SEQ ID NO: 6495 - DNA, 18 bp, Artificial sequence
  synthetic polynucleotide sequence
caatgcccaaggtcgcaa

SEQ ID NO: 6496 - DNA, 18 bp, Artificial sequence
  synthetic polynucleotide sequence
tcattggggaacacagca

SEQ ID NO: 6497 - DNA, 18 bp, Artificial sequence
  synthetic polynucleotide sequence
ggatggcagctggcacca

SEQ ID NO: 6498 - DNA, 18 bp, Artificial sequence
  synthetic polynucleotide sequence
gatcaccggcttcccaca

SEQ ID NO: 6499 - DNA, 18 bp, Artificial sequence
  synthetic polynucleotide sequence
agtggaggacccagcaca

SEQ ID NO: 6500 - DNA, 18 bp, Artificial sequence
  synthetic polynucleotide sequence
cgaagaggcctcgctcca

SEQ ID NO: 6501 - DNA, 18 bp, Artificial sequence
  synthetic polynucleotide sequence
gccatgctagaagaggaa

SEQ ID NO: 6502 - DNA, 18 bp, Artificial sequence
  synthetic polynucleotide sequence
ctatcccaagacatgcga

SEQ ID NO: 6503 - DNA, 18 bp, Artificial sequence
  synthetic polynucleotide sequence
ggagatggtggccagcaa

SEQ ID NO: 6504 - DNA, 18 bp, Artificial sequence
  synthetic polynucleotide sequence
ggatctgcatgcccagca

SEQ ID NO: 6505 - DNA, 18 bp, Artificial sequence
  synthetic polynucleotide sequence
tcgtgacacccaacggga

SEQ ID NO: 6506 - DNA, 18 bp, Artificial sequence
  synthetic polynucleotide sequence
gccagctgcttccagaca

SEQ ID NO: 6507 - DNA, 18 bp, Artificial sequence
  synthetic polynucleotide sequence
cccaagccagcccacaga

SEQ ID NO: 6508 - DNA, 18 bp, Artificial sequence
  synthetic polynucleotide sequence
cagctcctgagagagaca

SEQ ID NO: 6509 - DNA, 18 bp, Artificial sequence
  synthetic polynucleotide sequence
gtggggaaagaacagcca

SEQ ID NO: 6510 - DNA, 18 bp, Artificial sequence
  synthetic polynucleotide sequence
tacgcccactgagggcca

SEQ ID NO: 6511 - DNA, 18 bp, Artificial sequence
  synthetic polynucleotide sequence
ctgcaagctgggcagcca

SEQ ID NO: 6512 - DNA, 18 bp, Artificial sequence
  synthetic polynucleotide sequence
gtgtagacggggatgaca

SEQ ID NO: 6513 - DNA, 18 bp, Artificial sequence
  synthetic polynucleotide sequence
cgggatccccaataccca

SEQ ID NO: 6514 - DNA, 18 bp, Artificial sequence
  synthetic polynucleotide sequence
ccctcagcaggagcctga

SEQ ID NO: 6515 - DNA, 18 bp, Artificial sequence
  synthetic polynucleotide sequence
ctgcagctcatcagggaa

SEQ ID NO: 6516 - DNA, 18 bp, Artificial sequence
  synthetic polynucleotide sequence
gggtgatccaccacgcta

SEQ ID NO: 6517 - DNA, 18 bp, Artificial sequence
  synthetic polynucleotide sequence
cgaaaggctgtggagcaa

SEQ ID NO: 6518 - DNA, 18 bp, Artificial sequence
  synthetic polynucleotide sequence
aggggttgggcctggaca

SEQ ID NO: 6519 - DNA, 18 bp, Artificial sequence
  synthetic polynucleotide sequence
gcggtactcagaaacaga

SEQ ID NO: 6520 - DNA, 18 bp, Artificial sequence
  synthetic polynucleotide sequence
agtctctcaccaacagca

SEQ ID NO: 6521 - DNA, 18 bp, Artificial sequence
  synthetic polynucleotide sequence
agaagggggtgaggagga

SEQ ID NO: 6522 - DNA, 18 bp, Artificial sequence
  synthetic polynucleotide sequence
ccgagaagtcccgctgca

SEQ ID NO: 6523 - DNA, 18 bp, Artificial sequence
  synthetic polynucleotide sequence
acggcctcacccacggaa

SEQ ID NO: 6524 - DNA, 18 bp, Artificial sequence
  synthetic polynucleotide sequence
aggccgacagggaggcca

SEQ ID NO: 6525 - DNA, 18 bp, Artificial sequence
  synthetic polynucleotide sequence
agccctgctccagcccaa

SEQ ID NO: 6526 - DNA, 18 bp, Artificial sequence
  synthetic polynucleotide sequence
aggtggagagaggtggca

SEQ ID NO: 6527 - DNA, 18 bp, Artificial sequence
  synthetic polynucleotide sequence
gggcatcttccacccgga

SEQ ID NO: 6528 - DNA, 18 bp, Artificial sequence
  synthetic polynucleotide sequence
agccacgtaagcagccga

SEQ ID NO: 6529 - DNA, 19 bp, Artificial sequence
  synthetic polynucleotide sequence
ggattggagagcagcagaa

SEQ ID NO: 6530 - DNA, 19 bp, Artificial sequence
  synthetic polynucleotide sequence
ggtcactgaagaggtcaca

SEQ ID NO: 6531 - DNA, 18 bp, Artificial sequence
  synthetic polynucleotide sequence
ctgggaaccatgtggaga

SEQ ID NO: 6532 - DNA, 18 bp, Artificial sequence
  synthetic polynucleotide sequence
gttcagctgagaaggcca

SEQ ID NO: 6533 - DNA, 18 bp, Artificial sequence
  synthetic polynucleotide sequence
gagaaggctacaggggca

SEQ ID NO: 6534 - DNA, 18 bp, Artificial sequence
  synthetic polynucleotide sequence
agcagtagccaactcgga

SEQ ID NO: 6535 - DNA, 18 bp, Artificial sequence
  synthetic polynucleotide sequence
cttcaaccgcacgacgga

SEQ ID NO: 6536 - DNA, 18 bp, Artificial sequence
  synthetic polynucleotide sequence
ctgcgagcgtgtggcaca

SEQ ID NO: 6537 - DNA, 18 bp, Artificial sequence
  synthetic polynucleotide sequence
aggggctgtggacaggaa

SEQ ID NO: 6538 - DNA, 18 bp, Artificial sequence
  synthetic polynucleotide sequence
agagggcagtggcgacga

SEQ ID NO: 6539 - DNA, 18 bp, Artificial sequence
  synthetic polynucleotide sequence
ggagaaccctcaaagcaa

SEQ ID NO: 6540 - DNA, 18 bp, Artificial sequence
  synthetic polynucleotide sequence
ggaggcaggggagggcga

SEQ ID NO: 6541 - DNA, 18 bp, Artificial sequence
  synthetic polynucleotide sequence
caagtcagaggaccagca

SEQ ID NO: 6542 - DNA, 18 bp, Artificial sequence
  synthetic polynucleotide sequence
aagagacgttgcgagcca

SEQ ID NO: 6543 - DNA, 18 bp, Artificial sequence
  synthetic polynucleotide sequence
cgacgtggaccgtaagga

SEQ ID NO: 6544 - DNA, 18 bp, Artificial sequence
  synthetic polynucleotide sequence
gccacggtcgaaggagca

SEQ ID NO: 6545 - DNA, 18 bp, Artificial sequence
  synthetic polynucleotide sequence
ggcaggctcacatggcaa

SEQ ID NO: 6546 - DNA, 18 bp, Artificial sequence
  synthetic polynucleotide sequence
gtccacagcacaacgcca

SEQ ID NO: 6547 - DNA, 18 bp, Artificial sequence
  synthetic polynucleotide sequence
ccgagtccaaccaaggca

SEQ ID NO: 6548 - DNA, 18 bp, Artificial sequence
  synthetic polynucleotide sequence
gaagagtggctgaggaca

SEQ ID NO: 6549 - DNA, 18 bp, Artificial sequence
  synthetic polynucleotide sequence
agccaggaggagcagaca

SEQ ID NO: 6550 - DNA, 18 bp, Artificial sequence
  synthetic polynucleotide sequence
gcactgggacagcgctca

SEQ ID NO: 6551 - DNA, 18 bp, Artificial sequence
  synthetic polynucleotide sequence
cacgatctgggaacctca

SEQ ID NO: 6552 - DNA, 18 bp, Artificial sequence
  synthetic polynucleotide sequence
ccagtcccaacagctcca

SEQ ID NO: 6553 - DNA, 18 bp, Artificial sequence
  synthetic polynucleotide sequence
gtagcagcgaggacccca

SEQ ID NO: 6554 - DNA, 18 bp, Artificial sequence
  synthetic polynucleotide sequence
tgccgcacggaatgcaca

SEQ ID NO: 6555 - DNA, 18 bp, Artificial sequence
  synthetic polynucleotide sequence
tgcactgcacaggccaca

SEQ ID NO: 6556 - DNA, 18 bp, Artificial sequence
  synthetic polynucleotide sequence
tcagcaccaagcaggtca

SEQ ID NO: 6557 - DNA, 18 bp, Artificial sequence
  synthetic polynucleotide sequence
cctctcaggacaacccca

SEQ ID NO: 6558 - DNA, 18 bp, Artificial sequence
  synthetic polynucleotide sequence
cccctggggcttcagaca

SEQ ID NO: 6559 - DNA, 18 bp, Artificial sequence
  synthetic polynucleotide sequence
gaagatcatccgcaagga

SEQ ID NO: 6560 - DNA, 18 bp, Artificial sequence
  synthetic polynucleotide sequence
ttcaggcccagatcagca

SEQ ID NO: 6561 - DNA, 18 bp, Artificial sequence
  synthetic polynucleotide sequence
ctggacaagagcctccca

SEQ ID NO: 6562 - DNA, 18 bp, Artificial sequence
  synthetic polynucleotide sequence
gcctggctaatccgagga

SEQ ID NO: 6563 - DNA, 18 bp, Artificial sequence
  synthetic polynucleotide sequence
ctggccagcacagaggaa

SEQ ID NO: 6564 - DNA, 18 bp, Artificial sequence
  synthetic polynucleotide sequence
atctgcagacccagcgca

SEQ ID NO: 6565 - DNA, 18 bp, Artificial sequence
  synthetic polynucleotide sequence
gagacctcctggagagca

SEQ ID NO: 6566 - DNA, 18 bp, Artificial sequence
  synthetic polynucleotide sequence
gcagctggagactggaca

SEQ ID NO: 6567 - DNA, 18 bp, Artificial sequence
  synthetic polynucleotide sequence
ctcctgccgagacagcca

SEQ ID NO: 6568 - DNA, 18 bp, Artificial sequence
  synthetic polynucleotide sequence
gctccttagaagcagcca

SEQ ID NO: 6569 - DNA, 18 bp, Artificial sequence
  synthetic polynucleotide sequence
aagctcgggcaaaagcta

SEQ ID NO: 6570 - DNA, 18 bp, Artificial sequence
  synthetic polynucleotide sequence
attccagcaccgctgcca

SEQ ID NO: 6571 - DNA, 18 bp, Artificial sequence
  synthetic polynucleotide sequence
catccgcaacgacgagga

SEQ ID NO: 6572 - DNA, 18 bp, Artificial sequence
  synthetic polynucleotide sequence
atgttgggcaggacacca

SEQ ID NO: 6573 - DNA, 18 bp, Artificial sequence
  synthetic polynucleotide sequence
caccggcatctcatccaa

SEQ ID NO: 6574 - DNA, 18 bp, Artificial sequence
  synthetic polynucleotide sequence
gtagtgagccaggcgaga

SEQ ID NO: 6575 - DNA, 18 bp, Artificial sequence
  synthetic polynucleotide sequence
acaacaagcgctcgacca

SEQ ID NO: 6576 - DNA, 18 bp, Artificial sequence
  synthetic polynucleotide sequence
tggccagctctccgggaa

SEQ ID NO: 6577 - DNA, 18 bp, Artificial sequence
  synthetic polynucleotide sequence
catccaaggccatgggca

SEQ ID NO: 6578 - DNA, 18 bp, Artificial sequence
  synthetic polynucleotide sequence
gtagtgggccagacggga

SEQ ID NO: 6579 - DNA, 18 bp, Artificial sequence
  synthetic polynucleotide sequence
cagccgcaaggagagcta

SEQ ID NO: 6580 - DNA, 18 bp, Artificial sequence
  synthetic polynucleotide sequence
cacccgcgatgcgttcga

SEQ ID NO: 6581 - DNA, 18 bp, Artificial sequence
  synthetic polynucleotide sequence
tccaccccgacaccggca

SEQ ID NO: 6582 - DNA, 18 bp, Artificial sequence
  synthetic polynucleotide sequence
tcgccagcgatgcgctca

SEQ ID NO: 6583 - DNA, 18 bp, Artificial sequence
  synthetic polynucleotide sequence
ccagcgcctggtgcgaga

SEQ ID NO: 6584 - DNA, 18 bp, Artificial sequence
  synthetic polynucleotide sequence
tgcagcgccatcaccgca

SEQ ID NO: 6585 - DNA, 18 bp, Artificial sequence
  synthetic polynucleotide sequence
ggagaacgtgatccggga

SEQ ID NO: 6586 - DNA, 18 bp, Artificial sequence
  synthetic polynucleotide sequence
ccacatccatggcagtga

SEQ ID NO: 6587 - DNA, 18 bp, Artificial sequence
  synthetic polynucleotide sequence
gcggtggcgtcaagcgca

SEQ ID NO: 6588 - DNA, 18 bp, Artificial sequence
  synthetic polynucleotide sequence
aggtgacggcgtctcgaa

SEQ ID NO: 6589 - DNA, 18 bp, Artificial sequence
  synthetic polynucleotide sequence
gcgataacatccagggca

SEQ ID NO: 6590 - DNA, 18 bp, Artificial sequence
  synthetic polynucleotide sequence
taagtgacagcgtcacga

SEQ ID NO: 6591 - DNA, 18 bp, Artificial sequence
  synthetic polynucleotide sequence
gtatcaccaagccagcca

SEQ ID NO: 6592 - DNA, 18 bp, Artificial sequence
  synthetic polynucleotide sequence
gcgcgtagaccacgtcca

SEQ ID NO: 6593 - DNA, 18 bp, Artificial sequence
  synthetic polynucleotide sequence
gcaccggttgctccgcaa

SEQ ID NO: 6594 - DNA, 18 bp, Artificial sequence
  synthetic polynucleotide sequence
cggcagtcaagtactcga

SEQ ID NO: 6595 - DNA, 18 bp, Artificial sequence
  synthetic polynucleotide sequence
gcaccagacggtgaagga

SEQ ID NO: 6596 - DNA, 18 bp, Artificial sequence
  synthetic polynucleotide sequence
tgcgtaaccgcacgccca

SEQ ID NO: 6597 - DNA, 18 bp, Artificial sequence
  synthetic polynucleotide sequence
gcacctgtgacgacagca

SEQ ID NO: 6598 - DNA, 18 bp, Artificial sequence
  synthetic polynucleotide sequence
gggtcccatccacaccca

SEQ ID NO: 6599 - DNA, 18 bp, Artificial sequence
  synthetic polynucleotide sequence
ggtggagaagatccggga

SEQ ID NO: 6600 - DNA, 18 bp, Artificial sequence
  synthetic polynucleotide sequence
aggcaacagcggtgacca

SEQ ID NO: 6601 - DNA, 18 bp, Artificial sequence
  synthetic polynucleotide sequence
gcacgtgtgaggacagca

SEQ ID NO: 6602 - DNA, 18 bp, Artificial sequence
  synthetic polynucleotide sequence
gtgccgtccacacccaca

SEQ ID NO: 6603 - DNA, 18 bp, Artificial sequence
  synthetic polynucleotide sequence
gccttctggagaggagca

SEQ ID NO: 6604 - DNA, 18 bp, Artificial sequence
  synthetic polynucleotide sequence
tacaagctgtgagggaca

SEQ ID NO: 6605 - DNA, 18 bp, Artificial sequence
  synthetic polynucleotide sequence
gaccagaccagcaggaga

SEQ ID NO: 6606 - DNA, 18 bp, Artificial sequence
  synthetic polynucleotide sequence
cagcgaccacagctccga

SEQ ID NO: 6607 - DNA, 17 bp, Artificial sequence
  synthetic polynucleotide sequence
atcacactgacctggca

SEQ ID NO: 6608 - DNA, 18 bp, Artificial sequence
  synthetic polynucleotide sequence
cttgtccagaaggcacca

SEQ ID NO: 6609 - DNA, 19 bp, Artificial sequence
  synthetic polynucleotide sequence
attgaccgctacacagcaa

SEQ ID NO: 6610 - DNA, 19 bp, Artificial sequence
  synthetic polynucleotide sequence
atgagaacaatgcccacga

SEQ ID NO: 6611 - DNA, 19 bp, Artificial sequence
  synthetic polynucleotide sequence
ctcacagcacctcaaccaa

SEQ ID NO: 6612 - DNA, 19 bp, Artificial sequence
  synthetic polynucleotide sequence
atagcaggccagcatcaca

SEQ ID NO: 6613 - DNA, 18 bp, Artificial sequence
  synthetic polynucleotide sequence
tgactgccaggtggagca

SEQ ID NO: 6614 - DNA, 18 bp, Artificial sequence
  synthetic polynucleotide sequence
accagggtctccatggca

SEQ ID NO: 6615 - DNA, 17 bp, Artificial sequence
  synthetic polynucleotide sequence
gaatgggcaggaggaga

SEQ ID NO: 6616 - DNA, 18 bp, Artificial sequence
  synthetic polynucleotide sequence
cagaaacagggctcagca

SEQ ID NO: 6617 - DNA, 18 bp, Artificial sequence
  synthetic polynucleotide sequence
aagcactgggaggcccaa

SEQ ID NO: 6618 - DNA, 18 bp, Artificial sequence
  synthetic polynucleotide sequence
tgcccacgatgatgccga

SEQ ID NO: 6619 - DNA, 18 bp, Artificial sequence
  synthetic polynucleotide sequence
ggagcacaccagcctgga

SEQ ID NO: 6620 - DNA, 18 bp, Artificial sequence
  synthetic polynucleotide sequence
cccagcacgaagccccca

SEQ ID NO: 6621 - DNA, 18 bp, Artificial sequence
  synthetic polynucleotide sequence
tgactgcaaggtggagca

SEQ ID NO: 6622 - DNA, 18 bp, Artificial sequence
  synthetic polynucleotide sequence
aagcaccaactgaacgca

SEQ ID NO: 6623 - DNA, 18 bp, Artificial sequence
  synthetic polynucleotide sequence
ccagcctccagagcccca

SEQ ID NO: 6624 - DNA, 18 bp, Artificial sequence
  synthetic polynucleotide sequence
gacggatgataaggccca

SEQ ID NO: 6625 - DNA, 18 bp, Artificial sequence
  synthetic polynucleotide sequence
cgactgcagggtggagca

SEQ ID NO: 6626 - DNA, 18 bp, Artificial sequence
  synthetic polynucleotide sequence
tgatgcccaccagaccca

SEQ ID NO: 6627 - DNA, 18 bp, Artificial sequence
  synthetic polynucleotide sequence
gacccagcccctgcagca

SEQ ID NO: 6628 - DNA, 18 bp, Artificial sequence
  synthetic polynucleotide sequence
ggatcaggcctgtggaca

SEQ ID NO: 6629 - DNA, 19 bp, Artificial sequence
  synthetic polynucleotide sequence
ccacaggcctgattcagaa

SEQ ID NO: 6630 - DNA, 17 bp, Artificial sequence
  synthetic polynucleotide sequence
cccgactccactcagca

SEQ ID NO: 6631 - DNA, 18 bp, Artificial sequence
  synthetic polynucleotide sequence
gcatgaggggctacccga

SEQ ID NO: 6632 - DNA, 18 bp, Artificial sequence
  synthetic polynucleotide sequence
gactcagacccctgggca

SEQ ID NO: 6633 - DNA, 18 bp, Artificial sequence
  synthetic polynucleotide sequence
gaacagacccaggacaca

SEQ ID NO: 6634 - DNA, 18 bp, Artificial sequence
  synthetic polynucleotide sequence
tccacatcacagcagcga

SEQ ID NO: 6635 - DNA, 18 bp, Artificial sequence
  synthetic polynucleotide sequence
tggagctcgtggagacca

SEQ ID NO: 6636 - DNA, 18 bp, Artificial sequence
  synthetic polynucleotide sequence
tccacagcacagcagcga

SEQ ID NO: 6637 - DNA, 18 bp, Artificial sequence
  synthetic polynucleotide sequence
cagagccccatcagacca

SEQ ID NO: 6638 - DNA, 18 bp, Artificial sequence
  synthetic polynucleotide sequence
aacccactgggacctgga

SEQ ID NO: 6639 - DNA, 18 bp, Artificial sequence
  synthetic polynucleotide sequence
aatgcgctaatgcacgca

SEQ ID NO: 6640 - DNA, 18 bp, Artificial sequence
  synthetic polynucleotide sequence
gggccatggaaccatcca

SEQ ID NO: 6641 - DNA, 19 bp, Artificial sequence
  synthetic polynucleotide sequence
ggagtctagacggctcaga

SEQ ID NO: 6642 - DNA, 19 bp, Artificial sequence
  synthetic polynucleotide sequence
cgagcagtgatgcctacca

SEQ ID NO: 6643 - DNA, 18 bp, Artificial sequence
  synthetic polynucleotide sequence
gacgtgtaacggagggca

SEQ ID NO: 6644 - DNA, 18 bp, Artificial sequence
  synthetic polynucleotide sequence
tccacaggaggcagagca

SEQ ID NO: 6645 - DNA, 18 bp, Artificial sequence
  synthetic polynucleotide sequence
aggaaaccaaggggcaga

SEQ ID NO: 6646 - DNA, 18 bp, Artificial sequence
  synthetic polynucleotide sequence
ctccgaggactcctgcga

SEQ ID NO: 6647 - DNA, 18 bp, Artificial sequence
  synthetic polynucleotide sequence
gaagcctgctcaggagga

SEQ ID NO: 6648 - DNA, 18 bp, Artificial sequence
  synthetic polynucleotide sequence
agtggaaagaccatggca

SEQ ID NO: 6649 - DNA, 18 bp, Artificial sequence
  synthetic polynucleotide sequence
ggatcccaatgcacccaa

SEQ ID NO: 6650 - DNA, 18 bp, Artificial sequence
  synthetic polynucleotide sequence
cgcaacatcaccaatgga

SEQ ID NO: 6651 - DNA, 18 bp, Artificial sequence
  synthetic polynucleotide sequence
ctcgctatgacagggaga

SEQ ID NO: 6652 - DNA, 18 bp, Artificial sequence
  synthetic polynucleotide sequence
gggcgatgttcagagcaa

SEQ ID NO: 6653 - DNA, 18 bp, Artificial sequence
  synthetic polynucleotide sequence
tctccctgggggacacca

SEQ ID NO: 6654 - DNA, 18 bp, Artificial sequence
  synthetic polynucleotide sequence
ccacgacactcactccca

SEQ ID NO: 6655 - DNA, 18 bp, Artificial sequence
  synthetic polynucleotide sequence
acaacgcccatgcagcaa

SEQ ID NO: 6656 - DNA, 18 bp, Artificial sequence
  synthetic polynucleotide sequence
ggttggtcccaccaccca

SEQ ID NO: 6657 - DNA, 18 bp, Artificial sequence
  synthetic polynucleotide sequence
gctcagagaggacaccca

SEQ ID NO: 6658 - DNA, 18 bp, Artificial sequence
  synthetic polynucleotide sequence
agtgggacgccgagcgta

SEQ ID NO: 6659 - DNA, 18 bp, Artificial sequence
  synthetic polynucleotide sequence
tggcctcggagtacccaa

SEQ ID NO: 6660 - DNA, 18 bp, Artificial sequence
  synthetic polynucleotide sequence
catcaggcgagccagaga

SEQ ID NO: 6661 - DNA, 18 bp, Artificial sequence
  synthetic polynucleotide sequence
gagaaaggctgaagggga

SEQ ID NO: 6662 - DNA, 18 bp, Artificial sequence
  synthetic polynucleotide sequence
agcagacaacctcgcgga

SEQ ID NO: 6663 - DNA, 18 bp, Artificial sequence
  synthetic polynucleotide sequence
gccccacgacatcagcaa

SEQ ID NO: 6664 - DNA, 18 bp, Artificial sequence
  synthetic polynucleotide sequence
gtggtagaggcggaagga

SEQ ID NO: 6665 - DNA, 19 bp, Artificial sequence
  synthetic polynucleotide sequence
gtgccaccaagttcaagca

SEQ ID NO: 6666 - DNA, 19 bp, Artificial sequence
  synthetic polynucleotide sequence
gatgttgagcaggaacgca

SEQ ID NO: 6667 - DNA, 18 bp, Artificial sequence
  synthetic polynucleotide sequence
ccacactggccagagaga

SEQ ID NO: 6668 - DNA, 18 bp, Artificial sequence
  synthetic polynucleotide sequence
gtccagcagctagggcca

SEQ ID NO: 6669 - DNA, 18 bp, Artificial sequence
  synthetic polynucleotide sequence
aaatccccctggcggcaa

SEQ ID NO: 6670 - DNA, 18 bp, Artificial sequence
  synthetic polynucleotide sequence
gcagttcacaagcatgga

SEQ ID NO: 6671 - DNA, 18 bp, Artificial sequence
  synthetic polynucleotide sequence
ctacagccacaagcccga

SEQ ID NO: 6672 - DNA, 18 bp, Artificial sequence
  synthetic polynucleotide sequence
aagcccggactcactgga

SEQ ID NO: 6673 - DNA, 18 bp, Artificial sequence
  synthetic polynucleotide sequence
agcaagtctccccagcca

SEQ ID NO: 6674 - DNA, 18 bp, Artificial sequence
  synthetic polynucleotide sequence
aggtgctgactgggggca

SEQ ID NO: 6675 - DNA, 18 bp, Artificial sequence
  synthetic polynucleotide sequence
ctcggagccaccaagaga

SEQ ID NO: 6676 - DNA, 18 bp, Artificial sequence
  synthetic polynucleotide sequence
gcagctcctggaagggca

SEQ ID NO: 6677 - DNA, 18 bp, Artificial sequence
  synthetic polynucleotide sequence
acaagaagctgccaggca

SEQ ID NO: 6678 - DNA, 18 bp, Artificial sequence
  synthetic polynucleotide sequence
cacctgcacctccgccta

SEQ ID NO: 6679 - DNA, 18 bp, Artificial sequence
  synthetic polynucleotide sequence
ccctgtcaaagcaagaga

SEQ ID NO: 6680 - DNA, 18 bp, Artificial sequence
  synthetic polynucleotide sequence
tagccatccccactgcca

SEQ ID NO: 6681 - DNA, 18 bp, Artificial sequence
  synthetic polynucleotide sequence
cagggtgggggctacgga

SEQ ID NO: 6682 - DNA, 18 bp, Artificial sequence
  synthetic polynucleotide sequence
ctcccaccataaccccca

SEQ ID NO: 6683 - DNA, 18 bp, Artificial sequence
  synthetic polynucleotide sequence
gacccatgaaagggggca

SEQ ID NO: 6684 - DNA, 18 bp, Artificial sequence
  synthetic polynucleotide sequence
ccaccacttccaccacca

SEQ ID NO: 6685 - DNA, 18 bp, Artificial sequence
  synthetic polynucleotide sequence
gtgaaccgaggaaaagca

SEQ ID NO: 6686 - DNA, 18 bp, Artificial sequence
  synthetic polynucleotide sequence
acagcccgagcaatagga

SEQ ID NO: 6687 - DNA, 18 bp, Artificial sequence
  synthetic polynucleotide sequence
gaggcaccgaagggggca

SEQ ID NO: 6688 - DNA, 18 bp, Artificial sequence
  synthetic polynucleotide sequence
agagtgtcgtggggagga

SEQ ID NO: 6689 - DNA, 18 bp, Artificial sequence
  synthetic polynucleotide sequence
accgacctgttcgggaga

SEQ ID NO: 6690 - DNA, 18 bp, Artificial sequence
  synthetic polynucleotide sequence
aggcccctcatgtggaca

SEQ ID NO: 6691 - DNA, 18 bp, Artificial sequence
  synthetic polynucleotide sequence
ggctctaggggtggcaga

SEQ ID NO: 6692 - DNA, 18 bp, Artificial sequence
  synthetic polynucleotide sequence
cccccacgattgccccga

SEQ ID NO: 6693 - DNA, 18 bp, Artificial sequence
  synthetic polynucleotide sequence
aggaggagcccctgggaa

SEQ ID NO: 6694 - DNA, 18 bp, Artificial sequence
  synthetic polynucleotide sequence
ggatagccgattccacca

SEQ ID NO: 6695 - DNA, 18 bp, Artificial sequence
  synthetic polynucleotide sequence
tgtcaacgggacggacga

SEQ ID NO: 6696 - DNA, 18 bp, Artificial sequence
  synthetic polynucleotide sequence
gcgctctgcgtcaaggca

SEQ ID NO: 6697 - DNA, 18 bp, Artificial sequence
  synthetic polynucleotide sequence
gggcggagctgtgcgaga

SEQ ID NO: 6698 - DNA, 18 bp, Artificial sequence
  synthetic polynucleotide sequence
agaacctgggccatcaca

SEQ ID NO: 6699 - DNA, 18 bp, Artificial sequence
  synthetic polynucleotide sequence
cagctcaacgagacccaa

SEQ ID NO: 6700 - DNA, 18 bp, Artificial sequence
  synthetic polynucleotide sequence
tggccggagagatgggca

SEQ ID NO: 6701 - DNA, 18 bp, Artificial sequence
  synthetic polynucleotide sequence
gcgctgcccctataccaa

SEQ ID NO: 6702 - DNA, 18 bp, Artificial sequence
  synthetic polynucleotide sequence
gcatgcgggacagttgca

SEQ ID NO: 6703 - DNA, 18 bp, Artificial sequence
  synthetic polynucleotide sequence
acgggaatacgccacgaa

SEQ ID NO: 6704 - DNA, 18 bp, Artificial sequence
  synthetic polynucleotide sequence
tgacctgccgctcagaga

SEQ ID NO: 6705 - DNA, 18 bp, Artificial sequence
  synthetic polynucleotide sequence
gctatgggaccccacaca

SEQ ID NO: 6706 - DNA, 18 bp, Artificial sequence
  synthetic polynucleotide sequence
cggcacccccatagtcca

SEQ ID NO: 6707 - DNA, 18 bp, Artificial sequence
  synthetic polynucleotide sequence
gtcggccagaaggggtga

SEQ ID NO: 6708 - DNA, 18 bp, Artificial sequence
  synthetic polynucleotide sequence
tcaactggaggagaacca

SEQ ID NO: 6709 - DNA, 18 bp, Artificial sequence
  synthetic polynucleotide sequence
cacaaggcagctgacaga

SEQ ID NO: 6710 - DNA, 18 bp, Artificial sequence
  synthetic polynucleotide sequence
agctccagggtggcggca

SEQ ID NO: 6711 - DNA, 18 bp, Artificial sequence
  synthetic polynucleotide sequence
ggacgcgcctccagccaa

SEQ ID NO: 6712 - DNA, 18 bp, Artificial sequence
  synthetic polynucleotide sequence
gtaagggtggtagacgga

SEQ ID NO: 6713 - DNA, 18 bp, Artificial sequence
  synthetic polynucleotide sequence
gcatgtacagcgcagaga

SEQ ID NO: 6714 - DNA, 18 bp, Artificial sequence
  synthetic polynucleotide sequence
cgcggtagtagctgggca

SEQ ID NO: 6715 - DNA, 18 bp, Artificial sequence
  synthetic polynucleotide sequence
cttccaccgtcaccgaga

SEQ ID NO: 6716 - DNA, 18 bp, Artificial sequence
  synthetic polynucleotide sequence
ggtcgaaggcttgaggca

SEQ ID NO: 6717 - DNA, 18 bp, Artificial sequence
  synthetic polynucleotide sequence
cgtcgaaggctaccagca

SEQ ID NO: 6718 - DNA, 18 bp, Artificial sequence
  synthetic polynucleotide sequence
gggaaccacgtctgggaa

SEQ ID NO: 6719 - DNA, 18 bp, Artificial sequence
  synthetic polynucleotide sequence
ccgcgaactggaacgcga

SEQ ID NO: 6720 - DNA, 18 bp, Artificial sequence
  synthetic polynucleotide sequence
gaggttgagcatccgaga

SEQ ID NO: 6721 - DNA, 18 bp, Artificial sequence
  synthetic polynucleotide sequence
aacgaggtgccagcgcga

SEQ ID NO: 6722 - DNA, 18 bp, Artificial sequence
  synthetic polynucleotide sequence
aggactggtacccctcca

SEQ ID NO: 6723 - DNA, 18 bp, Artificial sequence
  synthetic polynucleotide sequence
ccaagaagacacctgcta

SEQ ID NO: 6724 - DNA, 18 bp, Artificial sequence
  synthetic polynucleotide sequence
acacaccatactcagcca

SEQ ID NO: 6725 - DNA, 18 bp, Artificial sequence
  synthetic polynucleotide sequence
ccaggataaggacgacca

SEQ ID NO: 6726 - DNA, 18 bp, Artificial sequence
  synthetic polynucleotide sequence
gcatgtcacactgcagca

SEQ ID NO: 6727 - DNA, 18 bp, Artificial sequence
  synthetic polynucleotide sequence
acgcaggtgcacacggaa

SEQ ID NO: 6728 - DNA, 18 bp, Artificial sequence
  synthetic polynucleotide sequence
gcgatgtgctggacccca

SEQ ID NO: 6729 - DNA, 18 bp, Artificial sequence
  synthetic polynucleotide sequence
gctcagggcataggcaga

SEQ ID NO: 6730 - DNA, 18 bp, Artificial sequence
  synthetic polynucleotide sequence
cagccacatcgcactgga

SEQ ID NO: 6731 - DNA, 18 bp, Artificial sequence
  synthetic polynucleotide sequence
aacgaaggccccaaacca

SEQ ID NO: 6732 - DNA, 18 bp, Artificial sequence
  synthetic polynucleotide sequence
ggagctggggagggagca

SEQ ID NO: 6733 - DNA, 18 bp, Artificial sequence
  synthetic polynucleotide sequence
aggaggctcgagtcccca

SEQ ID NO: 6734 - DNA, 18 bp, Artificial sequence
  synthetic polynucleotide sequence
aatgccacacagccgcca

SEQ ID NO: 6735 - DNA, 18 bp, Artificial sequence
  synthetic polynucleotide sequence
gctatggcgatgcgggca

SEQ ID NO: 6736 - DNA, 18 bp, Artificial sequence
  synthetic polynucleotide sequence
ccatactcagccacagca

SEQ ID NO: 6737 - DNA, 19 bp, Artificial sequence
  synthetic polynucleotide sequence
gaccagtcaacaggggaca

SEQ ID NO: 6738 - DNA, 19 bp, Artificial sequence
  synthetic polynucleotide sequence
atactgcctgaccaaggaa

SEQ ID NO: 6739 - DNA, 18 bp, Artificial sequence
  synthetic polynucleotide sequence
tggccctaccaggagcaa

SEQ ID NO: 6740 - DNA, 18 bp, Artificial sequence
  synthetic polynucleotide sequence
tccaggagcaactgagca

SEQ ID NO: 6741 - DNA, 18 bp, Artificial sequence
  synthetic polynucleotide sequence
tgctggccaatcagggca

SEQ ID NO: 6742 - DNA, 18 bp, Artificial sequence
  synthetic polynucleotide sequence
agcccagccacatgcaca

SEQ ID NO: 6743 - DNA, 18 bp, Artificial sequence
  synthetic polynucleotide sequence
ccaagccacgtggacaga

SEQ ID NO: 6744 - DNA, 18 bp, Artificial sequence
  synthetic polynucleotide sequence
aggtacaagccgggacca

SEQ ID NO: 6745 - DNA, 18 bp, Artificial sequence
  synthetic polynucleotide sequence
gtgcatgccgacacacca

SEQ ID NO: 6746 - DNA, 18 bp, Artificial sequence
  synthetic polynucleotide sequence
cggaacacgtgccacaca

SEQ ID NO: 6747 - DNA, 18 bp, Artificial sequence
  synthetic polynucleotide sequence
acgggtgaaggactcgga

SEQ ID NO: 6748 - DNA, 18 bp, Artificial sequence
  synthetic polynucleotide sequence
gagcctgccgagattcca

SEQ ID NO: 6749 - DNA, 18 bp, Artificial sequence
  synthetic polynucleotide sequence
ggacacaggtccacagga

SEQ ID NO: 6750 - DNA, 18 bp, Artificial sequence
  synthetic polynucleotide sequence
agcttcctggagcgcaga

SEQ ID NO: 6751 - DNA, 18 bp, Artificial sequence
  synthetic polynucleotide sequence
tcatggacaccaccccca

SEQ ID NO: 6752 - DNA, 18 bp, Artificial sequence
  synthetic polynucleotide sequence
ggtgggtcacaaggtcca

SEQ ID NO: 6753 - DNA, 18 bp, Artificial sequence
  synthetic polynucleotide sequence
agcaccaggcaaaggcaa

SEQ ID NO: 6754 - DNA, 18 bp, Artificial sequence
  synthetic polynucleotide sequence
tgatgtagcccagccaga

SEQ ID NO: 6755 - DNA, 18 bp, Artificial sequence
  synthetic polynucleotide sequence
ccaccatcagggagcaca

SEQ ID NO: 6756 - DNA, 18 bp, Artificial sequence
  synthetic polynucleotide sequence
gttggcatagcccagcca

SEQ ID NO: 6757 - DNA, 18 bp, Artificial sequence
  synthetic polynucleotide sequence
gagccaggagattagcca

SEQ ID NO: 6758 - DNA, 20 bp, Artificial sequence
  synthetic polynucleotide sequence
gaattgaaccactgaagcca

SEQ ID NO: 6759 - DNA, 18 bp, Artificial sequence
  synthetic polynucleotide sequence
aggggtgaacgacacgga

SEQ ID NO: 6760 - DNA, 18 bp, Artificial sequence
  synthetic polynucleotide sequence
gaagactgacgggagcca

SEQ ID NO: 6761 - DNA, 18 bp, Artificial sequence
  synthetic polynucleotide sequence
ggacccttcaagtggaca

SEQ ID NO: 6762 - DNA, 18 bp, Artificial sequence
  synthetic polynucleotide sequence
gtgaagtcacagcctgca

SEQ ID NO: 6763 - DNA, 18 bp, Artificial sequence
  synthetic polynucleotide sequence
cggagacgaaaacaagga

SEQ ID NO: 6764 - DNA, 18 bp, Artificial sequence
  synthetic polynucleotide sequence
ggccacagaagaacggga

SEQ ID NO: 6765 - DNA, 18 bp, Artificial sequence
  synthetic polynucleotide sequence
ctacccgtccatcgagga

SEQ ID NO: 6766 - DNA, 18 bp, Artificial sequence
  synthetic polynucleotide sequence
ggatgtggcgcagcggga

SEQ ID NO: 6767 - DNA, 18 bp, Artificial sequence
  synthetic polynucleotide sequence
catgtccccggacacgaa

SEQ ID NO: 6768 - DNA, 18 bp, Artificial sequence
  synthetic polynucleotide sequence
acagggggaagtagcgca

SEQ ID NO: 6769 - DNA, 18 bp, Artificial sequence
  synthetic polynucleotide sequence
gggctgcacgctacagga

SEQ ID NO: 6770 - DNA, 18 bp, Artificial sequence
  synthetic polynucleotide sequence
acaggttgtagcagccca

SEQ ID NO: 6771 - DNA, 18 bp, Artificial sequence
  synthetic polynucleotide sequence
gctgagaccgtccaggaa

SEQ ID NO: 6772 - DNA, 18 bp, Artificial sequence
  synthetic polynucleotide sequence
cagtgtagcagctgggca

SEQ ID NO: 6773 - DNA, 18 bp, Artificial sequence
  synthetic polynucleotide sequence
atgtccagagaggggcca

SEQ ID NO: 6774 - DNA, 18 bp, Artificial sequence
  synthetic polynucleotide sequence
agttatagcagcccacca

SEQ ID NO: 6775 - DNA, 18 bp, Artificial sequence
  synthetic polynucleotide sequence
ctggcaccatggaagaca

SEQ ID NO: 6776 - DNA, 18 bp, Artificial sequence
  synthetic polynucleotide sequence
aagccactttcccagcca

SEQ ID NO: 6777 - DNA, 18 bp, Artificial sequence
  synthetic polynucleotide sequence
cagcctgacggacagcaa

SEQ ID NO: 6778 - DNA, 18 bp, Artificial sequence
  synthetic polynucleotide sequence
cgcgatctcggaggccca

SEQ ID NO: 6779 - DNA, 18 bp, Artificial sequence
  synthetic polynucleotide sequence
gtgggaaaagcgcaagca

SEQ ID NO: 6780 - DNA, 18 bp, Artificial sequence
  synthetic polynucleotide sequence
catggccaggcgtagcga

SEQ ID NO: 6781 - DNA, 18 bp, Artificial sequence
  synthetic polynucleotide sequence
gcaccccactgctgacca

SEQ ID NO: 6782 - DNA, 18 bp, Artificial sequence
  synthetic polynucleotide sequence
gcctgtacgaggtgagca

SEQ ID NO: 6783 - DNA, 18 bp, Artificial sequence
  synthetic polynucleotide sequence
gggcatggaattgggaga

SEQ ID NO: 6784 - DNA, 18 bp, Artificial sequence
  synthetic polynucleotide sequence
ggcacccagtcccttgca

SEQ ID NO: 6785 - DNA, 18 bp, Artificial sequence
  synthetic polynucleotide sequence
tagggccacaatccgaga

SEQ ID NO: 6786 - DNA, 18 bp, Artificial sequence
  synthetic polynucleotide sequence
tggcttcggaggccagga

SEQ ID NO: 6787 - DNA, 18 bp, Artificial sequence
  synthetic polynucleotide sequence
ggaagactacggccagga

SEQ ID NO: 6788 - DNA, 18 bp, Artificial sequence
  synthetic polynucleotide sequence
gctggatgtcccgcagca

SEQ ID NO: 6789 - DNA, 18 bp, Artificial sequence
  synthetic polynucleotide sequence
gcctcagtggagactgga

SEQ ID NO: 6790 - DNA, 18 bp, Artificial sequence
  synthetic polynucleotide sequence
taacacacgcctggcaga

SEQ ID NO: 6791 - DNA, 18 bp, Artificial sequence
  synthetic polynucleotide sequence
gaaagaagcccccaagca

SEQ ID NO: 6792 - DNA, 18 bp, Artificial sequence
  synthetic polynucleotide sequence
agttcgcggatgcaccga

SEQ ID NO: 6793 - DNA, 18 bp, Artificial sequence
  synthetic polynucleotide sequence
cacagcaaaggcaaggaa

SEQ ID NO: 6794 - DNA, 18 bp, Artificial sequence
  synthetic polynucleotide sequence
ctgtacctggacaggcca

SEQ ID NO: 6795 - DNA, 18 bp, Artificial sequence
  synthetic polynucleotide sequence
cgcccttcaaccgccaca

SEQ ID NO: 6796 - DNA, 18 bp, Artificial sequence
  synthetic polynucleotide sequence
gtgccggtccacaaggga

SEQ ID NO: 6797 - DNA, 18 bp, Artificial sequence
  synthetic polynucleotide sequence
tatggggaaggaggccca

SEQ ID NO: 6798 - DNA, 18 bp, Artificial sequence
  synthetic polynucleotide sequence
gcagagccctcaaggcca

SEQ ID NO: 6799 - DNA, 18 bp, Artificial sequence
  synthetic polynucleotide sequence
cgacaaggctcagcgcca

SEQ ID NO: 6800 - DNA, 18 bp, Artificial sequence
  synthetic polynucleotide sequence
cgtagcggcctgtaccca

SEQ ID NO: 6801 - DNA, 18 bp, Artificial sequence
  synthetic polynucleotide sequence
acgtgaacaccagaggca

SEQ ID NO: 6802 - DNA, 18 bp, Artificial sequence
  synthetic polynucleotide sequence
cccagcatatccatagca

SEQ ID NO: 6803 - DNA, 18 bp, Artificial sequence
  synthetic polynucleotide sequence
ggaagccgtcagcagaga

SEQ ID NO: 6804 - DNA, 18 bp, Artificial sequence
  synthetic polynucleotide sequence
accgtggatctccggaca

SEQ ID NO: 6805 - DNA, 18 bp, Artificial sequence
  synthetic polynucleotide sequence
ggtggtagactcggagga

SEQ ID NO: 6806 - DNA, 18 bp, Artificial sequence
  synthetic polynucleotide sequence
atctcatcaccagaggca

SEQ ID NO: 6807 - DNA, 18 bp, Artificial sequence
  synthetic polynucleotide sequence
gctggcagaagacaagga

SEQ ID NO: 6808 - DNA, 18 bp, Artificial sequence
  synthetic polynucleotide sequence
gggaggtatgatagcgca

SEQ ID NO: 6809 - DNA, 18 bp, Artificial sequence
  synthetic polynucleotide sequence
ccggtgtaggaatgacca

SEQ ID NO: 6810 - DNA, 18 bp, Artificial sequence
  synthetic polynucleotide sequence
tgctacaaggaaggcgga

SEQ ID NO: 6811 - DNA, 18 bp, Artificial sequence
  synthetic polynucleotide sequence
ggacaggaaggaacctca

SEQ ID NO: 6812 - DNA, 18 bp, Artificial sequence
  synthetic polynucleotide sequence
aacccactgttcacgcga

SEQ ID NO: 6813 - DNA, 18 bp, Artificial sequence
  synthetic polynucleotide sequence
ctgccctgatcaagcgca

SEQ ID NO: 6814 - DNA, 18 bp, Artificial sequence
  synthetic polynucleotide sequence
cgtacacctggatcagca

SEQ ID NO: 6815 - DNA, 18 bp, Artificial sequence
  synthetic polynucleotide sequence
cgccaacaccttggccga

SEQ ID NO: 6816 - DNA, 18 bp, Artificial sequence
  synthetic polynucleotide sequence
atggtagggcctgaccca

SEQ ID NO: 6817 - DNA, 18 bp, Artificial sequence
  synthetic polynucleotide sequence
gcagcggctgcttcagga

SEQ ID NO: 6818 - DNA, 18 bp, Artificial sequence
  synthetic polynucleotide sequence
agccccagggacagggga

SEQ ID NO: 6819 - DNA, 18 bp, Artificial sequence
  synthetic polynucleotide sequence
ccatcctcatcggcgaca

SEQ ID NO: 6820 - DNA, 18 bp, Artificial sequence
  synthetic polynucleotide sequence
ggggtcatgacaccgcca

SEQ ID NO: 6821 - DNA, 18 bp, Artificial sequence
  synthetic polynucleotide sequence
gctagagtggagccacca

SEQ ID NO: 6822 - DNA, 18 bp, Artificial sequence
  synthetic polynucleotide sequence
gcaggcgataagatggca

SEQ ID NO: 6823 - DNA, 18 bp, Artificial sequence
  synthetic polynucleotide sequence
aagaaccatcctgcccca

SEQ ID NO: 6824 - DNA, 18 bp, Artificial sequence
  synthetic polynucleotide sequence
actgatgcgctagccaca

SEQ ID NO: 6825 - DNA, 18 bp, Artificial sequence
  synthetic polynucleotide sequence
atcaacgagcctacggca

SEQ ID NO: 6826 - DNA, 18 bp, Artificial sequence
  synthetic polynucleotide sequence
cgaaggttccgccaccca

SEQ ID NO: 6827 - DNA, 18 bp, Artificial sequence
  synthetic polynucleotide sequence
aggaggaggtggagagga

SEQ ID NO: 6828 - DNA, 18 bp, Artificial sequence
  synthetic polynucleotide sequence
gctccagccaggcaagga

SEQ ID NO: 6829 - DNA, 18 bp, Artificial sequence
  synthetic polynucleotide sequence
agagaaagcccttcgaga

SEQ ID NO: 6830 - DNA, 18 bp, Artificial sequence
  synthetic polynucleotide sequence
gagtgacatccaagagca

SEQ ID NO: 6831 - DNA, 18 bp, Artificial sequence
  synthetic polynucleotide sequence
ggagctgccattcaggga

SEQ ID NO: 6832 - DNA, 18 bp, Artificial sequence
  synthetic polynucleotide sequence
catcagcggcagtagaga

SEQ ID NO: 6833 - DNA, 18 bp, Artificial sequence
  synthetic polynucleotide sequence
ccacgcagtccaacgaga

SEQ ID NO: 6834 - DNA, 18 bp, Artificial sequence
  synthetic polynucleotide sequence
ggcggcagtctcatcgga

SEQ ID NO: 6835 - DNA, 18 bp, Artificial sequence
  synthetic polynucleotide sequence
ccagcgcctggaccgcca

SEQ ID NO: 6836 - DNA, 18 bp, Artificial sequence
  synthetic polynucleotide sequence
gggagagagcagctcgga

SEQ ID NO: 6837 - DNA, 18 bp, Artificial sequence
  synthetic polynucleotide sequence
cagcttcaagccagagga

SEQ ID NO: 6838 - DNA, 18 bp, Artificial sequence
  synthetic polynucleotide sequence
cctctgcaggaagctgga

SEQ ID NO: 6839 - DNA, 18 bp, Artificial sequence
  synthetic polynucleotide sequence
tccttgggagcccacaca

SEQ ID NO: 6840 - DNA, 18 bp, Artificial sequence
  synthetic polynucleotide sequence
gggctcagtgtaaccgca

SEQ ID NO: 6841 - DNA, 18 bp, Artificial sequence
  synthetic polynucleotide sequence
gtggcagtcaaggctcca

SEQ ID NO: 6842 - DNA, 18 bp, Artificial sequence
  synthetic polynucleotide sequence
ctgcaccaccagtagcaa

SEQ ID NO: 6843 - DNA, 18 bp, Artificial sequence
  synthetic polynucleotide sequence
ctgtaaccaaaggaggca

SEQ ID NO: 6844 - DNA, 18 bp, Artificial sequence
  synthetic polynucleotide sequence
aacccgatccaacagcga

SEQ ID NO: 6845 - DNA, 18 bp, Artificial sequence
  synthetic polynucleotide sequence
aggacagaggctgcagca

SEQ ID NO: 6846 - DNA, 18 bp, Artificial sequence
  synthetic polynucleotide sequence
tgagcacgtacaactgga

SEQ ID NO: 6847 - DNA, 18 bp, Artificial sequence
  synthetic polynucleotide sequence
aggcaagaatctcgccca

SEQ ID NO: 6848 - DNA, 18 bp, Artificial sequence
  synthetic polynucleotide sequence
ctctaaccacggtcacca

SEQ ID NO: 6849 - DNA, 18 bp, Artificial sequence
  synthetic polynucleotide sequence
cagtgaagacgctgggca

SEQ ID NO: 6850 - DNA, 18 bp, Artificial sequence
  synthetic polynucleotide sequence
gttggagtagcccagcca

SEQ ID NO: 6851 - DNA, 18 bp, Artificial sequence
  synthetic polynucleotide sequence
tggtgaacaccgaccaca

SEQ ID NO: 6852 - DNA, 18 bp, Artificial sequence
  synthetic polynucleotide sequence
tgcggccatagagggcga

SEQ ID NO: 6853 - DNA, 18 bp, Artificial sequence
  synthetic polynucleotide sequence
cagtgccctggaacgcaa

SEQ ID NO: 6854 - DNA, 18 bp, Artificial sequence
  synthetic polynucleotide sequence
agcaggagtcccggcaga

SEQ ID NO: 6855 - DNA, 18 bp, Artificial sequence
  synthetic polynucleotide sequence
tggacaggtactgggcca

SEQ ID NO: 6856 - DNA, 18 bp, Artificial sequence
  synthetic polynucleotide sequence
acagagggggcatggaga

SEQ ID NO: 6857 - DNA, 18 bp, Artificial sequence
  synthetic polynucleotide sequence
gcagccactaccctggga

SEQ ID NO: 6858 - DNA, 18 bp, Artificial sequence
  synthetic polynucleotide sequence
gatacccaagccatgcca

SEQ ID NO: 6859 - DNA, 18 bp, Artificial sequence
  synthetic polynucleotide sequence
aggcaggaggactatgca

SEQ ID NO: 6860 - DNA, 18 bp, Artificial sequence
  synthetic polynucleotide sequence
agcagggccccaatgaca

SEQ ID NO: 6861 - DNA, 18 bp, Artificial sequence
  synthetic polynucleotide sequence
caccggaaaaggtggcaa

SEQ ID NO: 6862 - DNA, 18 bp, Artificial sequence
  synthetic polynucleotide sequence
agggacaccacataagca

SEQ ID NO: 6863 - DNA, 18 bp, Artificial sequence
  synthetic polynucleotide sequence
accagaacgcacgccgaa

SEQ ID NO: 6864 - DNA, 18 bp, Artificial sequence
  synthetic polynucleotide sequence
gggcaccacatgatcaga

SEQ ID NO: 6865 - DNA, 18 bp, Artificial sequence
  synthetic polynucleotide sequence
gcgggatgagatccgaga

SEQ ID NO: 6866 - DNA, 18 bp, Artificial sequence
  synthetic polynucleotide sequence
gccagatggaccagagca

SEQ ID NO: 6867 - DNA, 18 bp, Artificial sequence
  synthetic polynucleotide sequence
tcaacaagccctacgcca

SEQ ID NO: 6868 - DNA, 18 bp, Artificial sequence
  synthetic polynucleotide sequence
aggcctgctctcggagga

SEQ ID NO: 6869 - DNA, 18 bp, Artificial sequence
  synthetic polynucleotide sequence
ctgccaaacagccccaga

SEQ ID NO: 6870 - DNA, 18 bp, Artificial sequence
  synthetic polynucleotide sequence
aggggatccagcagagca

SEQ ID NO: 6871 - DNA, 18 bp, Artificial sequence
  synthetic polynucleotide sequence
acagcaccatgaacccca

SEQ ID NO: 6872 - DNA, 18 bp, Artificial sequence
  synthetic polynucleotide sequence
ggtgcgcagtgatggcga

SEQ ID NO: 6873 - DNA, 18 bp, Artificial sequence
  synthetic polynucleotide sequence
ctgtgggtggagaggaca

SEQ ID NO: 6874 - DNA, 18 bp, Artificial sequence
  synthetic polynucleotide sequence
ggtactggcactggagca

SEQ ID NO: 6875 - DNA, 18 bp, Artificial sequence
  synthetic polynucleotide sequence
gcaccgggacttcccaga

SEQ ID NO: 6876 - DNA, 18 bp, Artificial sequence
  synthetic polynucleotide sequence
catcattggcggagacca

SEQ ID NO: 6877 - DNA, 18 bp, Artificial sequence
  synthetic polynucleotide sequence
tgaccctgagtcccagca

SEQ ID NO: 6878 - DNA, 18 bp, Artificial sequence
  synthetic polynucleotide sequence
tcacatcaccaggccgca

SEQ ID NO: 6879 - DNA, 18 bp, Artificial sequence
  synthetic polynucleotide sequence
gcaagaggttgcgccgaa

SEQ ID NO: 6880 - DNA, 18 bp, Artificial sequence
  synthetic polynucleotide sequence
gcagctcactcgagtcca

SEQ ID NO: 6881 - DNA, 18 bp, Artificial sequence
  synthetic polynucleotide sequence
gtggagaaggtggcgcca

SEQ ID NO: 6882 - DNA, 18 bp, Artificial sequence
  synthetic polynucleotide sequence
ccccattctggagcacca

SEQ ID NO: 6883 - DNA, 18 bp, Artificial sequence
  synthetic polynucleotide sequence
aagctggctaatggagga

SEQ ID NO: 6884 - DNA, 18 bp, Artificial sequence
  synthetic polynucleotide sequence
ctgcagagacaccctcca

SEQ ID NO: 6885 - DNA, 18 bp, Artificial sequence
  synthetic polynucleotide sequence
tcctacggcagtccacga

SEQ ID NO: 6886 - DNA, 18 bp, Artificial sequence
  synthetic polynucleotide sequence
gacggacatgcacagcca

SEQ ID NO: 6887 - DNA, 18 bp, Artificial sequence
  synthetic polynucleotide sequence
cctggatgagctggagca

SEQ ID NO: 6888 - DNA, 18 bp, Artificial sequence
  synthetic polynucleotide sequence
cccagctcacccagagca

SEQ ID NO: 6889 - DNA, 18 bp, Artificial sequence
  synthetic polynucleotide sequence
cggggtacaccacaagca

SEQ ID NO: 6890 - DNA, 18 bp, Artificial sequence
  synthetic polynucleotide sequence
cgcagctggggttcacca

SEQ ID NO: 6891 - DNA, 18 bp, Artificial sequence
  synthetic polynucleotide sequence
ggtgcagggagacagcaa

SEQ ID NO: 6892 - DNA, 18 bp, Artificial sequence
  synthetic polynucleotide sequence
ttcggaggggcagacgga

SEQ ID NO: 6893 - DNA, 18 bp, Artificial sequence
  synthetic polynucleotide sequence
ggacaagtctgaggccca

SEQ ID NO: 6894 - DNA, 18 bp, Artificial sequence
  synthetic polynucleotide sequence
cctctggcaagtcaggca

SEQ ID NO: 6895 - DNA, 18 bp, Artificial sequence
  synthetic polynucleotide sequence
tgccacatgtgcaacgca

SEQ ID NO: 6896 - DNA, 18 bp, Artificial sequence
  synthetic polynucleotide sequence
gatgagagaatggcacca

SEQ ID NO: 6897 - DNA, 18 bp, Artificial sequence
  synthetic polynucleotide sequence
cccactgtgggtcagcga

SEQ ID NO: 6898 - DNA, 18 bp, Artificial sequence
  synthetic polynucleotide sequence
gaacctgagcatagggca

SEQ ID NO: 6899 - DNA, 17 bp, Artificial sequence
  synthetic polynucleotide sequence
tacgagggggagtacga

SEQ ID NO: 6900 - DNA, 18 bp, Artificial sequence
  synthetic polynucleotide sequence
gccggatgcaaagccaga

SEQ ID NO: 6901 - DNA, 18 bp, Artificial sequence
  synthetic polynucleotide sequence
gaccccaaggcccagaca

SEQ ID NO: 6902 - DNA, 18 bp, Artificial sequence
  synthetic polynucleotide sequence
gcagtcaggtctgaggca

SEQ ID NO: 6903 - DNA, 18 bp, Artificial sequence
  synthetic polynucleotide sequence
caagaaccagacccggga

SEQ ID NO: 6904 - DNA, 18 bp, Artificial sequence
  synthetic polynucleotide sequence
gacacttgagctcgggca

SEQ ID NO: 6905 - DNA, 18 bp, Artificial sequence
  synthetic polynucleotide sequence
caaacactcagccccgaa

SEQ ID NO: 6906 - DNA, 18 bp, Artificial sequence
  synthetic polynucleotide sequence
gcaggacagatgtcacga

SEQ ID NO: 6907 - DNA, 18 bp, Artificial sequence
  synthetic polynucleotide sequence
gtccagctcacgaggcaa

SEQ ID NO: 6908 - DNA, 18 bp, Artificial sequence
  synthetic polynucleotide sequence
cgatagtcaccacgccca

SEQ ID NO: 6909 - DNA, 18 bp, Artificial sequence
  synthetic polynucleotide sequence
cggcacccattacactga

SEQ ID NO: 6910 - DNA, 18 bp, Artificial sequence
  synthetic polynucleotide sequence
ataggtacgcagcgccca

SEQ ID NO: 6911 - DNA, 18 bp, Artificial sequence
  synthetic polynucleotide sequence
cctgcccaagtcaccaga

SEQ ID NO: 6912 - DNA, 18 bp, Artificial sequence
  synthetic polynucleotide sequence
cgcattggtggccacaca

SEQ ID NO: 6913 - DNA, 18 bp, Artificial sequence
  synthetic polynucleotide sequence
ctccaggaggacaagcca

SEQ ID NO: 6914 - DNA, 18 bp, Artificial sequence
  synthetic polynucleotide sequence
gtcatccaagtcagccca

SEQ ID NO: 6915 - DNA, 18 bp, Artificial sequence
  synthetic polynucleotide sequence
ggggcaaatactctgcga

SEQ ID NO: 6916 - DNA, 18 bp, Artificial sequence
  synthetic polynucleotide sequence
ccagaacttcagctggca

SEQ ID NO: 6917 - DNA, 18 bp, Artificial sequence
  synthetic polynucleotide sequence
agccgctaccggaaccga

SEQ ID NO: 6918 - DNA, 18 bp, Artificial sequence
  synthetic polynucleotide sequence
tgacgttgaacaagcgca

SEQ ID NO: 6919 - DNA, 18 bp, Artificial sequence
  synthetic polynucleotide sequence
aggtgagcaaggtggaga

SEQ ID NO: 6920 - DNA, 18 bp, Artificial sequence
  synthetic polynucleotide sequence
gcggagcccggaccggca

SEQ ID NO: 6921 - DNA, 18 bp, Artificial sequence
  synthetic polynucleotide sequence
aggagctggtgcccagca

SEQ ID NO: 6922 - DNA, 18 bp, Artificial sequence
  synthetic polynucleotide sequence
gatgcgagtccagggcga

SEQ ID NO: 6923 - DNA, 18 bp, Artificial sequence
  synthetic polynucleotide sequence
cagctgaggagccgctga

SEQ ID NO: 6924 - DNA, 18 bp, Artificial sequence
  synthetic polynucleotide sequence
tcgggactccgggtacca

SEQ ID NO: 6925 - DNA, 18 bp, Artificial sequence
  synthetic polynucleotide sequence
ggaggctggtgcccacca

SEQ ID NO: 6926 - DNA, 18 bp, Artificial sequence
  synthetic polynucleotide sequence
gcgccagctgcaggtcca

SEQ ID NO: 6927 - DNA, 18 bp, Artificial sequence
  synthetic polynucleotide sequence
gaggtgctcacagcggaa

SEQ ID NO: 6928 - DNA, 18 bp, Artificial sequence
  synthetic polynucleotide sequence
actatggcaacccggaca

SEQ ID NO: 6929 - DNA, 18 bp, Artificial sequence
  synthetic polynucleotide sequence
ggttagcccacagagcaa

SEQ ID NO: 6930 - DNA, 18 bp, Artificial sequence
  synthetic polynucleotide sequence
gtcatgaagccagcctca

SEQ ID NO: 6931 - DNA, 18 bp, Artificial sequence
  synthetic polynucleotide sequence
ggggaagctggatgggaa

SEQ ID NO: 6932 - DNA, 18 bp, Artificial sequence
  synthetic polynucleotide sequence
gctgaggccgtgaatgca

SEQ ID NO: 6933 - DNA, 18 bp, Artificial sequence
  synthetic polynucleotide sequence
atgggacggctccagaca

SEQ ID NO: 6934 - DNA, 18 bp, Artificial sequence
  synthetic polynucleotide sequence
cgcagcatcatcacggca

SEQ ID NO: 6935 - DNA, 18 bp, Artificial sequence
  synthetic polynucleotide sequence
agagcagacagaagggga

SEQ ID NO: 6936 - DNA, 18 bp, Artificial sequence
  synthetic polynucleotide sequence
cctcacagcactgcagga

SEQ ID NO: 6937 - DNA, 18 bp, Artificial sequence
  synthetic polynucleotide sequence
ccggcaagagtatcgcca

SEQ ID NO: 6938 - DNA, 18 bp, Artificial sequence
  synthetic polynucleotide sequence
ggccgttgatgacgcgga

SEQ ID NO: 6939 - DNA, 18 bp, Artificial sequence
  synthetic polynucleotide sequence
gcccttggagtgaggcga

SEQ ID NO: 6940 - DNA, 18 bp, Artificial sequence
  synthetic polynucleotide sequence
ggaacctcttccaaggga

SEQ ID NO: 6941 - DNA, 18 bp, Artificial sequence
  synthetic polynucleotide sequence
aaaggcaacccccagcta

SEQ ID NO: 6942 - DNA, 18 bp, Artificial sequence
  synthetic polynucleotide sequence
tggaggaactgagcagca

SEQ ID NO: 6943 - DNA, 18 bp, Artificial sequence
  synthetic polynucleotide sequence
atggagccaggcaggcaa

SEQ ID NO: 6944 - DNA, 18 bp, Artificial sequence
  synthetic polynucleotide sequence
cacggggattaccaggga

SEQ ID NO: 6945 - DNA, 18 bp, Artificial sequence
  synthetic polynucleotide sequence
gagcagctctgggccgaa

SEQ ID NO: 6946 - DNA, 18 bp, Artificial sequence
  synthetic polynucleotide sequence
cgctcgcgtagatcagca

SEQ ID NO: 6947 - DNA, 18 bp, Artificial sequence
  synthetic polynucleotide sequence
gaagaggagggagcgtca

SEQ ID NO: 6948 - DNA, 18 bp, Artificial sequence
  synthetic polynucleotide sequence
gcagttcaggaggccgga

SEQ ID NO: 6949 - DNA, 18 bp, Artificial sequence
  synthetic polynucleotide sequence
gacgcccctaacgccgca

SEQ ID NO: 6950 - DNA, 18 bp, Artificial sequence
  synthetic polynucleotide sequence
gctgaggtccagagcgta

SEQ ID NO: 6951 - DNA, 18 bp, Artificial sequence
  synthetic polynucleotide sequence
tggggaacagaccaggga

SEQ ID NO: 6952 - DNA, 18 bp, Artificial sequence
  synthetic polynucleotide sequence
caagtgcaaggtcagcca

SEQ ID NO: 6953 - DNA, 18 bp, Artificial sequence
  synthetic polynucleotide sequence
ggagatggagaccgggaa

SEQ ID NO: 6954 - DNA, 18 bp, Artificial sequence
  synthetic polynucleotide sequence
tccgtaggagtcccgaga

SEQ ID NO: 6955 - DNA, 18 bp, Artificial sequence
  synthetic polynucleotide sequence
ccttcagaggccagcaca

SEQ ID NO: 6956 - DNA, 18 bp, Artificial sequence
  synthetic polynucleotide sequence
gatggaggcatctgagga

SEQ ID NO: 6957 - DNA, 18 bp, Artificial sequence
  synthetic polynucleotide sequence
tgcagtcactgggagcaa

SEQ ID NO: 6958 - DNA, 18 bp, Artificial sequence
  synthetic polynucleotide sequence
ctcgcaatgacagccgca

SEQ ID NO: 6959 - DNA, 18 bp, Artificial sequence
  synthetic polynucleotide sequence
gcagctggactctccaca

SEQ ID NO: 6960 - DNA, 18 bp, Artificial sequence
  synthetic polynucleotide sequence
gggttcagctgggagaga

SEQ ID NO: 6961 - DNA, 18 bp, Artificial sequence
  synthetic polynucleotide sequence
catgcacgccaacgccca

SEQ ID NO: 6962 - DNA, 18 bp, Artificial sequence
  synthetic polynucleotide sequence
ggcagacaagggtaagga

SEQ ID NO: 6963 - DNA, 18 bp, Artificial sequence
  synthetic polynucleotide sequence
gggagctactgccaggga

SEQ ID NO: 6964 - DNA, 18 bp, Artificial sequence
  synthetic polynucleotide sequence
accagtaccgagcgggga

SEQ ID NO: 6965 - DNA, 18 bp, Artificial sequence
  synthetic polynucleotide sequence
gcctgtgcagggatgaca

SEQ ID NO: 6966 - DNA, 18 bp, Artificial sequence
  synthetic polynucleotide sequence
gccacatgtaccacacca

SEQ ID NO: 6967 - DNA, 18 bp, Artificial sequence
  synthetic polynucleotide sequence
taaccgagcggtatagga

SEQ ID NO: 6968 - DNA, 18 bp, Artificial sequence
  synthetic polynucleotide sequence
ctgccccatctagcccca

SEQ ID NO: 6969 - DNA, 18 bp, Artificial sequence
  synthetic polynucleotide sequence
aggagtcaaagcccacca

SEQ ID NO: 6970 - DNA, 18 bp, Artificial sequence
  synthetic polynucleotide sequence
tgacgagaccataacgga

SEQ ID NO: 6971 - DNA, 18 bp, Artificial sequence
  synthetic polynucleotide sequence
acctggacaaggtggaga

SEQ ID NO: 6972 - DNA, 18 bp, Artificial sequence
  synthetic polynucleotide sequence
acagcctgccttagggga

SEQ ID NO: 6973 - DNA, 18 bp, Artificial sequence
  synthetic polynucleotide sequence
gccttggagaaagcccca

SEQ ID NO: 6974 - DNA, 18 bp, Artificial sequence
  synthetic polynucleotide sequence
gccctatagcagcaccca

SEQ ID NO: 6975 - DNA, 18 bp, Artificial sequence
  synthetic polynucleotide sequence
ccgtgatcaacatccaca

SEQ ID NO: 6976 - DNA, 18 bp, Artificial sequence
  synthetic polynucleotide sequence
gcccagaatcagggccca

SEQ ID NO: 6977 - DNA, 18 bp, Artificial sequence
  synthetic polynucleotide sequence
cagcggccagcctcccaa

SEQ ID NO: 6978 - DNA, 18 bp, Artificial sequence
  synthetic polynucleotide sequence
tgctatgaagcccaggca

SEQ ID NO: 6979 - DNA, 18 bp, Artificial sequence
  synthetic polynucleotide sequence
tccacatccgcagcgaga

SEQ ID NO: 6980 - DNA, 18 bp, Artificial sequence
  synthetic polynucleotide sequence
ggcccagatgttcaggca

SEQ ID NO: 6981 - DNA, 18 bp, Artificial sequence
  synthetic polynucleotide sequence
cagcagcatctgaagcaa

SEQ ID NO: 6982 - DNA, 18 bp, Artificial sequence
  synthetic polynucleotide sequence
ataggggtgtaccacgca

SEQ ID NO: 6983 - DNA, 17 bp, Artificial sequence
  synthetic polynucleotide sequence
gaggagagggtgggaga

SEQ ID NO: 6984 - DNA, 16 bp, Artificial sequence
  synthetic polynucleotide sequence
caacctcccaggcaca

SEQ ID NO: 6985 - DNA, 17 bp, Artificial sequence
  synthetic polynucleotide sequence
ggttggggtggaagaga

SEQ ID NO: 6986 - DNA, 16 bp, Artificial sequence
  synthetic polynucleotide sequence
caacctcccaggcaca

SEQ ID NO: 6987 - DNA, 18 bp, Artificial sequence
  synthetic polynucleotide sequence
gcctggataacaggagga

SEQ ID NO: 6988 - DNA, 18 bp, Artificial sequence
  synthetic polynucleotide sequence
aggacagagatggctgga

SEQ ID NO: 6989 - DNA, 18 bp, Artificial sequence
  synthetic polynucleotide sequence
tccagaaagctcaagcca

SEQ ID NO: 6990 - DNA, 18 bp, Artificial sequence
  synthetic polynucleotide sequence
acacaggcttccaggtca

SEQ ID NO: 6991 - DNA, 19 bp, Artificial sequence
  synthetic polynucleotide sequence
cctggcacaaatgggaaga

SEQ ID NO: 6992 - DNA, 19 bp, Artificial sequence
  synthetic polynucleotide sequence
tctcatcccaagcagcaga

SEQ ID NO: 6993 - DNA, 17 bp, Artificial sequence
  synthetic polynucleotide sequence
ggtgggggtgacagaga

SEQ ID NO: 6994 - DNA, 16 bp, Artificial sequence
  synthetic polynucleotide sequence
caacctcccaggcaca

SEQ ID NO: 6995 - DNA, 19 bp, Artificial sequence
  synthetic polynucleotide sequence
gggaacagagcctcctaga

SEQ ID NO: 6996 - DNA, 18 bp, Artificial sequence
  synthetic polynucleotide sequence
cagccaggatggagtcca

SEQ ID NO: 6997 - DNA, 18 bp, Artificial sequence
  synthetic polynucleotide sequence
ctgaatgacctggaagca

SEQ ID NO: 6998 - DNA, 18 bp, Artificial sequence
  synthetic polynucleotide sequence
cctcacagccaggatgga

SEQ ID NO: 6999 - DNA, 19 bp, Artificial sequence
  synthetic polynucleotide sequence
gaggttggagtggaagaca

SEQ ID NO: 7000 - DNA, 16 bp, Artificial sequence
  synthetic polynucleotide sequence
caacctcccatgcaca

SEQ ID NO: 7001 - DNA, 18 bp, Artificial sequence
  synthetic polynucleotide sequence
gcagctgaatgacctgga

SEQ ID NO: 7002 - DNA, 18 bp, Artificial sequence
  synthetic polynucleotide sequence
tctcacagccaggatgga

SEQ ID NO: 7003 - DNA, 18 bp, Artificial sequence
  synthetic polynucleotide sequence
ggaagtgggggtgataga

SEQ ID NO: 7004 - DNA, 16 bp, Artificial sequence
  synthetic polynucleotide sequence
caacctcccaggcaca

SEQ ID NO: 7005 - DNA, 18 bp, Artificial sequence
  synthetic polynucleotide sequence
ccgcagccgcaggtggaa

SEQ ID NO: 7006 - DNA, 18 bp, Artificial sequence
  synthetic polynucleotide sequence
agtcacattcccgacaga

SEQ ID NO: 7007 - DNA, 18 bp, Artificial sequence
  synthetic polynucleotide sequence
cccggagtccgaggagga

SEQ ID NO: 7008 - DNA, 18 bp, Artificial sequence
  synthetic polynucleotide sequence
tctcacagggcccactca

SEQ ID NO: 7009 - DNA, 19 bp, Artificial sequence
  synthetic polynucleotide sequence
agcagttccagaaggagga

SEQ ID NO: 7010 - DNA, 19 bp, Artificial sequence
  synthetic polynucleotide sequence
agccaggaggttctcaaca

SEQ ID NO: 7011 - DNA, 19 bp, Artificial sequence
  synthetic polynucleotide sequence
gaatgtccaacgcaaagca

SEQ ID NO: 7012 - DNA, 18 bp, Artificial sequence
  synthetic polynucleotide sequence
ttgcaggcaggacaacca

SEQ ID NO: 7013 - DNA, 18 bp, Artificial sequence
  synthetic polynucleotide sequence
actcacgcagaaggaaga

SEQ ID NO: 7014 - DNA, 19 bp, Artificial sequence
  synthetic polynucleotide sequence
agttgtaacaccccacaca

SEQ ID NO: 7015 - DNA, 17 bp, Artificial sequence
  synthetic polynucleotide sequence
gagctgggagcactcca

SEQ ID NO: 7016 - DNA, 18 bp, Artificial sequence
  synthetic polynucleotide sequence
ccgtggaggtatcagcga

SEQ ID NO: 7017 - DNA, 19 bp, Artificial sequence
  synthetic polynucleotide sequence
atgaaaccctcagaagcca

SEQ ID NO: 7018 - DNA, 19 bp, Artificial sequence
  synthetic polynucleotide sequence
ggacaatctcccaggcaca

SEQ ID NO: 7019 - DNA, 18 bp, Artificial sequence
  synthetic polynucleotide sequence
gctgcaccggctccagga

SEQ ID NO: 7020 - DNA, 18 bp, Artificial sequence
  synthetic polynucleotide sequence
ctcgcgtgaggaggcgga

SEQ ID NO: 7021 - DNA, 18 bp, Artificial sequence
  synthetic polynucleotide sequence
tggaccagccccttcaca

SEQ ID NO: 7022 - DNA, 18 bp, Artificial sequence
  synthetic polynucleotide sequence
tggagccggtacagccaa

SEQ ID NO: 7023 - DNA, 19 bp, Artificial sequence
  synthetic polynucleotide sequence
taaaagggagccagttgca

SEQ ID NO: 7024 - DNA, 18 bp, Artificial sequence
  synthetic polynucleotide sequence
catgttccaggcagcaga

SEQ ID NO: 7025 - DNA, 18 bp, Artificial sequence
  synthetic polynucleotide sequence
gccttggcaacagatgga

SEQ ID NO: 7026 - DNA, 18 bp, Artificial sequence
  synthetic polynucleotide sequence
cctccactgccctcagga

SEQ ID NO: 7027 - DNA, 18 bp, Artificial sequence
  synthetic polynucleotide sequence
cgcataaagtcaggcaga

SEQ ID NO: 7028 - DNA, 18 bp, Artificial sequence
  synthetic polynucleotide sequence
ccactatcaccgctagca

SEQ ID NO: 7029 - DNA, 18 bp, Artificial sequence
  synthetic polynucleotide sequence
ccacagggtatggctcca

SEQ ID NO: 7030 - DNA, 18 bp, Artificial sequence
  synthetic polynucleotide sequence
tggcgctgggcacggaca

SEQ ID NO: 7031 - DNA, 18 bp, Artificial sequence
  synthetic polynucleotide sequence
ccaggaacaacggggaga

SEQ ID NO: 7032 - DNA, 18 bp, Artificial sequence
  synthetic polynucleotide sequence
ccagctgttggagccgca

SEQ ID NO: 7033 - DNA, 18 bp, Artificial sequence
  synthetic polynucleotide sequence
ccggacaacttccccaga

SEQ ID NO: 7034 - DNA, 18 bp, Artificial sequence
  synthetic polynucleotide sequence
cacgcaggagggcaggca

SEQ ID NO: 7035 - DNA, 18 bp, Artificial sequence
  synthetic polynucleotide sequence
aggctcccgagcaggaga

SEQ ID NO: 7036 - DNA, 18 bp, Artificial sequence
  synthetic polynucleotide sequence
tgatggaggcgctggcaa

SEQ ID NO: 7037 - DNA, 18 bp, Artificial sequence
  synthetic polynucleotide sequence
atcagcgctccacagcca

SEQ ID NO: 7038 - DNA, 18 bp, Artificial sequence
  synthetic polynucleotide sequence
gggccagagacttgcaga

SEQ ID NO: 7039 - DNA, 18 bp, Artificial sequence
  synthetic polynucleotide sequence
cttccagggcctgggcaa

SEQ ID NO: 7040 - DNA, 18 bp, Artificial sequence
  synthetic polynucleotide sequence
ccaagaggctgttgggca

SEQ ID NO: 7041 - DNA, 18 bp, Artificial sequence
  synthetic polynucleotide sequence
ggccccttctgaagagga

SEQ ID NO: 7042 - DNA, 18 bp, Artificial sequence
  synthetic polynucleotide sequence
tggagagccttcgagcca

SEQ ID NO: 7043 - DNA, 18 bp, Artificial sequence
  synthetic polynucleotide sequence
ctccctgcacatccccaa

SEQ ID NO: 7044 - DNA, 18 bp, Artificial sequence
  synthetic polynucleotide sequence
ggggttcacacaccagca

SEQ ID NO: 7045 - DNA, 18 bp, Artificial sequence
  synthetic polynucleotide sequence
caagttccaccccctcca

SEQ ID NO: 7046 - DNA, 18 bp, Artificial sequence
  synthetic polynucleotide sequence
ccgcttggactcggagga

SEQ ID NO: 7047 - DNA, 18 bp, Artificial sequence
  synthetic polynucleotide sequence
ggatgggcagcgtggcaa

SEQ ID NO: 7048 - DNA, 18 bp, Artificial sequence
  synthetic polynucleotide sequence
ccagctggtggcagtcca

SEQ ID NO: 7049 - DNA, 18 bp, Artificial sequence
  synthetic polynucleotide sequence
gcccaattgtgaccgcaa

SEQ ID NO: 7050 - DNA, 18 bp, Artificial sequence
  synthetic polynucleotide sequence
cttgtccacgcaccagca

SEQ ID NO: 7051 - DNA, 18 bp, Artificial sequence
  synthetic polynucleotide sequence
gcagagaccaacagagga

SEQ ID NO: 7052 - DNA, 18 bp, Artificial sequence
  synthetic polynucleotide sequence
gctgcagcactgagtcca

SEQ ID NO: 7053 - DNA, 18 bp, Artificial sequence
  synthetic polynucleotide sequence
gcgagcaaggtccttcca

SEQ ID NO: 7054 - DNA, 18 bp, Artificial sequence
  synthetic polynucleotide sequence
tgtcccggtcaccaggca

SEQ ID NO: 7055 - DNA, 18 bp, Artificial sequence
  synthetic polynucleotide sequence
acggtcgctcgtacccca

SEQ ID NO: 7056 - DNA, 18 bp, Artificial sequence
  synthetic polynucleotide sequence
agccctcacttcacagga

SEQ ID NO: 7057 - DNA, 18 bp, Artificial sequence
  synthetic polynucleotide sequence
tgccagccacacaagaga

SEQ ID NO: 7058 - DNA, 18 bp, Artificial sequence
  synthetic polynucleotide sequence
gggtcctggccaagggca

SEQ ID NO: 7059 - DNA, 18 bp, Artificial sequence
  synthetic polynucleotide sequence
cccgctggctcagaacca

SEQ ID NO: 7060 - DNA, 18 bp, Artificial sequence
  synthetic polynucleotide sequence
gcagggccagaaggtgca

SEQ ID NO: 7061 - DNA, 18 bp, Artificial sequence
  synthetic polynucleotide sequence
tgtgccagccgacaccca

SEQ ID NO: 7062 - DNA, 18 bp, Artificial sequence
  synthetic polynucleotide sequence
tcatacccagaaccctca

SEQ ID NO: 7063 - DNA, 19 bp, Artificial sequence
  synthetic polynucleotide sequence
ctacagaagtggagctgga

SEQ ID NO: 7064 - DNA, 19 bp, Artificial sequence
  synthetic polynucleotide sequence
ccaccatatacgagtggga

SEQ ID NO: 7065 - DNA, 18 bp, Artificial sequence
  synthetic polynucleotide sequence
tgaggagctccaagccaa

SEQ ID NO: 7066 - DNA, 18 bp, Artificial sequence
  synthetic polynucleotide sequence
accgtcaagattcccgga

SEQ ID NO: 7067 - DNA, 18 bp, Artificial sequence
  synthetic polynucleotide sequence
gactgctgagcagcggca

SEQ ID NO: 7068 - DNA, 18 bp, Artificial sequence
  synthetic polynucleotide sequence
ccagggatcctgggcgca

SEQ ID NO: 7069 - DNA, 18 bp, Artificial sequence
  synthetic polynucleotide sequence
ggctcagagacagacgga

SEQ ID NO: 7070 - DNA, 18 bp, Artificial sequence
  synthetic polynucleotide sequence
ggaacgggcagttccaca

SEQ ID NO: 7071 - DNA, 18 bp, Artificial sequence
  synthetic polynucleotide sequence
cacagagtcagtcagcca

SEQ ID NO: 7072 - DNA, 18 bp, Artificial sequence
  synthetic polynucleotide sequence
tgttgacccgggaccaga

SEQ ID NO: 7073 - DNA, 18 bp, Artificial sequence
  synthetic polynucleotide sequence
gctccaccgacacgcaca

SEQ ID NO: 7074 - DNA, 18 bp, Artificial sequence
  synthetic polynucleotide sequence
gtggggccaatggaacca

SEQ ID NO: 7075 - DNA, 18 bp, Artificial sequence
  synthetic polynucleotide sequence
gaatgcccctacccagga

SEQ ID NO: 7076 - DNA, 18 bp, Artificial sequence
  synthetic polynucleotide sequence
actgagctggatggcaca

SEQ ID NO: 7077 - DNA, 18 bp, Artificial sequence
  synthetic polynucleotide sequence
tcagcctcaccgtccaga

SEQ ID NO: 7078 - DNA, 18 bp, Artificial sequence
  synthetic polynucleotide sequence
gggtctccagaaccgaca

SEQ ID NO: 7079 - DNA, 18 bp, Artificial sequence
  synthetic polynucleotide sequence
acaggaggagggaccaca

SEQ ID NO: 7080 - DNA, 18 bp, Artificial sequence
  synthetic polynucleotide sequence
agaggagtatgaaggcca

SEQ ID NO: 7081 - DNA, 18 bp, Artificial sequence
  synthetic polynucleotide sequence
ggtggagcgaccagagga

SEQ ID NO: 7082 - DNA, 18 bp, Artificial sequence
  synthetic polynucleotide sequence
gtcggcatgctgcaccca

SEQ ID NO: 7083 - DNA, 18 bp, Artificial sequence
  synthetic polynucleotide sequence
ggctgacaatcacacgga

SEQ ID NO: 7084 - DNA, 18 bp, Artificial sequence
  synthetic polynucleotide sequence
agaaggccaactgagcca

SEQ ID NO: 7085 - DNA, 18 bp, Artificial sequence
  synthetic polynucleotide sequence
actggacgactgaccgga

SEQ ID NO: 7086 - DNA, 18 bp, Artificial sequence
  synthetic polynucleotide sequence
gtgcacatgggaggcgga

SEQ ID NO: 7087 - DNA, 18 bp, Artificial sequence
  synthetic polynucleotide sequence
ctcagcagctcaaggcca

SEQ ID NO: 7088 - DNA, 18 bp, Artificial sequence
  synthetic polynucleotide sequence
cgcccacagagctccaca

SEQ ID NO: 7089 - DNA, 18 bp, Artificial sequence
  synthetic polynucleotide sequence
tcagcagcagcctgggaa

SEQ ID NO: 7090 - DNA, 18 bp, Artificial sequence
  synthetic polynucleotide sequence
gggagcatctggagagga

SEQ ID NO: 7091 - DNA, 17 bp, Artificial sequence
  synthetic polynucleotide sequence
ttccaggctgagaggca

SEQ ID NO: 7092 - DNA, 16 bp, Artificial sequence
  synthetic polynucleotide sequence
gcctgggagacctcga

SEQ ID NO: 7093 - DNA, 18 bp, Artificial sequence
  synthetic polynucleotide sequence
gcgattcagctacccaga

SEQ ID NO: 7094 - DNA, 18 bp, Artificial sequence
  synthetic polynucleotide sequence
ctggggccacttcagcga

SEQ ID NO: 7095 - DNA, 18 bp, Artificial sequence
  synthetic polynucleotide sequence
cgccaaagaggaccccaa

SEQ ID NO: 7096 - DNA, 18 bp, Artificial sequence
  synthetic polynucleotide sequence
tgaagccatggcagccca

SEQ ID NO: 7097 - DNA, 17 bp, Artificial sequence
  synthetic polynucleotide sequence
ccccaagctgagaacca

SEQ ID NO: 7098 - DNA, 19 bp, Artificial sequence
  synthetic polynucleotide sequence
agggaagaaatcgatgaca

SEQ ID NO: 7099 - DNA, 18 bp, Artificial sequence
  synthetic polynucleotide sequence
gctgcagtgacctgggaa

SEQ ID NO: 7100 - DNA, 18 bp, Artificial sequence
  synthetic polynucleotide sequence
ggctagagatgaggggca

SEQ ID NO: 7101 - DNA, 18 bp, Artificial sequence
  synthetic polynucleotide sequence
agctggggaatggagtga

SEQ ID NO: 7102 - DNA, 18 bp, Artificial sequence
  synthetic polynucleotide sequence
gcaaggcgaagcagccga

SEQ ID NO: 7103 - DNA, 18 bp, Artificial sequence
  synthetic polynucleotide sequence
aggctgcgagcggaccta

SEQ ID NO: 7104 - DNA, 18 bp, Artificial sequence
  synthetic polynucleotide sequence
gcagggccaggcgggaca

SEQ ID NO: 7105 - DNA, 18 bp, Artificial sequence
  synthetic polynucleotide sequence
gctacacacgcagccaga

SEQ ID NO: 7106 - DNA, 18 bp, Artificial sequence
  synthetic polynucleotide sequence
actgaggccaagaaccca

SEQ ID NO: 7107 - DNA, 18 bp, Artificial sequence
  synthetic polynucleotide sequence
aggtggagttcaagacca

SEQ ID NO: 7108 - DNA, 18 bp, Artificial sequence
  synthetic polynucleotide sequence
agggcctgcatcagctca

SEQ ID NO: 7109 - DNA, 19 bp, Artificial sequence
  synthetic polynucleotide sequence
gaacttgcagctgaagcca

SEQ ID NO: 7110 - DNA, 19 bp, Artificial sequence
  synthetic polynucleotide sequence
cctggacctgaacgcagaa

SEQ ID NO: 7111 - DNA, 18 bp, Artificial sequence
  synthetic polynucleotide sequence
aggccaaggccaccagga

SEQ ID NO: 7112 - DNA, 18 bp, Artificial sequence
  synthetic polynucleotide sequence
tggttcaggccaggacca

SEQ ID NO: 7113 - DNA, 18 bp, Artificial sequence
  synthetic polynucleotide sequence
ctgctccaactggccaca

SEQ ID NO: 7114 - DNA, 18 bp, Artificial sequence
  synthetic polynucleotide sequence
gggagcaccgtccaggga

SEQ ID NO: 7115 - DNA, 17 bp, Artificial sequence
  synthetic polynucleotide sequence
gcatgtccgagacacca

SEQ ID NO: 7116 - DNA, 16 bp, Artificial sequence
  synthetic polynucleotide sequence
gaagacgggcagcaca

SEQ ID NO: 7117 - DNA, 18 bp, Artificial sequence
  synthetic polynucleotide sequence
cccgagggagccagctca

SEQ ID NO: 7118 - DNA, 18 bp, Artificial sequence
  synthetic polynucleotide sequence
tgctacactgggacccca

SEQ ID NO: 7119 - DNA, 18 bp, Artificial sequence
  synthetic polynucleotide sequence
caagggcattgaagcgaa

SEQ ID NO: 7120 - DNA, 18 bp, Artificial sequence
  synthetic polynucleotide sequence
gcatgatccaagccctca

SEQ ID NO: 7121 - DNA, 21 bp, Artificial sequence
  synthetic polynucleotide sequence
ggcttcctaaaacagaagcca

SEQ ID NO: 7122 - DNA, 18 bp, Artificial sequence
  synthetic polynucleotide sequence
ttgcaactggggtgaaca

SEQ ID NO: 7123 - DNA, 18 bp, Artificial sequence
  synthetic polynucleotide sequence
ggcaccccctctcagaca

SEQ ID NO: 7124 - DNA, 18 bp, Artificial sequence
  synthetic polynucleotide sequence
tgaggtagcatgccagga

SEQ ID NO: 7125 - DNA, 18 bp, Artificial sequence
  synthetic polynucleotide sequence
tctcaaggggaccacgca

SEQ ID NO: 7126 - DNA, 18 bp, Artificial sequence
  synthetic polynucleotide sequence
ccagtgtcaccgtgcaga

SEQ ID NO: 7127 - DNA, 18 bp, Artificial sequence
  synthetic polynucleotide sequence
cgctgatgggaacgtgga

SEQ ID NO: 7128 - DNA, 18 bp, Artificial sequence
  synthetic polynucleotide sequence
ccctgcgcaggaccagga

SEQ ID NO: 7129 - DNA, 19 bp, Artificial sequence
  synthetic polynucleotide sequence
cgcatggaggagtatgaga

SEQ ID NO: 7130 - DNA, 18 bp, Artificial sequence
  synthetic polynucleotide sequence
ggacatccacagctgcaa

SEQ ID NO: 7131 - DNA, 18 bp, Artificial sequence
  synthetic polynucleotide sequence
aggaccgctatccacaga

SEQ ID NO: 7132 - DNA, 18 bp, Artificial sequence
  synthetic polynucleotide sequence
tgaacggggcagcacgca

SEQ ID NO: 7133 - DNA, 18 bp, Artificial sequence
  synthetic polynucleotide sequence
gctgttcggcgaggagga

SEQ ID NO: 7134 - DNA, 17 bp, Artificial sequence
  synthetic polynucleotide sequence
gacgcaggtgcagccca

SEQ ID NO: 7135 - DNA, 18 bp, Artificial sequence
  synthetic polynucleotide sequence
ggaagttgtacaggccca

SEQ ID NO: 7136 - DNA, 18 bp, Artificial sequence
  synthetic polynucleotide sequence
aggtgcagccaacagtca

SEQ ID NO: 7137 - DNA, 18 bp, Artificial sequence
  synthetic polynucleotide sequence
ggtacccgctcatggaca

SEQ ID NO: 7138 - DNA, 18 bp, Artificial sequence
  synthetic polynucleotide sequence
accagtcgggacagcgga

SEQ ID NO: 7139 - DNA, 18 bp, Artificial sequence
  synthetic polynucleotide sequence
gtggcaagagcgagggca

SEQ ID NO: 7140 - DNA, 18 bp, Artificial sequence
  synthetic polynucleotide sequence
gggcagacactgagagca

SEQ ID NO: 7141 - DNA, 18 bp, Artificial sequence
  synthetic polynucleotide sequence
caaaaccccggtggcaca

SEQ ID NO: 7142 - DNA, 18 bp, Artificial sequence
  synthetic polynucleotide sequence
gtcaggttccagaggcca

SEQ ID NO: 7143 - DNA, 18 bp, Artificial sequence
  synthetic polynucleotide sequence
ggatacccaagcccagca

SEQ ID NO: 7144 - DNA, 18 bp, Artificial sequence
  synthetic polynucleotide sequence
ctggacatctgaccgcca

SEQ ID NO: 7145 - DNA, 16 bp, Artificial sequence
  synthetic polynucleotide sequence
cgggcagatcaccaga

SEQ ID NO: 7146 - DNA, 16 bp, Artificial sequence
  synthetic polynucleotide sequence
ccaggctagagcgcaa

SEQ ID NO: 7147 - DNA, 18 bp, Artificial sequence
  synthetic polynucleotide sequence
gctaagcagtgtccagca

SEQ ID NO: 7148 - DNA, 18 bp, Artificial sequence
  synthetic polynucleotide sequence
ggggcaaggttgccctca

SEQ ID NO: 7149 - DNA, 18 bp, Artificial sequence
  synthetic polynucleotide sequence
ggctgatatcccaggcca

SEQ ID NO: 7150 - DNA, 18 bp, Artificial sequence
  synthetic polynucleotide sequence
ctaggcacactactgcca

SEQ ID NO: 7151 - DNA, 18 bp, Artificial sequence
  synthetic polynucleotide sequence
cccagtccgtccaactga

SEQ ID NO: 7152 - DNA, 18 bp, Artificial sequence
  synthetic polynucleotide sequence
ggtaggtccggtacagca

SEQ ID NO: 7153 - DNA, 18 bp, Artificial sequence
  synthetic polynucleotide sequence
tgccaccagagtcatcca

SEQ ID NO: 7154 - DNA, 18 bp, Artificial sequence
  synthetic polynucleotide sequence
gtcgagctctcccaggga

SEQ ID NO: 7155 - DNA, 18 bp, Artificial sequence
  synthetic polynucleotide sequence
tctgggaaactcacggca

SEQ ID NO: 7156 - DNA, 18 bp, Artificial sequence
  synthetic polynucleotide sequence
ccctgccaagcacaccca

SEQ ID NO: 7157 - DNA, 18 bp, Artificial sequence
  synthetic polynucleotide sequence
gaactgcacgctccggga

SEQ ID NO: 7158 - DNA, 18 bp, Artificial sequence
  synthetic polynucleotide sequence
aggacatggagaacacca

SEQ ID NO: 7159 - DNA, 18 bp, Artificial sequence
  synthetic polynucleotide sequence
gttgcaggagacggagga

SEQ ID NO: 7160 - DNA, 18 bp, Artificial sequence
  synthetic polynucleotide sequence
cagccacattcatcacga

SEQ ID NO: 7161 - DNA, 18 bp, Artificial sequence
  synthetic polynucleotide sequence
taagtgtgagggggacca

SEQ ID NO: 7162 - DNA, 18 bp, Artificial sequence
  synthetic polynucleotide sequence
acacagcggtaatagcca

SEQ ID NO: 7163 - DNA, 18 bp, Artificial sequence
  synthetic polynucleotide sequence
gggaccttgaggagccaa

SEQ ID NO: 7164 - DNA, 18 bp, Artificial sequence
  synthetic polynucleotide sequence
ggccggaaccacagcaca

SEQ ID NO: 7165 - DNA, 18 bp, Artificial sequence
  synthetic polynucleotide sequence
atgagataccagccacga

SEQ ID NO: 7166 - DNA, 18 bp, Artificial sequence
  synthetic polynucleotide sequence
tgagtagcgtcagaggca

SEQ ID NO: 7167 - DNA, 18 bp, Artificial sequence
  synthetic polynucleotide sequence
agtggagggaggaccaca

SEQ ID NO: 7168 - DNA, 18 bp, Artificial sequence
  synthetic polynucleotide sequence
ttctgggcagccaaggga

SEQ ID NO: 7169 - DNA, 18 bp, Artificial sequence
  synthetic polynucleotide sequence
ccctgatccaggacggga

SEQ ID NO: 7170 - DNA, 18 bp, Artificial sequence
  synthetic polynucleotide sequence
tgcagcagctggaccgga

SEQ ID NO: 7171 - DNA, 18 bp, Artificial sequence
  synthetic polynucleotide sequence
gacctgagcgagaacaga

SEQ ID NO: 7172 - DNA, 18 bp, Artificial sequence
  synthetic polynucleotide sequence
gggcaggcggcagactca

SEQ ID NO: 7173 - DNA, 18 bp, Artificial sequence
  synthetic polynucleotide sequence
gcccaagaaggccacaga

SEQ ID NO: 7174 - DNA, 21 bp, Artificial sequence
  synthetic polynucleotide sequence
tcagatccctttagttccaga

SEQ ID NO: 7175 - DNA, 18 bp, Artificial sequence
  synthetic polynucleotide sequence
gtgcaagccaaagatgga

SEQ ID NO: 7176 - DNA, 18 bp, Artificial sequence
  synthetic polynucleotide sequence
atggcgcaggaggcagca

SEQ ID NO: 7177 - DNA, 18 bp, Artificial sequence
  synthetic polynucleotide sequence
gcacacagactcggagga

SEQ ID NO: 7178 - DNA, 18 bp, Artificial sequence
  synthetic polynucleotide sequence
ccctcctctccgagccca

SEQ ID NO: 7179 - DNA, 18 bp, Artificial sequence
  synthetic polynucleotide sequence
ggcctactggaggaggga

SEQ ID NO: 7180 - DNA, 18 bp, Artificial sequence
  synthetic polynucleotide sequence
cgaccacaaggatcagca

SEQ ID NO: 7181 - DNA, 21 bp, Artificial sequence
  synthetic polynucleotide sequence
gctgaagtgaaaacgagacca

SEQ ID NO: 7182 - DNA, 19 bp, Artificial sequence
  synthetic polynucleotide sequence
gtccccaagaagatgacca

SEQ ID NO: 7183 - DNA, 18 bp, Artificial sequence
  synthetic polynucleotide sequence
ccggcctggatatggaca

SEQ ID NO: 7184 - DNA, 18 bp, Artificial sequence
  synthetic polynucleotide sequence
gtggcggaggaatgacca

SEQ ID NO: 7185 - DNA, 19 bp, Artificial sequence
  synthetic polynucleotide sequence
ccctatatcaccaaccgca

SEQ ID NO: 7186 - DNA, 19 bp, Artificial sequence
  synthetic polynucleotide sequence
tcagattgagggaacagca

SEQ ID NO: 7187 - DNA, 18 bp, Artificial sequence
  synthetic polynucleotide sequence
ggggaggaagggacacca

SEQ ID NO: 7188 - DNA, 19 bp, Artificial sequence
  synthetic polynucleotide sequence
cacacaagggactccagca

SEQ ID NO: 7189 - DNA, 18 bp, Artificial sequence
  synthetic polynucleotide sequence
aagtggatgctggcagca

SEQ ID NO: 7190 - DNA, 18 bp, Artificial sequence
  synthetic polynucleotide sequence
tgagtagctcccagccga

SEQ ID NO: 7191 - DNA, 18 bp, Artificial sequence
  synthetic polynucleotide sequence
cccaaggactcagggaca

SEQ ID NO: 7192 - DNA, 18 bp, Artificial sequence
  synthetic polynucleotide sequence
gctgaggcccagtaggga

SEQ ID NO: 7193 - DNA, 18 bp, Artificial sequence
  synthetic polynucleotide sequence
aacgcactaggcatggaa

SEQ ID NO: 7194 - DNA, 18 bp, Artificial sequence
  synthetic polynucleotide sequence
tgacggctgcagaaggta

SEQ ID NO: 7195 - DNA, 19 bp, Artificial sequence
  synthetic polynucleotide sequence
ccatcagagacagtgcaca

SEQ ID NO: 7196 - DNA, 18 bp, Artificial sequence
  synthetic polynucleotide sequence
gggaacaaaccagtgcca

SEQ ID NO: 7197 - DNA, 18 bp, Artificial sequence
  synthetic polynucleotide sequence
cccccaggacctgtacca

SEQ ID NO: 7198 - DNA, 18 bp, Artificial sequence
  synthetic polynucleotide sequence
gtggtagagcagctccga

SEQ ID NO: 7199 - DNA, 18 bp, Artificial sequence
  synthetic polynucleotide sequence
cattgccaagcacaagca

SEQ ID NO: 7200 - DNA, 18 bp, Artificial sequence
  synthetic polynucleotide sequence
agcgtcaacagcttggga

SEQ ID NO: 7201 - DNA, 18 bp, Artificial sequence
  synthetic polynucleotide sequence
cccggaggaggaggagga

SEQ ID NO: 7202 - DNA, 18 bp, Artificial sequence
  synthetic polynucleotide sequence
gcccagccttggacagca

SEQ ID NO: 7203 - DNA, 18 bp, Artificial sequence
  synthetic polynucleotide sequence
agaggtcccaaggcacca

SEQ ID NO: 7204 - DNA, 18 bp, Artificial sequence
  synthetic polynucleotide sequence
cagctcacagggacccca

SEQ ID NO: 7205 - DNA, 19 bp, Artificial sequence
  synthetic polynucleotide sequence
cacgggaagacaaggtgga

SEQ ID NO: 7206 - DNA, 18 bp, Artificial sequence
  synthetic polynucleotide sequence
gttgtgacgaggcaggaa

SEQ ID NO: 7207 - DNA, 19 bp, Artificial sequence
  synthetic polynucleotide sequence
cctgaagtgtaacacccca

SEQ ID NO: 7208 - DNA, 18 bp, Artificial sequence
  synthetic polynucleotide sequence
gcgagatctcaggtgcca

SEQ ID NO: 7209 - DNA, 18 bp, Artificial sequence
  synthetic polynucleotide sequence
ggactgactgggaccaca

SEQ ID NO: 7210 - DNA, 18 bp, Artificial sequence
  synthetic polynucleotide sequence
accacggcttccaatgca

SEQ ID NO: 7211 - DNA, 18 bp, Artificial sequence
  synthetic polynucleotide sequence
aggccaaacctggaggca

SEQ ID NO: 7212 - DNA, 18 bp, Artificial sequence
  synthetic polynucleotide sequence
cggccgtggccaggggca

SEQ ID NO: 7213 - DNA, 18 bp, Artificial sequence
  synthetic polynucleotide sequence
ctcactcaggcccctcga

SEQ ID NO: 7214 - DNA, 18 bp, Artificial sequence
  synthetic polynucleotide sequence
cagggctgagacacggca

SEQ ID NO: 7215 - DNA, 18 bp, Artificial sequence
  synthetic polynucleotide sequence
tgaggagcagcacccaga

SEQ ID NO: 7216 - DNA, 18 bp, Artificial sequence
  synthetic polynucleotide sequence
ctgcatggaccagggcca

SEQ ID NO: 7217 - DNA, 18 bp, Artificial sequence
  synthetic polynucleotide sequence
ccccagggccaaacctga

SEQ ID NO: 7218 - DNA, 18 bp, Artificial sequence
  synthetic polynucleotide sequence
gggctgcaagactgagga

SEQ ID NO: 7219 - DNA, 18 bp, Artificial sequence
  synthetic polynucleotide sequence
ctggctgcccaaaaggaa

SEQ ID NO: 7220 - DNA, 18 bp, Artificial sequence
  synthetic polynucleotide sequence
gtcaccccaacaggctca

SEQ ID NO: 7221 - DNA, 18 bp, Artificial sequence
  synthetic polynucleotide sequence
caggcgtcaacagtacga

SEQ ID NO: 7222 - DNA, 18 bp, Artificial sequence
  synthetic polynucleotide sequence
gaaccgctggagagtcga

SEQ ID NO: 7223 - DNA, 18 bp, Artificial sequence
  synthetic polynucleotide sequence
ccacggacacaagtgcga

SEQ ID NO: 7224 - DNA, 18 bp, Artificial sequence
  synthetic polynucleotide sequence
cggtcaactcggtgcaca

SEQ ID NO: 7225 - DNA, 18 bp, Artificial sequence
  synthetic polynucleotide sequence
gactccagtacagccgca

SEQ ID NO: 7226 - DNA, 18 bp, Artificial sequence
  synthetic polynucleotide sequence
tcgccgtcagcagcacca

SEQ ID NO: 7227 - DNA, 18 bp, Artificial sequence
  synthetic polynucleotide sequence
ggaggaggaggtagagga

SEQ ID NO: 7228 - DNA, 18 bp, Artificial sequence
  synthetic polynucleotide sequence
tcccagggcatgtgagca

SEQ ID NO: 7229 - DNA, 18 bp, Artificial sequence
  synthetic polynucleotide sequence
gtatgccatccccacaga

SEQ ID NO: 7230 - DNA, 18 bp, Artificial sequence
  synthetic polynucleotide sequence
acagtacccccttgcaca

SEQ ID NO: 7231 - DNA, 18 bp, Artificial sequence
  synthetic polynucleotide sequence
ctgcagaacgaccactca

SEQ ID NO: 7232 - DNA, 18 bp, Artificial sequence
  synthetic polynucleotide sequence
gccaacaagccaggtgca

SEQ ID NO: 7233 - DNA, 18 bp, Artificial sequence
  synthetic polynucleotide sequence
gaaagcagcaaagaggca

SEQ ID NO: 7234 - DNA, 18 bp, Artificial sequence
  synthetic polynucleotide sequence
ccagattggaagcatcca

SEQ ID NO: 7235 - DNA, 18 bp, Artificial sequence
  synthetic polynucleotide sequence
tccacccccatgcaggca

SEQ ID NO: 7236 - DNA, 18 bp, Artificial sequence
  synthetic polynucleotide sequence
ggagcgttccgaaggcca

SEQ ID NO: 7237 - DNA, 18 bp, Artificial sequence
  synthetic polynucleotide sequence
gcgctgtggagacgcgga

SEQ ID NO: 7238 - DNA, 19 bp, Artificial sequence
  synthetic polynucleotide sequence
acaaggcttgcactagcca

SEQ ID NO: 7239 - DNA, 18 bp, Artificial sequence
  synthetic polynucleotide sequence
gctcgcaagttgaggcaa

SEQ ID NO: 7240 - DNA, 18 bp, Artificial sequence
  synthetic polynucleotide sequence
tgggcttcacccagggca

SEQ ID NO: 7241 - DNA, 18 bp, Artificial sequence
  synthetic polynucleotide sequence
tagctcaggggagatgga

SEQ ID NO: 7242 - DNA, 18 bp, Artificial sequence
  synthetic polynucleotide sequence
atcggggagactgggcca

SEQ ID NO: 7243 - DNA, 18 bp, Artificial sequence
  synthetic polynucleotide sequence
agccaccggagcactcca

SEQ ID NO: 7244 - DNA, 18 bp, Artificial sequence
  synthetic polynucleotide sequence
aggctgccaagagagcca

SEQ ID NO: 7245 - DNA, 18 bp, Artificial sequence
  synthetic polynucleotide sequence
ctggagacccagcaagga

SEQ ID NO: 7246 - DNA, 18 bp, Artificial sequence
  synthetic polynucleotide sequence
accgagccttgctgagga

SEQ ID NO: 7247 - DNA, 18 bp, Artificial sequence
  synthetic polynucleotide sequence
ccctcatccagtgaggca

SEQ ID NO: 7248 - DNA, 18 bp, Artificial sequence
  synthetic polynucleotide sequence
ggagggcaagggaggaga

SEQ ID NO: 7249 - DNA, 18 bp, Artificial sequence
  synthetic polynucleotide sequence
ctgcccatgctgcccaga

SEQ ID NO: 7250 - DNA, 18 bp, Artificial sequence
  synthetic polynucleotide sequence
acaccggagacagaggga

SEQ ID NO: 7251 - DNA, 18 bp, Artificial sequence
  synthetic polynucleotide sequence
acaggcgctgcttgcaga

SEQ ID NO: 7252 - DNA, 18 bp, Artificial sequence
  synthetic polynucleotide sequence
gtgagaggattcggacga

SEQ ID NO: 7253 - DNA, 18 bp, Artificial sequence
  synthetic polynucleotide sequence
ggcggctcctcataccaa

SEQ ID NO: 7254 - DNA, 18 bp, Artificial sequence
  synthetic polynucleotide sequence
taggagctgggagggcca

SEQ ID NO: 7255 - DNA, 18 bp, Artificial sequence
  synthetic polynucleotide sequence
gctggcagggcaatgaca

SEQ ID NO: 7256 - DNA, 18 bp, Artificial sequence
  synthetic polynucleotide sequence
ggtggagactggcaggca

SEQ ID NO: 7257 - DNA, 18 bp, Artificial sequence
  synthetic polynucleotide sequence
cctcagccacagcagcaa

SEQ ID NO: 7258 - DNA, 18 bp, Artificial sequence
  synthetic polynucleotide sequence
cccacatctccctgcaca

SEQ ID NO: 7259 - DNA, 18 bp, Artificial sequence
  synthetic polynucleotide sequence
agagctctgccctgagga

SEQ ID NO: 7260 - DNA, 18 bp, Artificial sequence
  synthetic polynucleotide sequence
gctagctccagatcacca

SEQ ID NO: 7261 - DNA, 18 bp, Artificial sequence
  synthetic polynucleotide sequence
gtggagcaagggcacgta

SEQ ID NO: 7262 - DNA, 18 bp, Artificial sequence
  synthetic polynucleotide sequence
cttggacgagtccaccca

SEQ ID NO: 7263 - DNA, 18 bp, Artificial sequence
  synthetic polynucleotide sequence
gaagacagaccaccgcaa

SEQ ID NO: 7264 - DNA, 18 bp, Artificial sequence
  synthetic polynucleotide sequence
gtaagggtgccagcgcca

SEQ ID NO: 7265 - DNA, 18 bp, Artificial sequence
  synthetic polynucleotide sequence
gctgcatgccaaggcgca

SEQ ID NO: 7266 - DNA, 18 bp, Artificial sequence
  synthetic polynucleotide sequence
gtcgaggggtccacccga

SEQ ID NO: 7267 - DNA, 18 bp, Artificial sequence
  synthetic polynucleotide sequence
tgacagcagcccaggcca

SEQ ID NO: 7268 - DNA, 18 bp, Artificial sequence
  synthetic polynucleotide sequence
tggaggctccaagggcca

SEQ ID NO: 7269 - DNA, 18 bp, Artificial sequence
  synthetic polynucleotide sequence
tgccaagagcttgaccca

SEQ ID NO: 7270 - DNA, 18 bp, Artificial sequence
  synthetic polynucleotide sequence
tggaggctatggacgcca

SEQ ID NO: 7271 - DNA, 18 bp, Artificial sequence
  synthetic polynucleotide sequence
ggtaccagagctcagcga

SEQ ID NO: 7272 - DNA, 18 bp, Artificial sequence
  synthetic polynucleotide sequence
ggtcgttggagaaggcca

SEQ ID NO: 7273 - DNA, 18 bp, Artificial sequence
  synthetic polynucleotide sequence
ctccaccctgctagagga

SEQ ID NO: 7274 - DNA, 18 bp, Artificial sequence
  synthetic polynucleotide sequence
gccaagccacactaacca

SEQ ID NO: 7275 - DNA, 18 bp, Artificial sequence
  synthetic polynucleotide sequence
gcacctggaggatgagga

SEQ ID NO: 7276 - DNA, 18 bp, Artificial sequence
  synthetic polynucleotide sequence
aggtcggggtcatgagca

SEQ ID NO: 7277 - DNA, 18 bp, Artificial sequence
  synthetic polynucleotide sequence
tcgaccccaacgaaccca

SEQ ID NO: 7278 - DNA, 18 bp, Artificial sequence
  synthetic polynucleotide sequence
gcacttgggacagtacca

SEQ ID NO: 7279 - DNA, 18 bp, Artificial sequence
  synthetic polynucleotide sequence
tcctgaccggggagcgga

SEQ ID NO: 7280 - DNA, 18 bp, Artificial sequence
  synthetic polynucleotide sequence
catgtcgtggggcagcga

SEQ ID NO: 7281 - DNA, 17 bp, Artificial sequence
  synthetic polynucleotide sequence
aactccggcgacagcga

SEQ ID NO: 7282 - DNA, 18 bp, Artificial sequence
  synthetic polynucleotide sequence
gtgaagcggtcccgcaga

SEQ ID NO: 7283 - DNA, 18 bp, Artificial sequence
  synthetic polynucleotide sequence
tggatcccaacgaaccca

SEQ ID NO: 7284 - DNA, 18 bp, Artificial sequence
  synthetic polynucleotide sequence
ttgggagcagcgtgggca

SEQ ID NO: 7285 - DNA, 18 bp, Artificial sequence
  synthetic polynucleotide sequence
caggaggacatcagagga

SEQ ID NO: 7286 - DNA, 18 bp, Artificial sequence
  synthetic polynucleotide sequence
cgtggtaaggtccacgca

SEQ ID NO: 7287 - DNA, 18 bp, Artificial sequence
  synthetic polynucleotide sequence
cccagtggaggggagaga

SEQ ID NO: 7288 - DNA, 18 bp, Artificial sequence
  synthetic polynucleotide sequence
tccaccgttcccagccca

SEQ ID NO: 7289 - DNA, 18 bp, Artificial sequence
  synthetic polynucleotide sequence
ccaccaagctgagaccca

SEQ ID NO: 7290 - DNA, 18 bp, Artificial sequence
  synthetic polynucleotide sequence
acccacactcctccacga

SEQ ID NO: 7291 - DNA, 18 bp, Artificial sequence
  synthetic polynucleotide sequence
tggtgaaccagtaccgca

SEQ ID NO: 7292 - DNA, 18 bp, Artificial sequence
  synthetic polynucleotide sequence
gcacgtcccgcttgacga

SEQ ID NO: 7293 - DNA, 18 bp, Artificial sequence
  synthetic polynucleotide sequence
ggcagtgcccactacaca

SEQ ID NO: 7294 - DNA, 18 bp, Artificial sequence
  synthetic polynucleotide sequence
ggccgtgggtacacagca

SEQ ID NO: 7295 - DNA, 18 bp, Artificial sequence
  synthetic polynucleotide sequence
cactcctcggtcccacca

SEQ ID NO: 7296 - DNA, 18 bp, Artificial sequence
  synthetic polynucleotide sequence
tggtgctcagccaggaga

SEQ ID NO: 7297 - DNA, 18 bp, Artificial sequence
  synthetic polynucleotide sequence
cgatgtccacctgggcaa

SEQ ID NO: 7298 - DNA, 18 bp, Artificial sequence
  synthetic polynucleotide sequence
ccaccatgtaggacggga

SEQ ID NO: 7299 - DNA, 18 bp, Artificial sequence
  synthetic polynucleotide sequence
gaacgtgcatgcccggaa

SEQ ID NO: 7300 - DNA, 18 bp, Artificial sequence
  synthetic polynucleotide sequence
gctccagtgtcaccgaca

SEQ ID NO: 7301 - DNA, 18 bp, Artificial sequence
  synthetic polynucleotide sequence
ccccaagaccaaccccca

SEQ ID NO: 7302 - DNA, 18 bp, Artificial sequence
  synthetic polynucleotide sequence
tccccacattggcccaca

SEQ ID NO: 7303 - DNA, 18 bp, Artificial sequence
  synthetic polynucleotide sequence
tccgagacaacaacggca

SEQ ID NO: 7304 - DNA, 18 bp, Artificial sequence
  synthetic polynucleotide sequence
agcaccagctccttggca

SEQ ID NO: 7305 - DNA, 18 bp, Artificial sequence
  synthetic polynucleotide sequence
cacaggagtcaaggccca

SEQ ID NO: 7306 - DNA, 19 bp, Artificial sequence
  synthetic polynucleotide sequence
gaaggaactcagggaccca

SEQ ID NO: 7307 - DNA, 18 bp, Artificial sequence
  synthetic polynucleotide sequence
ttctgcaacaggcccaca

SEQ ID NO: 7308 - DNA, 18 bp, Artificial sequence
  synthetic polynucleotide sequence
aagcatgctggaagcgga

SEQ ID NO: 7309 - DNA, 18 bp, Artificial sequence
  synthetic polynucleotide sequence
tggagcgggagaagcaca

SEQ ID NO: 7310 - DNA, 18 bp, Artificial sequence
  synthetic polynucleotide sequence
ggtcacaccatgagggca

SEQ ID NO: 7311 - DNA, 18 bp, Artificial sequence
  synthetic polynucleotide sequence
ctagtgtgcggggaacga

SEQ ID NO: 7312 - DNA, 18 bp, Artificial sequence
  synthetic polynucleotide sequence
ccagggccaagggctgca

SEQ ID NO: 7313 - DNA, 18 bp, Artificial sequence
  synthetic polynucleotide sequence
ccctgctgcgggacagca

SEQ ID NO: 7314 - DNA, 18 bp, Artificial sequence
  synthetic polynucleotide sequence
gtcaaggacagctggaca

SEQ ID NO: 7315 - DNA, 18 bp, Artificial sequence
  synthetic polynucleotide sequence
gtctggacgccacagcca

SEQ ID NO: 7316 - DNA, 18 bp, Artificial sequence
  synthetic polynucleotide sequence
aagaggaccggggagtca

SEQ ID NO: 7317 - DNA, 18 bp, Artificial sequence
  synthetic polynucleotide sequence
gaccggaggcgaccgtga

SEQ ID NO: 7318 - DNA, 18 bp, Artificial sequence
  synthetic polynucleotide sequence
ggcaggggctgcaggcca

SEQ ID NO: 7319 - DNA, 18 bp, Artificial sequence
  synthetic polynucleotide sequence
gaggaaaatccagcgcaa

SEQ ID NO: 7320 - DNA, 18 bp, Artificial sequence
  synthetic polynucleotide sequence
gggcatctgtccacccca

SEQ ID NO: 7321 - DNA, 18 bp, Artificial sequence
  synthetic polynucleotide sequence
actctgcggccatgccaa

SEQ ID NO: 7322 - DNA, 18 bp, Artificial sequence
  synthetic polynucleotide sequence
gtgcaatcaaccgtgaga

SEQ ID NO: 7323 - DNA, 18 bp, Artificial sequence
  synthetic polynucleotide sequence
cagcaagggcgctcagga

SEQ ID NO: 7324 - DNA, 18 bp, Artificial sequence
  synthetic polynucleotide sequence
gcacgggcacctgcagga

SEQ ID NO: 7325 - DNA, 18 bp, Artificial sequence
  synthetic polynucleotide sequence
cggtcaacgagtcagcca

SEQ ID NO: 7326 - DNA, 18 bp, Artificial sequence
  synthetic polynucleotide sequence
tggacaccactcccagga

SEQ ID NO: 7327 - DNA, 18 bp, Artificial sequence
  synthetic polynucleotide sequence
ctacctgagggccagcaa

SEQ ID NO: 7328 - DNA, 18 bp, Artificial sequence
  synthetic polynucleotide sequence
agggcgtgaggtggcaca

SEQ ID NO: 7329 - DNA, 18 bp, Artificial sequence
  synthetic polynucleotide sequence
ccagctggacacagggca

SEQ ID NO: 7330 - DNA, 18 bp, Artificial sequence
  synthetic polynucleotide sequence
gcctgccgctccagcaca

SEQ ID NO: 7331 - DNA, 18 bp, Artificial sequence
  synthetic polynucleotide sequence
ctgactgagctcaaggca

SEQ ID NO: 7332 - DNA, 18 bp, Artificial sequence
  synthetic polynucleotide sequence
aagtcgatcatgcgcaca

SEQ ID NO: 7333 - DNA, 18 bp, Artificial sequence
  synthetic polynucleotide sequence
gaagctgacagccaggaa

SEQ ID NO: 7334 - DNA, 18 bp, Artificial sequence
  synthetic polynucleotide sequence
gtcatcaggggcaggcga

SEQ ID NO: 7335 - DNA, 18 bp, Artificial sequence
  synthetic polynucleotide sequence
cagtgggagacacagcca

SEQ ID NO: 7336 - DNA, 18 bp, Artificial sequence
  synthetic polynucleotide sequence
tgatgagccctgcacgca

SEQ ID NO: 7337 - DNA, 18 bp, Artificial sequence
  synthetic polynucleotide sequence
caggaaaccagagcccca

SEQ ID NO: 7338 - DNA, 18 bp, Artificial sequence
  synthetic polynucleotide sequence
agaagctcgggagccaca

SEQ ID NO: 7339 - DNA, 18 bp, Artificial sequence
  synthetic polynucleotide sequence
cccaacagcttgagggaa

SEQ ID NO: 7340 - DNA, 18 bp, Artificial sequence
  synthetic polynucleotide sequence
aaggggtagtagctgcca

SEQ ID NO: 7341 - DNA, 18 bp, Artificial sequence
  synthetic polynucleotide sequence
gtggacaagccgacagca

SEQ ID NO: 7342 - DNA, 18 bp, Artificial sequence
  synthetic polynucleotide sequence
acttagagcgggtgcgga

SEQ ID NO: 7343 - DNA, 19 bp, Artificial sequence
  synthetic polynucleotide sequence
gcctggagatgagaatgca

SEQ ID NO: 7344 - DNA, 17 bp, Artificial sequence
  synthetic polynucleotide sequence
tggcatcacggatagca

SEQ ID NO: 7345 - DNA, 18 bp, Artificial sequence
  synthetic polynucleotide sequence
ccacaagctcaggaccca

SEQ ID NO: 7346 - DNA, 18 bp, Artificial sequence
  synthetic polynucleotide sequence
tgccattcggaaccagga

SEQ ID NO: 7347 - DNA, 18 bp, Artificial sequence
  synthetic polynucleotide sequence
tcaaccctgcccgacaga

SEQ ID NO: 7348 - DNA, 18 bp, Artificial sequence
  synthetic polynucleotide sequence
ggagggagctggacgaca

SEQ ID NO: 7349 - DNA, 18 bp, Artificial sequence
  synthetic polynucleotide sequence
cacaggcacgggaagcca

SEQ ID NO: 7350 - DNA, 18 bp, Artificial sequence
  synthetic polynucleotide sequence
tgcaggtactcgacggca

SEQ ID NO: 7351 - DNA, 18 bp, Artificial sequence
  synthetic polynucleotide sequence
ggcctgaggatagacaga

SEQ ID NO: 7352 - DNA, 18 bp, Artificial sequence
  synthetic polynucleotide sequence
cacaagaagaactgggca

SEQ ID NO: 7353 - DNA, 18 bp, Artificial sequence
  synthetic polynucleotide sequence
agggtgcagctaatggca

SEQ ID NO: 7354 - DNA, 18 bp, Artificial sequence
  synthetic polynucleotide sequence
tccacagctggaagtcca

SEQ ID NO: 7355 - DNA, 18 bp, Artificial sequence
  synthetic polynucleotide sequence
ggctgccaaaggaccgta

SEQ ID NO: 7356 - DNA, 18 bp, Artificial sequence
  synthetic polynucleotide sequence
ctctaccggagaggccca

SEQ ID NO: 7357 - DNA, 18 bp, Artificial sequence
  synthetic polynucleotide sequence
agctgtaaggaggagcca

SEQ ID NO: 7358 - DNA, 18 bp, Artificial sequence
  synthetic polynucleotide sequence
ggatggagggcaaccgga

SEQ ID NO: 7359 - DNA, 18 bp, Artificial sequence
  synthetic polynucleotide sequence
cggccttctaagaaagga

SEQ ID NO: 7360 - DNA, 18 bp, Artificial sequence
  synthetic polynucleotide sequence
gttgaagtcaggaccgca

SEQ ID NO: 7361 - DNA, 19 bp, Artificial sequence
  synthetic polynucleotide sequence
cttcacggaaggaagcgga

SEQ ID NO: 7362 - DNA, 19 bp, Artificial sequence
  synthetic polynucleotide sequence
acaaccttgaccatcacga

SEQ ID NO: 7363 - DNA, 19 bp, Artificial sequence
  synthetic polynucleotide sequence
gccagctggacatctcaga

SEQ ID NO: 7364 - DNA, 16 bp, Artificial sequence
  synthetic polynucleotide sequence
aggggtggctcatgga

SEQ ID NO: 7365 - DNA, 18 bp, Artificial sequence
  synthetic polynucleotide sequence
cagaccaacaccccacca

SEQ ID NO: 7366 - DNA, 18 bp, Artificial sequence
  synthetic polynucleotide sequence
gtcgagctgctacaggca

SEQ ID NO: 7367 - DNA, 18 bp, Artificial sequence
  synthetic polynucleotide sequence
cccaccagaaaggacaga

SEQ ID NO: 7368 - DNA, 18 bp, Artificial sequence
  synthetic polynucleotide sequence
gagatctgcaggcggaca

SEQ ID NO: 7369 - DNA, 18 bp, Artificial sequence
  synthetic polynucleotide sequence
ggaactgtgacaccccca

SEQ ID NO: 7370 - DNA, 18 bp, Artificial sequence
  synthetic polynucleotide sequence
tggacaggcagaggctga

SEQ ID NO: 7371 - DNA, 18 bp, Artificial sequence
  synthetic polynucleotide sequence
cttccgagagctgcagca

SEQ ID NO: 7372 - DNA, 18 bp, Artificial sequence
  synthetic polynucleotide sequence
atcacagagccggctcca

SEQ ID NO: 7373 - DNA, 18 bp, Artificial sequence
  synthetic polynucleotide sequence
catcctagtggccagcaa

SEQ ID NO: 7374 - DNA, 18 bp, Artificial sequence
  synthetic polynucleotide sequence
tctgaagagctccacgca

SEQ ID NO: 7375 - DNA, 18 bp, Artificial sequence
  synthetic polynucleotide sequence
ggagcatgaagcccgtca

SEQ ID NO: 7376 - DNA, 18 bp, Artificial sequence
  synthetic polynucleotide sequence
gagggtactccagctcca

SEQ ID NO: 7377 - DNA, 18 bp, Artificial sequence
  synthetic polynucleotide sequence
agcctcagcagatgggaa

SEQ ID NO: 7378 - DNA, 18 bp, Artificial sequence
  synthetic polynucleotide sequence
ggacatcccattgccaga

SEQ ID NO: 7379 - DNA, 18 bp, Artificial sequence
  synthetic polynucleotide sequence
tacgtggacacctcgcca

SEQ ID NO: 7380 - DNA, 18 bp, Artificial sequence
  synthetic polynucleotide sequence
aaggcgctcatgccccca

SEQ ID NO: 7381 - DNA, 18 bp, Artificial sequence
  synthetic polynucleotide sequence
cgacttcagctcccccaa

SEQ ID NO: 7382 - DNA, 18 bp, Artificial sequence
  synthetic polynucleotide sequence
cggctgcagagacgacga

SEQ ID NO: 7383 - DNA, 18 bp, Artificial sequence
  synthetic polynucleotide sequence
gggctcaggaggaaacca

SEQ ID NO: 7384 - DNA, 18 bp, Artificial sequence
  synthetic polynucleotide sequence
tggccaccacctgagcca

SEQ ID NO: 7385 - DNA, 18 bp, Artificial sequence
  synthetic polynucleotide sequence
cgactctcagtccccaga

SEQ ID NO: 7386 - DNA, 18 bp, Artificial sequence
  synthetic polynucleotide sequence
tccagacgggtactggca

SEQ ID NO: 7387 - DNA, 18 bp, Artificial sequence
  synthetic polynucleotide sequence
gcagccctcaccctgaca

SEQ ID NO: 7388 - DNA, 18 bp, Artificial sequence
  synthetic polynucleotide sequence
cccctggttcggacacca

SEQ ID NO: 7389 - DNA, 18 bp, Artificial sequence
  synthetic polynucleotide sequence
ggaaagacggtggaggaa

SEQ ID NO: 7390 - DNA, 18 bp, Artificial sequence
  synthetic polynucleotide sequence
ccagcatggagcagtgca

SEQ ID NO: 7391 - DNA, 18 bp, Artificial sequence
  synthetic polynucleotide sequence
gcaagtgagcgggctgga

SEQ ID NO: 7392 - DNA, 18 bp, Artificial sequence
  synthetic polynucleotide sequence
caggggcttgaggccgta

SEQ ID NO: 7393 - DNA, 18 bp, Artificial sequence
  synthetic polynucleotide sequence
gggtcacccctcagcaca

SEQ ID NO: 7394 - DNA, 18 bp, Artificial sequence
  synthetic polynucleotide sequence
tcaggtcatgacccacca

SEQ ID NO: 7395 - DNA, 18 bp, Artificial sequence
  synthetic polynucleotide sequence
cccagaagttgccacgga

SEQ ID NO: 7396 - DNA, 18 bp, Artificial sequence
  synthetic polynucleotide sequence
caatgctacatcgagcca

SEQ ID NO: 7397 - DNA, 18 bp, Artificial sequence
  synthetic polynucleotide sequence
gacaacgaggtgcagcca

SEQ ID NO: 7398 - DNA, 18 bp, Artificial sequence
  synthetic polynucleotide sequence
gcctcagggttcccagca

SEQ ID NO: 7399 - DNA, 18 bp, Artificial sequence
  synthetic polynucleotide sequence
cgtacctcgagtccgaga

SEQ ID NO: 7400 - DNA, 18 bp, Artificial sequence
  synthetic polynucleotide sequence
tggactgggactccacca

SEQ ID NO: 7401 - DNA, 18 bp, Artificial sequence
  synthetic polynucleotide sequence
ccgcatcaagcgcaagga

SEQ ID NO: 7402 - DNA, 18 bp, Artificial sequence
  synthetic polynucleotide sequence
gggacagcatggagcgga

SEQ ID NO: 7403 - DNA, 18 bp, Artificial sequence
  synthetic polynucleotide sequence
gcagtgggaactgcagca

SEQ ID NO: 7404 - DNA, 18 bp, Artificial sequence
  synthetic polynucleotide sequence
tgccaggacaggagggca

SEQ ID NO: 7405 - DNA, 18 bp, Artificial sequence
  synthetic polynucleotide sequence
agttggccgaggagtcga

SEQ ID NO: 7406 - DNA, 18 bp, Artificial sequence
  synthetic polynucleotide sequence
atcccggttcgagcgaga

SEQ ID NO: 7407 - DNA, 18 bp, Artificial sequence
  synthetic polynucleotide sequence
caatgggaagaccccaga

SEQ ID NO: 7408 - DNA, 18 bp, Artificial sequence
  synthetic polynucleotide sequence
gctgacaccagaaccgga

SEQ ID NO: 7409 - DNA, 18 bp, Artificial sequence
  synthetic polynucleotide sequence
actgccatatggagggaa

SEQ ID NO: 7410 - DNA, 18 bp, Artificial sequence
  synthetic polynucleotide sequence
gggtgacacggtactgca

SEQ ID NO: 7411 - DNA, 18 bp, Artificial sequence
  synthetic polynucleotide sequence
cctcagagagagagccca

SEQ ID NO: 7412 - DNA, 18 bp, Artificial sequence
  synthetic polynucleotide sequence
gacctggctcaggagaga

SEQ ID NO: 7413 - DNA, 18 bp, Artificial sequence
  synthetic polynucleotide sequence
agagttgccccgagcaca

SEQ ID NO: 7414 - DNA, 18 bp, Artificial sequence
  synthetic polynucleotide sequence
gcttcaagggcagggcta

SEQ ID NO: 7415 - DNA, 18 bp, Artificial sequence
  synthetic polynucleotide sequence
gatggacgcagccaacga

SEQ ID NO: 7416 - DNA, 18 bp, Artificial sequence
  synthetic polynucleotide sequence
ccagctcacacagcacca

SEQ ID NO: 7417 - DNA, 18 bp, Artificial sequence
  synthetic polynucleotide sequence
caggccatcatccccaca

SEQ ID NO: 7418 - DNA, 18 bp, Artificial sequence
  synthetic polynucleotide sequence
gatggggcactctagcca

SEQ ID NO: 7419 - DNA, 18 bp, Artificial sequence
  synthetic polynucleotide sequence
agccagcatactaccgaa

SEQ ID NO: 7420 - DNA, 18 bp, Artificial sequence
  synthetic polynucleotide sequence
gcattgaggtccacagca

SEQ ID NO: 7421 - DNA, 18 bp, Artificial sequence
  synthetic polynucleotide sequence
gcctcagaaggaggagga

SEQ ID NO: 7422 - DNA, 18 bp, Artificial sequence
  synthetic polynucleotide sequence
ttccagagcctggggaca

SEQ ID NO: 7423 - DNA, 18 bp, Artificial sequence
  synthetic polynucleotide sequence
ggctgccaaatgcaggca

SEQ ID NO: 7424 - DNA, 18 bp, Artificial sequence
  synthetic polynucleotide sequence
gcatcaagatcccagcga

SEQ ID NO: 7425 - DNA, 18 bp, Artificial sequence
  synthetic polynucleotide sequence
catgcagtctgagcggga

SEQ ID NO: 7426 - DNA, 18 bp, Artificial sequence
  synthetic polynucleotide sequence
tgaggaaggcagagccca

SEQ ID NO: 7427 - DNA, 18 bp, Artificial sequence
  synthetic polynucleotide sequence
gatggctgacgtggccaa

SEQ ID NO: 7428 - DNA, 18 bp, Artificial sequence
  synthetic polynucleotide sequence
cgcttcacatgggccaca

SEQ ID NO: 7429 - DNA, 18 bp, Artificial sequence
  synthetic polynucleotide sequence
catgcccacagagggaga

SEQ ID NO: 7430 - DNA, 18 bp, Artificial sequence
  synthetic polynucleotide sequence
cagtgtagcggtccagga

SEQ ID NO: 7431 - DNA, 18 bp, Artificial sequence
  synthetic polynucleotide sequence
tggcagaggtgtcccgaa

SEQ ID NO: 7432 - DNA, 18 bp, Artificial sequence
  synthetic polynucleotide sequence
atggaggggcttcaggca

SEQ ID NO: 7433 - DNA, 18 bp, Artificial sequence
  synthetic polynucleotide sequence
cgagtacgtgccacacca

SEQ ID NO: 7434 - DNA, 18 bp, Artificial sequence
  synthetic polynucleotide sequence
cagcagggtgaacacgga

SEQ ID NO: 7435 - DNA, 18 bp, Artificial sequence
  synthetic polynucleotide sequence
gcaaggtgagcgggacca

SEQ ID NO: 7436 - DNA, 18 bp, Artificial sequence
  synthetic polynucleotide sequence
gcactgagcaactccaca

SEQ ID NO: 7437 - DNA, 18 bp, Artificial sequence
  synthetic polynucleotide sequence
gggtcaagacctcaccca

SEQ ID NO: 7438 - DNA, 18 bp, Artificial sequence
  synthetic polynucleotide sequence
acccccacccagagcaca

SEQ ID NO: 7439 - DNA, 18 bp, Artificial sequence
  synthetic polynucleotide sequence
aggtagaaagtcgggaca

SEQ ID NO: 7440 - DNA, 18 bp, Artificial sequence
  synthetic polynucleotide sequence
attccagcaaccacacca

SEQ ID NO: 7441 - DNA, 18 bp, Artificial sequence
  synthetic polynucleotide sequence
cagttcccaaagtagcga

SEQ ID NO: 7442 - DNA, 18 bp, Artificial sequence
  synthetic polynucleotide sequence
gtgtcgaggctggccaca

SEQ ID NO: 7443 - DNA, 18 bp, Artificial sequence
  synthetic polynucleotide sequence
tggcatccagaccctgga

SEQ ID NO: 7444 - DNA, 18 bp, Artificial sequence
  synthetic polynucleotide sequence
ggccatatacagtcacca

SEQ ID NO: 7445 - DNA, 18 bp, Artificial sequence
  synthetic polynucleotide sequence
gagtgcaagtggaggaga

SEQ ID NO: 7446 - DNA, 18 bp, Artificial sequence
  synthetic polynucleotide sequence
ccacaccgttggcctcca

SEQ ID NO: 7447 - DNA, 18 bp, Artificial sequence
  synthetic polynucleotide sequence
tgagcgctacaacggcca

SEQ ID NO: 7448 - DNA, 18 bp, Artificial sequence
  synthetic polynucleotide sequence
gcatacgttgcagcggca

SEQ ID NO: 7449 - DNA, 18 bp, Artificial sequence
  synthetic polynucleotide sequence
gggagccctacatgacga

SEQ ID NO: 7450 - DNA, 18 bp, Artificial sequence
  synthetic polynucleotide sequence
cggcaaggccaatgagca

SEQ ID NO: 7451 - DNA, 18 bp, Artificial sequence
  synthetic polynucleotide sequence
ggaggaccagaagggcaa

SEQ ID NO: 7452 - DNA, 18 bp, Artificial sequence
  synthetic polynucleotide sequence
ccgttgaagctgcagcga

SEQ ID NO: 7453 - DNA, 18 bp, Artificial sequence
  synthetic polynucleotide sequence
gcagtgccaatgcacgga

SEQ ID NO: 7454 - DNA, 18 bp, Artificial sequence
  synthetic polynucleotide sequence
tcccagagtggagcagca

SEQ ID NO: 7455 - DNA, 18 bp, Artificial sequence
  synthetic polynucleotide sequence
atccctcctgcagcggaa

SEQ ID NO: 7456 - DNA, 18 bp, Artificial sequence
  synthetic polynucleotide sequence
tccagccgctcctgcaca

SEQ ID NO: 7457 - DNA, 18 bp, Artificial sequence
  synthetic polynucleotide sequence
atgcgagagacaccggga

SEQ ID NO: 7458 - DNA, 18 bp, Artificial sequence
  synthetic polynucleotide sequence
agataggggccaaggcca

SEQ ID NO: 7459 - DNA, 18 bp, Artificial sequence
  synthetic polynucleotide sequence
ttcagcagcagcccagca

SEQ ID NO: 7460 - DNA, 18 bp, Artificial sequence
  synthetic polynucleotide sequence
gttcacagaagcggccga

SEQ ID NO: 7461 - DNA, 18 bp, Artificial sequence
  synthetic polynucleotide sequence
tgtcagctgaggagagca

SEQ ID NO: 7462 - DNA, 18 bp, Artificial sequence
  synthetic polynucleotide sequence
cggcgatctcctggagga

SEQ ID NO: 7463 - DNA, 18 bp, Artificial sequence
  synthetic polynucleotide sequence
ccacgatggtggtgagga

SEQ ID NO: 7464 - DNA, 18 bp, Artificial sequence
  synthetic polynucleotide sequence
tcgatgagtccagcccca

SEQ ID NO: 7465 - DNA, 18 bp, Artificial sequence
  synthetic polynucleotide sequence
agaagccagaggccagca

SEQ ID NO: 7466 - DNA, 18 bp, Artificial sequence
  synthetic polynucleotide sequence
agctgtagagctgaggca

SEQ ID NO: 7467 - DNA, 18 bp, Artificial sequence
  synthetic polynucleotide sequence
ctggcgacaagagaggca

SEQ ID NO: 7468 - DNA, 18 bp, Artificial sequence
  synthetic polynucleotide sequence
gcacggccctgttccaca

SEQ ID NO: 7469 - DNA, 18 bp, Artificial sequence
  synthetic polynucleotide sequence
ccggcctgaagatgacca

SEQ ID NO: 7470 - DNA, 18 bp, Artificial sequence
  synthetic polynucleotide sequence
ctccaacgtggctggaga

SEQ ID NO: 7471 - DNA, 18 bp, Artificial sequence
  synthetic polynucleotide sequence
cccctccaaatggccaca

SEQ ID NO: 7472 - DNA, 18 bp, Artificial sequence
  synthetic polynucleotide sequence
ggcgttggcagacacgga

SEQ ID NO: 7473 - DNA, 18 bp, Artificial sequence
  synthetic polynucleotide sequence
gcctacctggaagaggca

SEQ ID NO: 7474 - DNA, 18 bp, Artificial sequence
  synthetic polynucleotide sequence
gcacaccaaatgaccaca

SEQ ID NO: 7475 - DNA, 18 bp, Artificial sequence
  synthetic polynucleotide sequence
ggacggcaactgggccaa

SEQ ID NO: 7476 - DNA, 18 bp, Artificial sequence
  synthetic polynucleotide sequence
ccagtgctgcatggggga

SEQ ID NO: 7477 - DNA, 18 bp, Artificial sequence
  synthetic polynucleotide sequence
ggatggcaactgggccaa

SEQ ID NO: 7478 - DNA, 18 bp, Artificial sequence
  synthetic polynucleotide sequence
ccaatgctgcatggggga

SEQ ID NO: 7479 - DNA, 18 bp, Artificial sequence
  synthetic polynucleotide sequence
aaactggcgagtggcaga

SEQ ID NO: 7480 - DNA, 18 bp, Artificial sequence
  synthetic polynucleotide sequence
agaggtctctgcgacgaa

SEQ ID NO: 7481 - DNA, 18 bp, Artificial sequence
  synthetic polynucleotide sequence
ggactgcaaggacccaga

SEQ ID NO: 7482 - DNA, 18 bp, Artificial sequence
  synthetic polynucleotide sequence
agctggggcatctgcaga

SEQ ID NO: 7483 - DNA, 18 bp, Artificial sequence
  synthetic polynucleotide sequence
acccagaggctgccagga

SEQ ID NO: 7484 - DNA, 18 bp, Artificial sequence
  synthetic polynucleotide sequence
cccggaagcgatgggaga

SEQ ID NO: 7485 - DNA, 18 bp, Artificial sequence
  synthetic polynucleotide sequence
aggagggcctgaacgcca

SEQ ID NO: 7486 - DNA, 18 bp, Artificial sequence
  synthetic polynucleotide sequence
gtgagggcctctggacca

SEQ ID NO: 7487 - DNA, 18 bp, Artificial sequence
  synthetic polynucleotide sequence
cgtacgaccttgcgccaa

SEQ ID NO: 7488 - DNA, 18 bp, Artificial sequence
  synthetic polynucleotide sequence
cactgtcctgcaccccca

SEQ ID NO: 7489 - DNA, 18 bp, Artificial sequence
  synthetic polynucleotide sequence
gtggtctggagagggaca

SEQ ID NO: 7490 - DNA, 18 bp, Artificial sequence
  synthetic polynucleotide sequence
ttcacgcggaccagcaca

SEQ ID NO: 7491 - DNA, 18 bp, Artificial sequence
  synthetic polynucleotide sequence
acgactacaccgcgcaga

SEQ ID NO: 7492 - DNA, 18 bp, Artificial sequence
  synthetic polynucleotide sequence
tggatgggaagagcccca

SEQ ID NO: 7493 - DNA, 18 bp, Artificial sequence
  synthetic polynucleotide sequence
ccaccctgaccaagccca

SEQ ID NO: 7494 - DNA, 18 bp, Artificial sequence
  synthetic polynucleotide sequence
tggaattcacagagccca

SEQ ID NO: 7495 - DNA, 18 bp, Artificial sequence
  synthetic polynucleotide sequence
gggccgtgctgatgggca

SEQ ID NO: 7496 - DNA, 18 bp, Artificial sequence
  synthetic polynucleotide sequence
aggacgccacaaggtcca

SEQ ID NO: 7497 - DNA, 18 bp, Artificial sequence
  synthetic polynucleotide sequence
gcgaaacatcttccggga

SEQ ID NO: 7498 - DNA, 18 bp, Artificial sequence
  synthetic polynucleotide sequence
agttcaggaggccctgga

SEQ ID NO: 7499 - DNA, 18 bp, Artificial sequence
  synthetic polynucleotide sequence
ggtgccaagtgccaggaa

SEQ ID NO: 7500 - DNA, 18 bp, Artificial sequence
  synthetic polynucleotide sequence
gcaaggtcgagggccaca

SEQ ID NO: 7501 - DNA, 16 bp, Artificial sequence
  synthetic polynucleotide sequence
gcgaccagtacggcaa

SEQ ID NO: 7502 - DNA, 16 bp, Artificial sequence
  synthetic polynucleotide sequence
cggggtaggggacaca

SEQ ID NO: 7503 - DNA, 18 bp, Artificial sequence
  synthetic polynucleotide sequence
gctctaccgccatggcaa

SEQ ID NO: 7504 - DNA, 18 bp, Artificial sequence
  synthetic polynucleotide sequence
gccaggcatgcacttgca

SEQ ID NO: 7505 - DNA, 18 bp, Artificial sequence
  synthetic polynucleotide sequence
ctgcaggtatgaccccga

SEQ ID NO: 7506 - DNA, 18 bp, Artificial sequence
  synthetic polynucleotide sequence
aggcttcccgaaggcaga

SEQ ID NO: 7507 - DNA, 18 bp, Artificial sequence
  synthetic polynucleotide sequence
tggcagcaacagagccta

SEQ ID NO: 7508 - DNA, 18 bp, Artificial sequence
  synthetic polynucleotide sequence
cactgccatcccaagaca

SEQ ID NO: 7509 - DNA, 18 bp, Artificial sequence
  synthetic polynucleotide sequence
gatgggatgtgagcggga

SEQ ID NO: 7510 - DNA, 18 bp, Artificial sequence
  synthetic polynucleotide sequence
gggtgagcagtgaaggca

SEQ ID NO: 7511 - DNA, 18 bp, Artificial sequence
  synthetic polynucleotide sequence
tgatgccctgcagcagga

SEQ ID NO: 7512 - DNA, 18 bp, Artificial sequence
  synthetic polynucleotide sequence
tccactgctccacggcca

SEQ ID NO: 7513 - DNA, 18 bp, Artificial sequence
  synthetic polynucleotide sequence
ggtgtgaggagcaggaga

SEQ ID NO: 7514 - DNA, 18 bp, Artificial sequence
  synthetic polynucleotide sequence
ccaacgtgatcagggcca

SEQ ID NO: 7515 - DNA, 18 bp, Artificial sequence
  synthetic polynucleotide sequence
cctggatgagctcaggga

SEQ ID NO: 7516 - DNA, 18 bp, Artificial sequence
  synthetic polynucleotide sequence
cgcagagcacactccaga

SEQ ID NO: 7517 - DNA, 18 bp, Artificial sequence
  synthetic polynucleotide sequence
ggaccacagagagtgcca

SEQ ID NO: 7518 - DNA, 18 bp, Artificial sequence
  synthetic polynucleotide sequence
acatccaggaactgggca

SEQ ID NO: 7519 - DNA, 18 bp, Artificial sequence
  synthetic polynucleotide sequence
gaggcaggcagacagcaa

SEQ ID NO: 7520 - DNA, 18 bp, Artificial sequence
  synthetic polynucleotide sequence
tatcagggacctccacca

SEQ ID NO: 7521 - DNA, 18 bp, Artificial sequence
  synthetic polynucleotide sequence
cggggaaaaagagttcca

SEQ ID NO: 7522 - DNA, 18 bp, Artificial sequence
  synthetic polynucleotide sequence
caccaactggatcactca

SEQ ID NO: 7523 - DNA, 18 bp, Artificial sequence
  synthetic polynucleotide sequence
aggctgtctcacagggca

SEQ ID NO: 7524 - DNA, 18 bp, Artificial sequence
  synthetic polynucleotide sequence
ggtagtatcggcagcaga

SEQ ID NO: 7525 - DNA, 18 bp, Artificial sequence
  synthetic polynucleotide sequence
catgcccgactggcacca

SEQ ID NO: 7526 - DNA, 18 bp, Artificial sequence
  synthetic polynucleotide sequence
gcgcaaccaaggaggcca

SEQ ID NO: 7527 - DNA, 18 bp, Artificial sequence
  synthetic polynucleotide sequence
agatcgctggctgccgaa

SEQ ID NO: 7528 - DNA, 18 bp, Artificial sequence
  synthetic polynucleotide sequence
ggctgcagtagtcgggga

SEQ ID NO: 7529 - DNA, 18 bp, Artificial sequence
  synthetic polynucleotide sequence
gaagcaagagcaccccga

SEQ ID NO: 7530 - DNA, 18 bp, Artificial sequence
  synthetic polynucleotide sequence
gagtcggagtctgacgaa

SEQ ID NO: 7531 - DNA, 18 bp, Artificial sequence
  synthetic polynucleotide sequence
cactactccccaccccca

SEQ ID NO: 7532 - DNA, 18 bp, Artificial sequence
  synthetic polynucleotide sequence
ccagcgcttacgaccgta

SEQ ID NO: 7533 - DNA, 18 bp, Artificial sequence
  synthetic polynucleotide sequence
cgagatgaccgagcagga

SEQ ID NO: 7534 - DNA, 18 bp, Artificial sequence
  synthetic polynucleotide sequence
ggtgaagagcacctggga

SEQ ID NO: 7535 - DNA, 18 bp, Artificial sequence
  synthetic polynucleotide sequence
gaggcagcactccaagca

SEQ ID NO: 7536 - DNA, 18 bp, Artificial sequence
  synthetic polynucleotide sequence
gggcctcgaacttaggca

SEQ ID NO: 7537 - DNA, 18 bp, Artificial sequence
  synthetic polynucleotide sequence
gcaggccctgaaggagga

SEQ ID NO: 7538 - DNA, 18 bp, Artificial sequence
  synthetic polynucleotide sequence
ccatgtcgatgggggaca

SEQ ID NO: 7539 - DNA, 18 bp, Artificial sequence
  synthetic polynucleotide sequence
tcaaggaggaaccgcaga

SEQ ID NO: 7540 - DNA, 18 bp, Artificial sequence
  synthetic polynucleotide sequence
gcagccgcttgcgctcca

SEQ ID NO: 7541 - DNA, 18 bp, Artificial sequence
  synthetic polynucleotide sequence
gcgtgctggtgacaagga

SEQ ID NO: 7542 - DNA, 18 bp, Artificial sequence
  synthetic polynucleotide sequence
gcacagagttctgggcca

SEQ ID NO: 7543 - DNA, 18 bp, Artificial sequence
  synthetic polynucleotide sequence
gcgtgtgcccacaacaga

SEQ ID NO: 7544 - DNA, 18 bp, Artificial sequence
  synthetic polynucleotide sequence
acctgcttcgcccaggca

SEQ ID NO: 7545 - DNA, 18 bp, Artificial sequence
  synthetic polynucleotide sequence
ctccaaggcagtgcacca

SEQ ID NO: 7546 - DNA, 18 bp, Artificial sequence
  synthetic polynucleotide sequence
ccgggctcgatgtaggga

SEQ ID NO: 7547 - DNA, 18 bp, Artificial sequence
  synthetic polynucleotide sequence
agcgcaaacaggcccaga

SEQ ID NO: 7548 - DNA, 18 bp, Artificial sequence
  synthetic polynucleotide sequence
ccaggaacgctctccaca

SEQ ID NO: 7549 - DNA, 18 bp, Artificial sequence
  synthetic polynucleotide sequence
ccagggatgaggcggcaa

SEQ ID NO: 7550 - DNA, 18 bp, Artificial sequence
  synthetic polynucleotide sequence
ctgtaggccaaccagcca

SEQ ID NO: 7551 - DNA, 18 bp, Artificial sequence
  synthetic polynucleotide sequence
ccccagcaccaaaggcaa

SEQ ID NO: 7552 - DNA, 18 bp, Artificial sequence
  synthetic polynucleotide sequence
taggagagacggcccaga

SEQ ID NO: 7553 - DNA, 18 bp, Artificial sequence
  synthetic polynucleotide sequence
agcaaaaggcagggagga

SEQ ID NO: 7554 - DNA, 18 bp, Artificial sequence
  synthetic polynucleotide sequence
attgccatcaaggacgca

SEQ ID NO: 7555 - DNA, 18 bp, Artificial sequence
  synthetic polynucleotide sequence
cgctgtggccatcaacga

SEQ ID NO: 7556 - DNA, 18 bp, Artificial sequence
  synthetic polynucleotide sequence
gcaggacggtggtgcaca

SEQ ID NO: 7557 - DNA, 18 bp, Artificial sequence
  synthetic polynucleotide sequence
ggaaggatggcttggaca

SEQ ID NO: 7558 - DNA, 18 bp, Artificial sequence
  synthetic polynucleotide sequence
cctcatcactgggacgca

SEQ ID NO: 7559 - DNA, 18 bp, Artificial sequence
  synthetic polynucleotide sequence
agtgcccgtgcagcagca

SEQ ID NO: 7560 - DNA, 18 bp, Artificial sequence
  synthetic polynucleotide sequence
caggcagtggtatcggga

SEQ ID NO: 7561 - DNA, 18 bp, Artificial sequence
  synthetic polynucleotide sequence
ccgagaaactgaggggga

SEQ ID NO: 7562 - DNA, 18 bp, Artificial sequence
  synthetic polynucleotide sequence
gtagaggaactgcggcga

SEQ ID NO: 7563 - DNA, 18 bp, Artificial sequence
  synthetic polynucleotide sequence
cgagctggccgaacgaca

SEQ ID NO: 7564 - DNA, 18 bp, Artificial sequence
  synthetic polynucleotide sequence
gcaatcccagctcccgca

SEQ ID NO: 7565 - DNA, 18 bp, Artificial sequence
  synthetic polynucleotide sequence
acggggacatgtacccca

SEQ ID NO: 7566 - DNA, 18 bp, Artificial sequence
  synthetic polynucleotide sequence
tggagacgatgacgggca

SEQ ID NO: 7567 - DNA, 18 bp, Artificial sequence
  synthetic polynucleotide sequence
tactggggcacctcgaga

SEQ ID NO: 7568 - DNA, 18 bp, Artificial sequence
  synthetic polynucleotide sequence
tccacaggcaagtggaga

SEQ ID NO: 7569 - DNA, 18 bp, Artificial sequence
  synthetic polynucleotide sequence
cccaaacatggtcaggca

SEQ ID NO: 7570 - DNA, 18 bp, Artificial sequence
  synthetic polynucleotide sequence
gagcttgcctgaggagca

SEQ ID NO: 7571 - DNA, 18 bp, Artificial sequence
  synthetic polynucleotide sequence
ggtgcccaagaacgacga

SEQ ID NO: 7572 - DNA, 18 bp, Artificial sequence
  synthetic polynucleotide sequence
aagcccagctcagaggca

SEQ ID NO: 7573 - DNA, 18 bp, Artificial sequence
  synthetic polynucleotide sequence
cagtgacggcaagctgga

SEQ ID NO: 7574 - DNA, 18 bp, Artificial sequence
  synthetic polynucleotide sequence
gccaggcatcggactcga

SEQ ID NO: 7575 - DNA, 18 bp, Artificial sequence
  synthetic polynucleotide sequence
tggggccagacaaccaga

SEQ ID NO: 7576 - DNA, 18 bp, Artificial sequence
  synthetic polynucleotide sequence
agcgggtgtatcccagga

SEQ ID NO: 7577 - DNA, 18 bp, Artificial sequence
  synthetic polynucleotide sequence
ccgtgggctacggcgaca

SEQ ID NO: 7578 - DNA, 19 bp, Artificial sequence
  synthetic polynucleotide sequence
gctcggagtaggagcgcga

SEQ ID NO: 7579 - DNA, 18 bp, Artificial sequence
  synthetic polynucleotide sequence
ctacgtggccgagaagga

SEQ ID NO: 7580 - DNA, 18 bp, Artificial sequence
  synthetic polynucleotide sequence
tgaggatcccgctcagga

SEQ ID NO: 7581 - DNA, 18 bp, Artificial sequence
  synthetic polynucleotide sequence
aggctggcagctgagaga

SEQ ID NO: 7582 - DNA, 18 bp, Artificial sequence
  synthetic polynucleotide sequence
tggcaggactctcacgca

SEQ ID NO: 7583 - DNA, 18 bp, Artificial sequence
  synthetic polynucleotide sequence
ggtcctacaccaacggca

SEQ ID NO: 7584 - DNA, 18 bp, Artificial sequence
  synthetic polynucleotide sequence
agtacagggcggtgagca

SEQ ID NO: 7585 - DNA, 18 bp, Artificial sequence
  synthetic polynucleotide sequence
tgtgcgtccagaccacca

SEQ ID NO: 7586 - DNA, 18 bp, Artificial sequence
  synthetic polynucleotide sequence
ctcaagtccaggagcgca

SEQ ID NO: 7587 - DNA, 18 bp, Artificial sequence
  synthetic polynucleotide sequence
ggagcagcccccaacgaa

SEQ ID NO: 7588 - DNA, 18 bp, Artificial sequence
  synthetic polynucleotide sequence
tccgaagaggagcagaca

SEQ ID NO: 7589 - DNA, 18 bp, Artificial sequence
  synthetic polynucleotide sequence
ctcaaggagactccagca

SEQ ID NO: 7590 - DNA, 18 bp, Artificial sequence
  synthetic polynucleotide sequence
ctcccggagtgcagggta

SEQ ID NO: 7591 - DNA, 18 bp, Artificial sequence
  synthetic polynucleotide sequence
gggagatgccaccaccta

SEQ ID NO: 7592 - DNA, 18 bp, Artificial sequence
  synthetic polynucleotide sequence
agcaggatggagaggcca

SEQ ID NO: 7593 - DNA, 18 bp, Artificial sequence
  synthetic polynucleotide sequence
acctgccaagtccggaca

SEQ ID NO: 7594 - DNA, 18 bp, Artificial sequence
  synthetic polynucleotide sequence
aggcacatggcacagtga

SEQ ID NO: 7595 - DNA, 18 bp, Artificial sequence
  synthetic polynucleotide sequence
accaggtggacatcccca

SEQ ID NO: 7596 - DNA, 18 bp, Artificial sequence
  synthetic polynucleotide sequence
cgccttccaggatgacga

SEQ ID NO: 7597 - DNA, 18 bp, Artificial sequence
  synthetic polynucleotide sequence
cgctggaccagatcgaca

SEQ ID NO: 7598 - DNA, 18 bp, Artificial sequence
  synthetic polynucleotide sequence
ccaccatgccttccagga

SEQ ID NO: 7599 - DNA, 18 bp, Artificial sequence
  synthetic polynucleotide sequence
gccaagatggcaaagcca

SEQ ID NO: 7600 - DNA, 18 bp, Artificial sequence
  synthetic polynucleotide sequence
gaacatgagcttccacca

SEQ ID NO: 7601 - DNA, 18 bp, Artificial sequence
  synthetic polynucleotide sequence
ggctcacagaagggcaga

SEQ ID NO: 7602 - DNA, 18 bp, Artificial sequence
  synthetic polynucleotide sequence
accacctggatgcgcaca

SEQ ID NO: 7603 - DNA, 18 bp, Artificial sequence
  synthetic polynucleotide sequence
caccatcggcttcggcga

SEQ ID NO: 7604 - DNA, 18 bp, Artificial sequence
  synthetic polynucleotide sequence
aggttgaggaaggcgcca

SEQ ID NO: 7605 - DNA, 18 bp, Artificial sequence
  synthetic polynucleotide sequence
ggagtgccctggacgcca

SEQ ID NO: 7606 - DNA, 18 bp, Artificial sequence
  synthetic polynucleotide sequence
atgctcaggacagcagca

SEQ ID NO: 7607 - DNA, 18 bp, Artificial sequence
  synthetic polynucleotide sequence
gcgcagatcacgtgcaca

SEQ ID NO: 7608 - DNA, 18 bp, Artificial sequence
  synthetic polynucleotide sequence
agatccagagctccacga

SEQ ID NO: 7609 - DNA, 18 bp, Artificial sequence
  synthetic polynucleotide sequence
tcagctcgctcagcacca

SEQ ID NO: 7610 - DNA, 18 bp, Artificial sequence
  synthetic polynucleotide sequence
aggtctccactgccagca

SEQ ID NO: 7611 - DNA, 18 bp, Artificial sequence
  synthetic polynucleotide sequence
ctggggtcaacatcccca

SEQ ID NO: 7612 - DNA, 18 bp, Artificial sequence
  synthetic polynucleotide sequence
tccaggacactgacggca

SEQ ID NO: 7613 - DNA, 18 bp, Artificial sequence
  synthetic polynucleotide sequence
ctcgggggaacgaaacca

SEQ ID NO: 7614 - DNA, 18 bp, Artificial sequence
  synthetic polynucleotide sequence
cgccaggatggacaggta

SEQ ID NO: 7615 - DNA, 18 bp, Artificial sequence
  synthetic polynucleotide sequence
ccgaagagtctcaatgca

SEQ ID NO: 7616 - DNA, 18 bp, Artificial sequence
  synthetic polynucleotide sequence
aacgtacacctggaggca

SEQ ID NO: 7617 - DNA, 18 bp, Artificial sequence
  synthetic polynucleotide sequence
tggagcatctcaccgcca

SEQ ID NO: 7618 - DNA, 18 bp, Artificial sequence
  synthetic polynucleotide sequence
ggcctcgatgatggcaga

SEQ ID NO: 7619 - DNA, 18 bp, Artificial sequence
  synthetic polynucleotide sequence
acgcttcctaccgcagca

SEQ ID NO: 7620 - DNA, 18 bp, Artificial sequence
  synthetic polynucleotide sequence
ccacgtcaccatagccga

SEQ ID NO: 7621 - DNA, 18 bp, Artificial sequence
  synthetic polynucleotide sequence
acagctgcgggaacacca

SEQ ID NO: 7622 - DNA, 18 bp, Artificial sequence
  synthetic polynucleotide sequence
gctcaatgacgtcccgca

SEQ ID NO: 7623 - DNA, 18 bp, Artificial sequence
  synthetic polynucleotide sequence
gcagcacaggcagaagca

SEQ ID NO: 7624 - DNA, 18 bp, Artificial sequence
  synthetic polynucleotide sequence
gcaggtctgtgcgcgaga

SEQ ID NO: 7625 - DNA, 18 bp, Artificial sequence
  synthetic polynucleotide sequence
cgtatgtggagaggccca

SEQ ID NO: 7626 - DNA, 18 bp, Artificial sequence
  synthetic polynucleotide sequence
tgaccgacatcagggaca

SEQ ID NO: 7627 - DNA, 18 bp, Artificial sequence
  synthetic polynucleotide sequence
gggtcccgaagagacaga

SEQ ID NO: 7628 - DNA, 18 bp, Artificial sequence
  synthetic polynucleotide sequence
tgaggcaagctgagggca

SEQ ID NO: 7629 - DNA, 18 bp, Artificial sequence
  synthetic polynucleotide sequence
ggaggactacatggcgga

SEQ ID NO: 7630 - DNA, 18 bp, Artificial sequence
  synthetic polynucleotide sequence
ggcggaacatgaaggcca

SEQ ID NO: 7631 - DNA, 18 bp, Artificial sequence
  synthetic polynucleotide sequence
gggacccctgcacccaca

SEQ ID NO: 7632 - DNA, 18 bp, Artificial sequence
  synthetic polynucleotide sequence
catactccacctcgggga

SEQ ID NO: 7633 - DNA, 18 bp, Artificial sequence
  synthetic polynucleotide sequence
gctcaacgagagccgcga

SEQ ID NO: 7634 - DNA, 18 bp, Artificial sequence
  synthetic polynucleotide sequence
ccgaggagttacacgcca

SEQ ID NO: 7635 - DNA, 18 bp, Artificial sequence
  synthetic polynucleotide sequence
catgtggccaaatcccca

SEQ ID NO: 7636 - DNA, 18 bp, Artificial sequence
  synthetic polynucleotide sequence
ctggatccacagcaggga

SEQ ID NO: 7637 - DNA, 18 bp, Artificial sequence
  synthetic polynucleotide sequence
gagacagccgagaggaga

SEQ ID NO: 7638 - DNA, 18 bp, Artificial sequence
  synthetic polynucleotide sequence
ccagactgtcgcccagca

SEQ ID NO: 7639 - DNA, 18 bp, Artificial sequence
  synthetic polynucleotide sequence
tctctgggaagagccaga

SEQ ID NO: 7640 - DNA, 18 bp, Artificial sequence
  synthetic polynucleotide sequence
ggccaatgactgggacca

SEQ ID NO: 7641 - DNA, 18 bp, Artificial sequence
  synthetic polynucleotide sequence
ctgaagcagcagccacca

SEQ ID NO: 7642 - DNA, 18 bp, Artificial sequence
  synthetic polynucleotide sequence
ggatcccagaacacccga

SEQ ID NO: 7643 - DNA, 18 bp, Artificial sequence
  synthetic polynucleotide sequence
ggccaggtcagatggaca

SEQ ID NO: 7644 - DNA, 18 bp, Artificial sequence
  synthetic polynucleotide sequence
gatgatgagccgcaggga

SEQ ID NO: 7645 - DNA, 18 bp, Artificial sequence
  synthetic polynucleotide sequence
ggcctcaaggactaacca

SEQ ID NO: 7646 - DNA, 18 bp, Artificial sequence
  synthetic polynucleotide sequence
ggtcttgcaagcacagca

SEQ ID NO: 7647 - DNA, 18 bp, Artificial sequence
  synthetic polynucleotide sequence
ggccaatgttggggacca

SEQ ID NO: 7648 - DNA, 18 bp, Artificial sequence
  synthetic polynucleotide sequence
tctcccgtacaccacgca

SEQ ID NO: 7649 - DNA, 18 bp, Artificial sequence
  synthetic polynucleotide sequence
gccaggtggtcatcacca

SEQ ID NO: 7650 - DNA, 18 bp, Artificial sequence
  synthetic polynucleotide sequence
gggtcccagctggacaca

SEQ ID NO: 7651 - DNA, 18 bp, Artificial sequence
  synthetic polynucleotide sequence
gcaggctctagccacaga

SEQ ID NO: 7652 - DNA, 18 bp, Artificial sequence
  synthetic polynucleotide sequence
gagccgcctgttccacca

SEQ ID NO: 7653 - DNA, 18 bp, Artificial sequence
  synthetic polynucleotide sequence
cctgcagccagaaggaga

SEQ ID NO: 7654 - DNA, 18 bp, Artificial sequence
  synthetic polynucleotide sequence
gccatctctggggagaca

SEQ ID NO: 7655 - DNA, 18 bp, Artificial sequence
  synthetic polynucleotide sequence
gccctcacttgcagcaga

SEQ ID NO: 7656 - DNA, 18 bp, Artificial sequence
  synthetic polynucleotide sequence
gtgcggacaactggcaca

SEQ ID NO: 7657 - DNA, 18 bp, Artificial sequence
  synthetic polynucleotide sequence
ccacctccaagaccacca

SEQ ID NO: 7658 - DNA, 18 bp, Artificial sequence
  synthetic polynucleotide sequence
agagctccagcaaggcca

SEQ ID NO: 7659 - DNA, 18 bp, Artificial sequence
  synthetic polynucleotide sequence
gggtaacatccacgggca

SEQ ID NO: 7660 - DNA, 18 bp, Artificial sequence
  synthetic polynucleotide sequence
ctcgtgcaccgcgaacca

SEQ ID NO: 7661 - DNA, 18 bp, Artificial sequence
  synthetic polynucleotide sequence
agcccagtcagagaccca

SEQ ID NO: 7662 - DNA, 18 bp, Artificial sequence
  synthetic polynucleotide sequence
acaggtgaggtaggcaga

SEQ ID NO: 7663 - DNA, 18 bp, Artificial sequence
  synthetic polynucleotide sequence
ccaccagacacagacaca

SEQ ID NO: 7664 - DNA, 18 bp, Artificial sequence
  synthetic polynucleotide sequence
tactggagccatcccaca

SEQ ID NO: 7665 - DNA, 18 bp, Artificial sequence
  synthetic polynucleotide sequence
ccatgaagcaccggcgaa

SEQ ID NO: 7666 - DNA, 18 bp, Artificial sequence
  synthetic polynucleotide sequence
gctccatggtgacagcca

SEQ ID NO: 7667 - DNA, 18 bp, Artificial sequence
  synthetic polynucleotide sequence
gaggctgttacggcacca

SEQ ID NO: 7668 - DNA, 18 bp, Artificial sequence
  synthetic polynucleotide sequence
caccacgtgcacagcgga

SEQ ID NO: 7669 - DNA, 18 bp, Artificial sequence
  synthetic polynucleotide sequence
gcagctaaacatggccaa

SEQ ID NO: 7670 - DNA, 18 bp, Artificial sequence
  synthetic polynucleotide sequence
gagcactgattcggggaa

SEQ ID NO: 7671 - DNA, 18 bp, Artificial sequence
  synthetic polynucleotide sequence
cccccaccacctggacga

SEQ ID NO: 7672 - DNA, 18 bp, Artificial sequence
  synthetic polynucleotide sequence
gggctcgaggggtaggga

SEQ ID NO: 7673 - DNA, 18 bp, Artificial sequence
  synthetic polynucleotide sequence
gcggctccacaatgggaa

SEQ ID NO: 7674 - DNA, 18 bp, Artificial sequence
  synthetic polynucleotide sequence
gtcaccccggtctccaca

SEQ ID NO: 7675 - DNA, 18 bp, Artificial sequence
  synthetic polynucleotide sequence
cgtagagatctcccggca

SEQ ID NO: 7676 - DNA, 18 bp, Artificial sequence
  synthetic polynucleotide sequence
gcctggtccaactgggca

SEQ ID NO: 7677 - DNA, 18 bp, Artificial sequence
  synthetic polynucleotide sequence
tgggaagggtgtggcaca

SEQ ID NO: 7678 - DNA, 18 bp, Artificial sequence
  synthetic polynucleotide sequence
actccagacagggcagca

SEQ ID NO: 7679 - DNA, 18 bp, Artificial sequence
  synthetic polynucleotide sequence
gctccgtgccatgaagca

SEQ ID NO: 7680 - DNA, 18 bp, Artificial sequence
  synthetic polynucleotide sequence
ccaaccggcttctccaca

SEQ ID NO: 7681 - DNA, 18 bp, Artificial sequence
  synthetic polynucleotide sequence
gctgtggacacacaggga

SEQ ID NO: 7682 - DNA, 18 bp, Artificial sequence
  synthetic polynucleotide sequence
ccacaaggaccagggaca

SEQ ID NO: 7683 - DNA, 18 bp, Artificial sequence
  synthetic polynucleotide sequence
tccaccactcaagaggga

SEQ ID NO: 7684 - DNA, 18 bp, Artificial sequence
  synthetic polynucleotide sequence
taccggagccgcttcaca

SEQ ID NO: 7685 - DNA, 18 bp, Artificial sequence
  synthetic polynucleotide sequence
ctgctgaagtggcccgaa

SEQ ID NO: 7686 - DNA, 18 bp, Artificial sequence
  synthetic polynucleotide sequence
agggggtcgcagtgacca

SEQ ID NO: 7687 - DNA, 18 bp, Artificial sequence
  synthetic polynucleotide sequence
ggtgaacaggacccagga

SEQ ID NO: 7688 - DNA, 18 bp, Artificial sequence
  synthetic polynucleotide sequence
cttcacgcctcggaagga

SEQ ID NO: 7689 - DNA, 18 bp, Artificial sequence
  synthetic polynucleotide sequence
ggtgttcggggaagacca

SEQ ID NO: 7690 - DNA, 18 bp, Artificial sequence
  synthetic polynucleotide sequence
cgttctccaggaagcgca

SEQ ID NO: 7691 - DNA, 18 bp, Artificial sequence
  synthetic polynucleotide sequence
gctcaggggttagaggga

SEQ ID NO: 7692 - DNA, 18 bp, Artificial sequence
  synthetic polynucleotide sequence
tgcagccagcccttcaga

SEQ ID NO: 7693 - DNA, 18 bp, Artificial sequence
  synthetic polynucleotide sequence
cgccctacctcacaagca

SEQ ID NO: 7694 - DNA, 18 bp, Artificial sequence
  synthetic polynucleotide sequence
ggggttgatggggcagca

SEQ ID NO: 7695 - DNA, 18 bp, Artificial sequence
  synthetic polynucleotide sequence
ggactccagtgggacaca

SEQ ID NO: 7696 - DNA, 18 bp, Artificial sequence
  synthetic polynucleotide sequence
acagccagggcctcacca

SEQ ID NO: 7697 - DNA, 18 bp, Artificial sequence
  synthetic polynucleotide sequence
ctccaactcgcccagaga

SEQ ID NO: 7698 - DNA, 18 bp, Artificial sequence
  synthetic polynucleotide sequence
tgaacacctgctccacca

SEQ ID NO: 7699 - DNA, 18 bp, Artificial sequence
  synthetic polynucleotide sequence
tacgtctccagaggccca

SEQ ID NO: 7700 - DNA, 18 bp, Artificial sequence
  synthetic polynucleotide sequence
tcaccacagggatgggca

SEQ ID NO: 7701 - DNA, 18 bp, Artificial sequence
  synthetic polynucleotide sequence
gcagtcggtgatggcaga

SEQ ID NO: 7702 - DNA, 18 bp, Artificial sequence
  synthetic polynucleotide sequence
ggtcctctggaaggccca

SEQ ID NO: 7703 - DNA, 18 bp, Artificial sequence
  synthetic polynucleotide sequence
gaggccagatgatgagca

SEQ ID NO: 7704 - DNA, 18 bp, Artificial sequence
  synthetic polynucleotide sequence
gaaccaaggagctacgga

SEQ ID NO: 7705 - DNA, 18 bp, Artificial sequence
  synthetic polynucleotide sequence
gcagggcacagatgcaga

SEQ ID NO: 7706 - DNA, 18 bp, Artificial sequence
  synthetic polynucleotide sequence
ctcagcgtcggcaggaca

SEQ ID NO: 7707 - DNA, 18 bp, Artificial sequence
  synthetic polynucleotide sequence
tgcgtcgcagaaaggtga

SEQ ID NO: 7708 - DNA, 18 bp, Artificial sequence
  synthetic polynucleotide sequence
cactggatacagaaccca

SEQ ID NO: 7709 - DNA, 18 bp, Artificial sequence
  synthetic polynucleotide sequence
ggaagtggtcgtgagcca

SEQ ID NO: 7710 - DNA, 18 bp, Artificial sequence
  synthetic polynucleotide sequence
gcagagtggcagtgcaga

SEQ ID NO: 7711 - DNA, 18 bp, Artificial sequence
  synthetic polynucleotide sequence
ccttggggaaggagagca

SEQ ID NO: 7712 - DNA, 18 bp, Artificial sequence
  synthetic polynucleotide sequence
tctgccataccagaggca

SEQ ID NO: 7713 - DNA, 18 bp, Artificial sequence
  synthetic polynucleotide sequence
gatggcagctcaaagcaa

SEQ ID NO: 7714 - DNA, 18 bp, Artificial sequence
  synthetic polynucleotide sequence
agacactggaagacagca

SEQ ID NO: 7715 - DNA, 18 bp, Artificial sequence
  synthetic polynucleotide sequence
gacccagaccaagacaga

SEQ ID NO: 7716 - DNA, 18 bp, Artificial sequence
  synthetic polynucleotide sequence
gccgtagagcagcgctca

SEQ ID NO: 7717 - DNA, 18 bp, Artificial sequence
  synthetic polynucleotide sequence
ggaagccctgattcagga

SEQ ID NO: 7718 - DNA, 18 bp, Artificial sequence
  synthetic polynucleotide sequence
tggggatcctcagcagca

SEQ ID NO: 7719 - DNA, 18 bp, Artificial sequence
  synthetic polynucleotide sequence
cctgctccaagcagccaa

SEQ ID NO: 7720 - DNA, 18 bp, Artificial sequence
  synthetic polynucleotide sequence
cacagctcctgagccaga

SEQ ID NO: 7721 - DNA, 18 bp, Artificial sequence
  synthetic polynucleotide sequence
tcagtgccagcgagagca

SEQ ID NO: 7722 - DNA, 18 bp, Artificial sequence
  synthetic polynucleotide sequence
cgtaccgcccttcaacca

SEQ ID NO: 7723 - DNA, 18 bp, Artificial sequence
  synthetic polynucleotide sequence
cgccatcacacctagcga

SEQ ID NO: 7724 - DNA, 18 bp, Artificial sequence
  synthetic polynucleotide sequence
gcaggcacttggtagcca

SEQ ID NO: 7725 - DNA, 18 bp, Artificial sequence
  synthetic polynucleotide sequence
ggcccaggatcatgagga

SEQ ID NO: 7726 - DNA, 18 bp, Artificial sequence
  synthetic polynucleotide sequence
agccagcgaagacgacca

SEQ ID NO: 7727 - DNA, 18 bp, Artificial sequence
  synthetic polynucleotide sequence
gcgccttggtaccaacca

SEQ ID NO: 7728 - DNA, 18 bp, Artificial sequence
  synthetic polynucleotide sequence
aacgccgtgagcgtagga

SEQ ID NO: 7729 - DNA, 18 bp, Artificial sequence
  synthetic polynucleotide sequence
gggctaaccaattcagga

SEQ ID NO: 7730 - DNA, 18 bp, Artificial sequence
  synthetic polynucleotide sequence
gttcgaggcagaatgcca

SEQ ID NO: 7731 - DNA, 18 bp, Artificial sequence
  synthetic polynucleotide sequence
cccgaaggagaaccacca

SEQ ID NO: 7732 - DNA, 18 bp, Artificial sequence
  synthetic polynucleotide sequence
ggtaagccaggtggggga

SEQ ID NO: 7733 - DNA, 18 bp, Artificial sequence
  synthetic polynucleotide sequence
gcccagaaggctgaggaa

SEQ ID NO: 7734 - DNA, 18 bp, Artificial sequence
  synthetic polynucleotide sequence
gctgtaggggcatcacca

SEQ ID NO: 7735 - DNA, 18 bp, Artificial sequence
  synthetic polynucleotide sequence
cgctctgcaggagacaga

SEQ ID NO: 7736 - DNA, 18 bp, Artificial sequence
  synthetic polynucleotide sequence
gtgatggcatgagggaca

SEQ ID NO: 7737 - DNA, 18 bp, Artificial sequence
  synthetic polynucleotide sequence
caggctggtgtcagccaa

SEQ ID NO: 7738 - DNA, 18 bp, Artificial sequence
  synthetic polynucleotide sequence
cacaacactggtaaccca

SEQ ID NO: 7739 - DNA, 18 bp, Artificial sequence
  synthetic polynucleotide sequence
gggattacaggaacggga

SEQ ID NO: 7740 - DNA, 18 bp, Artificial sequence
  synthetic polynucleotide sequence
aacactgcatggctccga

SEQ ID NO: 7741 - DNA, 18 bp, Artificial sequence
  synthetic polynucleotide sequence
ggcgctgattccaggcaa

SEQ ID NO: 7742 - DNA, 18 bp, Artificial sequence
  synthetic polynucleotide sequence
gcttgctgggccagagca

SEQ ID NO: 7743 - DNA, 18 bp, Artificial sequence
  synthetic polynucleotide sequence
ccattgagccagcacgca

SEQ ID NO: 7744 - DNA, 18 bp, Artificial sequence
  synthetic polynucleotide sequence
gcaatggctggaccctca

SEQ ID NO: 7745 - DNA, 18 bp, Artificial sequence
  synthetic polynucleotide sequence
gcgtcagtagcagccaga

SEQ ID NO: 7746 - DNA, 18 bp, Artificial sequence
  synthetic polynucleotide sequence
agacagctggaggggaca

SEQ ID NO: 7747 - DNA, 18 bp, Artificial sequence
  synthetic polynucleotide sequence
cggacccaggattccgaa

SEQ ID NO: 7748 - DNA, 18 bp, Artificial sequence
  synthetic polynucleotide sequence
gacagcacctgctccaca

SEQ ID NO: 7749 - DNA, 18 bp, Artificial sequence
  synthetic polynucleotide sequence
ctctacctgcaggccaca

SEQ ID NO: 7750 - DNA, 18 bp, Artificial sequence
  synthetic polynucleotide sequence
cctcatagccacacggca

SEQ ID NO: 7751 - DNA, 18 bp, Artificial sequence
  synthetic polynucleotide sequence
gagggcattctgcacaga

SEQ ID NO: 7752 - DNA, 18 bp, Artificial sequence
  synthetic polynucleotide sequence
ctccacctcgcactgcca

SEQ ID NO: 7753 - DNA, 18 bp, Artificial sequence
  synthetic polynucleotide sequence
gaaacacaggctccagca

SEQ ID NO: 7754 - DNA, 18 bp, Artificial sequence
  synthetic polynucleotide sequence
accatctccagccactga

SEQ ID NO: 7755 - DNA, 18 bp, Artificial sequence
  synthetic polynucleotide sequence
ggcgtgagctacagcaga

SEQ ID NO: 7756 - DNA, 18 bp, Artificial sequence
  synthetic polynucleotide sequence
cagatgacagtgccccca

SEQ ID NO: 7757 - DNA, 18 bp, Artificial sequence
  synthetic polynucleotide sequence
tgcagagcgtggacgaca

SEQ ID NO: 7758 - DNA, 18 bp, Artificial sequence
  synthetic polynucleotide sequence
agccagccaagtccacca

SEQ ID NO: 7759 - DNA, 18 bp, Artificial sequence
  synthetic polynucleotide sequence
acccccgacacctgcaca

SEQ ID NO: 7760 - DNA, 18 bp, Artificial sequence
  synthetic polynucleotide sequence
agcaccagcgatgaagga

SEQ ID NO: 7761 - DNA, 18 bp, Artificial sequence
  synthetic polynucleotide sequence
cggaacattccaggccga

SEQ ID NO: 7762 - DNA, 18 bp, Artificial sequence
  synthetic polynucleotide sequence
cgtatggagagtcacgga

SEQ ID NO: 7763 - DNA, 18 bp, Artificial sequence
  synthetic polynucleotide sequence
caggaggtgacatacgca

SEQ ID NO: 7764 - DNA, 18 bp, Artificial sequence
  synthetic polynucleotide sequence
aacgctctgggctcagca

SEQ ID NO: 7765 - DNA, 18 bp, Artificial sequence
  synthetic polynucleotide sequence
gtgcgcaaggtcaacaga

SEQ ID NO: 7766 - DNA, 18 bp, Artificial sequence
  synthetic polynucleotide sequence
cgtagggagagtgacgga

SEQ ID NO: 7767 - DNA, 18 bp, Artificial sequence
  synthetic polynucleotide sequence
aggcaggagagaacgtga

SEQ ID NO: 7768 - DNA, 18 bp, Artificial sequence
  synthetic polynucleotide sequence
ccttgggcactgcacgga

SEQ ID NO: 7769 - DNA, 18 bp, Artificial sequence
  synthetic polynucleotide sequence
cggttcaggcaggagaga

SEQ ID NO: 7770 - DNA, 18 bp, Artificial sequence
  synthetic polynucleotide sequence
ttgaccctcagcaccgca

SEQ ID NO: 7771 - DNA, 18 bp, Artificial sequence
  synthetic polynucleotide sequence
gtcggtgactcaggcaga

SEQ ID NO: 7772 - DNA, 18 bp, Artificial sequence
  synthetic polynucleotide sequence
agcgtggatagcacccca

SEQ ID NO: 7773 - DNA, 18 bp, Artificial sequence
  synthetic polynucleotide sequence
ggccgattctgcaggcaa

SEQ ID NO: 7774 - DNA, 18 bp, Artificial sequence
  synthetic polynucleotide sequence
ccaccgacggaagacgca

SEQ ID NO: 7775 - DNA, 18 bp, Artificial sequence
  synthetic polynucleotide sequence
agccagctgctactgcca

SEQ ID NO: 7776 - DNA, 18 bp, Artificial sequence
  synthetic polynucleotide sequence
cgccctggggtgcgggga

SEQ ID NO: 7777 - DNA, 18 bp, Artificial sequence
  synthetic polynucleotide sequence
ggctacgtccggacccaa

SEQ ID NO: 7778 - DNA, 18 bp, Artificial sequence
  synthetic polynucleotide sequence
gaagagcggcacgagcca

SEQ ID NO: 7779 - DNA, 18 bp, Artificial sequence
  synthetic polynucleotide sequence
ggatggcacctgaaagca

SEQ ID NO: 7780 - DNA, 18 bp, Artificial sequence
  synthetic polynucleotide sequence
agggctgagcatccggaa

SEQ ID NO: 7781 - DNA, 19 bp, Artificial sequence
  synthetic polynucleotide sequence
actgaagggatctgcagga

SEQ ID NO: 7782 - DNA, 18 bp, Artificial sequence
  synthetic polynucleotide sequence
acatccatcccggggaca

SEQ ID NO: 7783 - DNA, 18 bp, Artificial sequence
  synthetic polynucleotide sequence
aggacacgaccacccgga

SEQ ID NO: 7784 - DNA, 18 bp, Artificial sequence
  synthetic polynucleotide sequence
tcacgaatagccaaggca

SEQ ID NO: 7785 - DNA, 18 bp, Artificial sequence
  synthetic polynucleotide sequence
cgcatctgcgcacgcaca

SEQ ID NO: 7786 - DNA, 18 bp, Artificial sequence
  synthetic polynucleotide sequence
cgcgaatctccagccgca

SEQ ID NO: 7787 - DNA, 18 bp, Artificial sequence
  synthetic polynucleotide sequence
gaggacgcacacaggaga

SEQ ID NO: 7788 - DNA, 18 bp, Artificial sequence
  synthetic polynucleotide sequence
ccggtcacacatggggca

SEQ ID NO: 7789 - DNA, 18 bp, Artificial sequence
  synthetic polynucleotide sequence
ggtcaacatccaggggca

SEQ ID NO: 7790 - DNA, 18 bp, Artificial sequence
  synthetic polynucleotide sequence
cccatgaggagaccggca

SEQ ID NO: 7791 - DNA, 20 bp, Artificial sequence
  synthetic polynucleotide sequence
ccctcagcaagagatgacga

SEQ ID NO: 7792 - DNA, 17 bp, Artificial sequence
  synthetic polynucleotide sequence
ggaagccgagactggca

SEQ ID NO: 7793 - DNA, 18 bp, Artificial sequence
  synthetic polynucleotide sequence
ccgaaagcacacgggcca

SEQ ID NO: 7794 - DNA, 18 bp, Artificial sequence
  synthetic polynucleotide sequence
atgtgcagcgccaggtga

SEQ ID NO: 7795 - DNA, 18 bp, Artificial sequence
  synthetic polynucleotide sequence
cgcggcatggaatacgga

SEQ ID NO: 7796 - DNA, 18 bp, Artificial sequence
  synthetic polynucleotide sequence
cctccgataaggagacca

SEQ ID NO: 7797 - DNA, 18 bp, Artificial sequence
  synthetic polynucleotide sequence
ccagcaggactaccccga

SEQ ID NO: 7798 - DNA, 18 bp, Artificial sequence
  synthetic polynucleotide sequence
gcatctgatcgggcagga

SEQ ID NO: 7799 - DNA, 18 bp, Artificial sequence
  synthetic polynucleotide sequence
ggccacctgtaccagcta

SEQ ID NO: 7800 - DNA, 18 bp, Artificial sequence
  synthetic polynucleotide sequence
gcagtctgcggaacagca

SEQ ID NO: 7801 - DNA, 18 bp, Artificial sequence
  synthetic polynucleotide sequence
gcggacgcacacaggaga

SEQ ID NO: 7802 - DNA, 18 bp, Artificial sequence
  synthetic polynucleotide sequence
cctgtcacagtgggagca

SEQ ID NO: 7803 - DNA, 18 bp, Artificial sequence
  synthetic polynucleotide sequence
agccgtcaaccaggccca

SEQ ID NO: 7804 - DNA, 18 bp, Artificial sequence
  synthetic polynucleotide sequence
accgtgccatccacggca

SEQ ID NO: 7805 - DNA, 18 bp, Artificial sequence
  synthetic polynucleotide sequence
cgcctccgaaaagaggca

SEQ ID NO: 7806 - DNA, 18 bp, Artificial sequence
  synthetic polynucleotide sequence
cagctcgtctgagcggga

SEQ ID NO: 7807 - DNA, 18 bp, Artificial sequence
  synthetic polynucleotide sequence
ccgaaggggaaggggcca

SEQ ID NO: 7808 - DNA, 18 bp, Artificial sequence
  synthetic polynucleotide sequence
acggccagtttgcacaga

SEQ ID NO: 7809 - DNA, 18 bp, Artificial sequence
  synthetic polynucleotide sequence
ctgaagccagaggacgga

SEQ ID NO: 7810 - DNA, 18 bp, Artificial sequence
  synthetic polynucleotide sequence
cgtcacagacacccccga

SEQ ID NO: 7811 - DNA, 18 bp, Artificial sequence
  synthetic polynucleotide sequence
aggtcgcctctaccggca

SEQ ID NO: 7812 - DNA, 18 bp, Artificial sequence
  synthetic polynucleotide sequence
gccactatgacccgtcca

SEQ ID NO: 7813 - DNA, 18 bp, Artificial sequence
  synthetic polynucleotide sequence
tgacgcagtggagagaca

SEQ ID NO: 7814 - DNA, 18 bp, Artificial sequence
  synthetic polynucleotide sequence
cgaggcaatagtgacaca

SEQ ID NO: 7815 - DNA, 18 bp, Artificial sequence
  synthetic polynucleotide sequence
cagctgcacgtctggaca

SEQ ID NO: 7816 - DNA, 18 bp, Artificial sequence
  synthetic polynucleotide sequence
gagcggccacctaacaca

SEQ ID NO: 7817 - DNA, 18 bp, Artificial sequence
  synthetic polynucleotide sequence
gcacaggctacgtgcaca

SEQ ID NO: 7818 - DNA, 18 bp, Artificial sequence
  synthetic polynucleotide sequence
cggctcaaggagcaggga

SEQ ID NO: 7819 - DNA, 18 bp, Artificial sequence
  synthetic polynucleotide sequence
atggagaagccacagaca

SEQ ID NO: 7820 - DNA, 18 bp, Artificial sequence
  synthetic polynucleotide sequence
cacagccatgataggaca

SEQ ID NO: 7821 - DNA, 18 bp, Artificial sequence
  synthetic polynucleotide sequence
gccactcttgaaggacca

SEQ ID NO: 7822 - DNA, 18 bp, Artificial sequence
  synthetic polynucleotide sequence
tggacattggagcacaca

SEQ ID NO: 7823 - DNA, 18 bp, Artificial sequence
  synthetic polynucleotide sequence
aacgcaccaagcccagga

SEQ ID NO: 7824 - DNA, 18 bp, Artificial sequence
  synthetic polynucleotide sequence
caggtcacctctgccaca

SEQ ID NO: 7825 - DNA, 18 bp, Artificial sequence
  synthetic polynucleotide sequence
acacctggaaggtggcaa

SEQ ID NO: 7826 - DNA, 18 bp, Artificial sequence
  synthetic polynucleotide sequence
acagcactctgacggcga

SEQ ID NO: 7827 - DNA, 18 bp, Artificial sequence
  synthetic polynucleotide sequence
gcctgacctgctccagca

SEQ ID NO: 7828 - DNA, 18 bp, Artificial sequence
  synthetic polynucleotide sequence
ccggtccagtccagcaca

SEQ ID NO: 7829 - DNA, 18 bp, Artificial sequence
  synthetic polynucleotide sequence
gcaggaagggggcaagga

SEQ ID NO: 7830 - DNA, 18 bp, Artificial sequence
  synthetic polynucleotide sequence
cgggtgatcgcacacgga

SEQ ID NO: 7831 - DNA, 18 bp, Artificial sequence
  synthetic polynucleotide sequence
ccgtccgcgtaaccagca

SEQ ID NO: 7832 - DNA, 18 bp, Artificial sequence
  synthetic polynucleotide sequence
ctcccgggatacacacca

SEQ ID NO: 7833 - DNA, 18 bp, Artificial sequence
  synthetic polynucleotide sequence
caccaccaccagccccca

SEQ ID NO: 7834 - DNA, 18 bp, Artificial sequence
  synthetic polynucleotide sequence
cccagagtcaccctcaca

SEQ ID NO: 7835 - DNA, 18 bp, Artificial sequence
  synthetic polynucleotide sequence
gcccattgaggtcaccca

SEQ ID NO: 7836 - DNA, 18 bp, Artificial sequence
  synthetic polynucleotide sequence
gcacacctcatccgggga

SEQ ID NO: 7837 - DNA, 18 bp, Artificial sequence
  synthetic polynucleotide sequence
cagagcaactacggacca

SEQ ID NO: 7838 - DNA, 18 bp, Artificial sequence
  synthetic polynucleotide sequence
gctggactaggcgcagca

SEQ ID NO: 7839 - DNA, 18 bp, Artificial sequence
  synthetic polynucleotide sequence
cagccacagcttcccaca

SEQ ID NO: 7840 - DNA, 18 bp, Artificial sequence
  synthetic polynucleotide sequence
caggctctgacaggcgga

SEQ ID NO: 7841 - DNA, 18 bp, Artificial sequence
  synthetic polynucleotide sequence
accacctgctacgcctca

SEQ ID NO: 7842 - DNA, 18 bp, Artificial sequence
  synthetic polynucleotide sequence
agggtgaacttgcgcaca

SEQ ID NO: 7843 - DNA, 18 bp, Artificial sequence
  synthetic polynucleotide sequence
ctgacaccatccggagca

SEQ ID NO: 7844 - DNA, 18 bp, Artificial sequence
  synthetic polynucleotide sequence
cgttcacgcactgcagca

SEQ ID NO: 7845 - DNA, 18 bp, Artificial sequence
  synthetic polynucleotide sequence
ggatgcttacccgagaca

SEQ ID NO: 7846 - DNA, 18 bp, Artificial sequence
  synthetic polynucleotide sequence
aggacacgagtccctgca

SEQ ID NO: 7847 - DNA, 18 bp, Artificial sequence
  synthetic polynucleotide sequence
acaccaccagctgccaca

SEQ ID NO: 7848 - DNA, 18 bp, Artificial sequence
  synthetic polynucleotide sequence
atctggccagggtaggca

SEQ ID NO: 7849 - DNA, 18 bp, Artificial sequence
  synthetic polynucleotide sequence
cactaccacgagcccaga

SEQ ID NO: 7850 - DNA, 18 bp, Artificial sequence
  synthetic polynucleotide sequence
gtcggggatgccagcgca

SEQ ID NO: 7851 - DNA, 18 bp, Artificial sequence
  synthetic polynucleotide sequence
tgacacgtgccagggcga

SEQ ID NO: 7852 - DNA, 18 bp, Artificial sequence
  synthetic polynucleotide sequence
acaggggtctgagcccca

SEQ ID NO: 7853 - DNA, 18 bp, Artificial sequence
  synthetic polynucleotide sequence
atgggagggtccggagca

SEQ ID NO: 7854 - DNA, 18 bp, Artificial sequence
  synthetic polynucleotide sequence
tgggcaggcggatcagca

SEQ ID NO: 7855 - DNA, 18 bp, Artificial sequence
  synthetic polynucleotide sequence
cccacagactcaggccca

SEQ ID NO: 7856 - DNA, 18 bp, Artificial sequence
  synthetic polynucleotide sequence
ccaaggtgaaccctgaca

SEQ ID NO: 7857 - DNA, 18 bp, Artificial sequence
  synthetic polynucleotide sequence
cagctccagagaagctca

SEQ ID NO: 7858 - DNA, 18 bp, Artificial sequence
  synthetic polynucleotide sequence
tcgttaccacagaggcca

SEQ ID NO: 7859 - DNA, 18 bp, Artificial sequence
  synthetic polynucleotide sequence
tactgccacctccagaga

SEQ ID NO: 7860 - DNA, 18 bp, Artificial sequence
  synthetic polynucleotide sequence
acacagtggccatcagga

SEQ ID NO: 7861 - DNA, 18 bp, Artificial sequence
  synthetic polynucleotide sequence
caaagtggcagcaaagga

SEQ ID NO: 7862 - DNA, 18 bp, Artificial sequence
  synthetic polynucleotide sequence
ggccatcaggacaatgca

SEQ ID NO: 7863 - DNA, 18 bp, Artificial sequence
  synthetic polynucleotide sequence
cacctccagagaagctca

SEQ ID NO: 7864 - DNA, 18 bp, Artificial sequence
  synthetic polynucleotide sequence
tcttcgaagcacaggcca

SEQ ID NO: 7865 - DNA, 19 bp, Artificial sequence
  synthetic polynucleotide sequence
gcatttactccaggaccca

SEQ ID NO: 7866 - DNA, 18 bp, Artificial sequence
  synthetic polynucleotide sequence
gaagcacagagatgccga

SEQ ID NO: 7867 - DNA, 18 bp, Artificial sequence
  synthetic polynucleotide sequence
cctagccagagactcaca

SEQ ID NO: 7868 - DNA, 18 bp, Artificial sequence
  synthetic polynucleotide sequence
ttcccacctccagccaga

SEQ ID NO: 7869 - DNA, 18 bp, Artificial sequence
  synthetic polynucleotide sequence
ctcgacacagctgggaga

SEQ ID NO: 7870 - DNA, 18 bp, Artificial sequence
  synthetic polynucleotide sequence
tacagcgatgaagcagca

SEQ ID NO: 7871 - DNA, 18 bp, Artificial sequence
  synthetic polynucleotide sequence
ccctccactaactcccga

SEQ ID NO: 7872 - DNA, 18 bp, Artificial sequence
  synthetic polynucleotide sequence
tccagaatggagtggcga

SEQ ID NO: 7873 - DNA, 18 bp, Artificial sequence
  synthetic polynucleotide sequence
tggagggcagatggagga

SEQ ID NO: 7874 - DNA, 18 bp, Artificial sequence
  synthetic polynucleotide sequence
tcccggagagggagggca

SEQ ID NO: 7875 - DNA, 18 bp, Artificial sequence
  synthetic polynucleotide sequence
cacctgaggagtcaccca

SEQ ID NO: 7876 - DNA, 18 bp, Artificial sequence
  synthetic polynucleotide sequence
tcaggtggaggggacaga

SEQ ID NO: 7877 - DNA, 18 bp, Artificial sequence
  synthetic polynucleotide sequence
tgccggtgaacagcgaca

SEQ ID NO: 7878 - DNA, 18 bp, Artificial sequence
  synthetic polynucleotide sequence
gcgttctgcgcgaggaca

SEQ ID NO: 7879 - DNA, 18 bp, Artificial sequence
  synthetic polynucleotide sequence
ccgtggggaagaggagca

SEQ ID NO: 7880 - DNA, 18 bp, Artificial sequence
  synthetic polynucleotide sequence
acagccgaggcagtcgta

SEQ ID NO: 7881 - DNA, 18 bp, Artificial sequence
  synthetic polynucleotide sequence
aggtgaggagcccaagca

SEQ ID NO: 7882 - DNA, 18 bp, Artificial sequence
  synthetic polynucleotide sequence
ggcactgtcactgggaca

SEQ ID NO: 7883 - DNA, 18 bp, Artificial sequence
  synthetic polynucleotide sequence
cctgctcaccaaccccaa

SEQ ID NO: 7884 - DNA, 18 bp, Artificial sequence
  synthetic polynucleotide sequence
agttggtcacggcccaca

SEQ ID NO: 7885 - DNA, 18 bp, Artificial sequence
  synthetic polynucleotide sequence
tggaaggaccagagccca

SEQ ID NO: 7886 - DNA, 18 bp, Artificial sequence
  synthetic polynucleotide sequence
tggcagcttcaggaagca

SEQ ID NO: 7887 - DNA, 18 bp, Artificial sequence
  synthetic polynucleotide sequence
gcttcctgaggcccagca

SEQ ID NO: 7888 - DNA, 18 bp, Artificial sequence
  synthetic polynucleotide sequence
cgcccttcagggagacca

SEQ ID NO: 7889 - DNA, 19 bp, Artificial sequence
  synthetic polynucleotide sequence
ggagctggtggcgtaggca

SEQ ID NO: 7890 - DNA, 18 bp, Artificial sequence
  synthetic polynucleotide sequence
caaagaaagccctcccca

SEQ ID NO: 7891 - DNA, 18 bp, Artificial sequence
  synthetic polynucleotide sequence
ggaaggagcaagccgtga

SEQ ID NO: 7892 - DNA, 18 bp, Artificial sequence
  synthetic polynucleotide sequence
cggggcaagtttgaggaa

SEQ ID NO: 7893 - DNA, 18 bp, Artificial sequence
  synthetic polynucleotide sequence
acacctatgccacgggga

SEQ ID NO: 7894 - DNA, 18 bp, Artificial sequence
  synthetic polynucleotide sequence
tggaagcgggctaggaca

SEQ ID NO: 7895 - DNA, 18 bp, Artificial sequence
  synthetic polynucleotide sequence
gacgccgctgaggaccca

SEQ ID NO: 7896 - DNA, 18 bp, Artificial sequence
  synthetic polynucleotide sequence
tttcccggagccagcaga

SEQ ID NO: 7897 - DNA, 18 bp, Artificial sequence
  synthetic polynucleotide sequence
agccctagagaaagcaga

SEQ ID NO: 7898 - DNA, 18 bp, Artificial sequence
  synthetic polynucleotide sequence
ctggagctcctagaccaa

SEQ ID NO: 7899 - DNA, 18 bp, Artificial sequence
  synthetic polynucleotide sequence
ctggagaatgtgccccga

SEQ ID NO: 7900 - DNA, 18 bp, Artificial sequence
  synthetic polynucleotide sequence
ccgccacctccagaacca

SEQ ID NO: 7901 - DNA, 18 bp, Artificial sequence
  synthetic polynucleotide sequence
cgctccaaggcctggaga

SEQ ID NO: 7902 - DNA, 18 bp, Artificial sequence
  synthetic polynucleotide sequence
ctgcagggcatagcggca

SEQ ID NO: 7903 - DNA, 17 bp, Artificial sequence
  synthetic polynucleotide sequence
ggcagcgtggaggagca

SEQ ID NO: 7904 - DNA, 22 bp, Artificial sequence
  synthetic polynucleotide sequence
gatgactgcgatccagaggaga

SEQ ID NO: 7905 - DNA, 18 bp, Artificial sequence
  synthetic polynucleotide sequence
gtgagctccgatgcgaga

SEQ ID NO: 7906 - DNA, 18 bp, Artificial sequence
  synthetic polynucleotide sequence
ggctgcggtaagtagcga

SEQ ID NO: 7907 - DNA, 18 bp, Artificial sequence
  synthetic polynucleotide sequence
gctggtgcagagtggcaa

SEQ ID NO: 7908 - DNA, 18 bp, Artificial sequence
  synthetic polynucleotide sequence
ggatctgggacagctgca

SEQ ID NO: 7909 - DNA, 18 bp, Artificial sequence
  synthetic polynucleotide sequence
ggagaacagcctgaggga

SEQ ID NO: 7910 - DNA, 18 bp, Artificial sequence
  synthetic polynucleotide sequence
ctgactcaaggtgcagca

SEQ ID NO: 7911 - DNA, 18 bp, Artificial sequence
  synthetic polynucleotide sequence
gggcaccgatctcgccaa

SEQ ID NO: 7912 - DNA, 18 bp, Artificial sequence
  synthetic polynucleotide sequence
gtgaaccaggcttcagca

SEQ ID NO: 7913 - DNA, 18 bp, Artificial sequence
  synthetic polynucleotide sequence
agctgtcccaggtgcaga

SEQ ID NO: 7914 - DNA, 18 bp, Artificial sequence
  synthetic polynucleotide sequence
gggcacgcacatccagca

SEQ ID NO: 7915 - DNA, 18 bp, Artificial sequence
  synthetic polynucleotide sequence
actggaggcatcagcgga

SEQ ID NO: 7916 - DNA, 18 bp, Artificial sequence
  synthetic polynucleotide sequence
gctgctggaactgccaga

SEQ ID NO: 7917 - DNA, 18 bp, Artificial sequence
  synthetic polynucleotide sequence
gagggcgaggaatgcaga

SEQ ID NO: 7918 - DNA, 18 bp, Artificial sequence
  synthetic polynucleotide sequence
cccacactgagcccacca

SEQ ID NO: 7919 - DNA, 18 bp, Artificial sequence
  synthetic polynucleotide sequence
gggaaccatgggcagcaa

SEQ ID NO: 7920 - DNA, 18 bp, Artificial sequence
  synthetic polynucleotide sequence
actcctgcgactggcgga

SEQ ID NO: 7921 - DNA, 18 bp, Artificial sequence
  synthetic polynucleotide sequence
ccagtcccacatcagcga

SEQ ID NO: 7922 - DNA, 18 bp, Artificial sequence
  synthetic polynucleotide sequence
cctcatactgggcacgga

SEQ ID NO: 7923 - DNA, 18 bp, Artificial sequence
  synthetic polynucleotide sequence
agagcgaggagagcagga

SEQ ID NO: 7924 - DNA, 18 bp, Artificial sequence
  synthetic polynucleotide sequence
acggtgctatagcccaca

SEQ ID NO: 7925 - DNA, 18 bp, Artificial sequence
  synthetic polynucleotide sequence
gctgcgtgagtaccagga

SEQ ID NO: 7926 - DNA, 18 bp, Artificial sequence
  synthetic polynucleotide sequence
gctggtgcggctgaagga

SEQ ID NO: 7927 - DNA, 18 bp, Artificial sequence
  synthetic polynucleotide sequence
tggactcgccctcagcca

SEQ ID NO: 7928 - DNA, 18 bp, Artificial sequence
  synthetic polynucleotide sequence
aggcctgatctggaggca

SEQ ID NO: 7929 - DNA, 18 bp, Artificial sequence
  synthetic polynucleotide sequence
cccagcccctgccaggca

SEQ ID NO: 7930 - DNA, 18 bp, Artificial sequence
  synthetic polynucleotide sequence
gcaggaaggctggcagca

SEQ ID NO: 7931 - DNA, 18 bp, Artificial sequence
  synthetic polynucleotide sequence
aagggaggctgcgggtca

SEQ ID NO: 7932 - DNA, 18 bp, Artificial sequence
  synthetic polynucleotide sequence
gcaactggactgggagca

SEQ ID NO: 7933 - DNA, 18 bp, Artificial sequence
  synthetic polynucleotide sequence
actctgcccagggagcca

SEQ ID NO: 7934 - DNA, 18 bp, Artificial sequence
  synthetic polynucleotide sequence
gcctcgggtcgtgacgca

SEQ ID NO: 7935 - DNA, 18 bp, Artificial sequence
  synthetic polynucleotide sequence
tgcccctccaccaagaga

SEQ ID NO: 7936 - DNA, 18 bp, Artificial sequence
  synthetic polynucleotide sequence
accacaggacttgagtca

SEQ ID NO: 7937 - DNA, 18 bp, Artificial sequence
  synthetic polynucleotide sequence
caagcgacaatgaaggca

SEQ ID NO: 7938 - DNA, 18 bp, Artificial sequence
  synthetic polynucleotide sequence
ggaactggagccactcga

SEQ ID NO: 7939 - DNA, 18 bp, Artificial sequence
  synthetic polynucleotide sequence
ggagaggatgttccggca

SEQ ID NO: 7940 - DNA, 18 bp, Artificial sequence
  synthetic polynucleotide sequence
ggatgagcaggacgagga

SEQ ID NO: 7941 - DNA, 18 bp, Artificial sequence
  synthetic polynucleotide sequence
cacaccgctgaaggccaa

SEQ ID NO: 7942 - DNA, 18 bp, Artificial sequence
  synthetic polynucleotide sequence
gagggtcgtcctccagca

SEQ ID NO: 7943 - DNA, 18 bp, Artificial sequence
  synthetic polynucleotide sequence
ggcgaagctgttcaagga

SEQ ID NO: 7944 - DNA, 18 bp, Artificial sequence
  synthetic polynucleotide sequence
cctccgcgacggtgagga

SEQ ID NO: 7945 - DNA, 18 bp, Artificial sequence
  synthetic polynucleotide sequence
gtgaacagtcagcccaga

SEQ ID NO: 7946 - DNA, 18 bp, Artificial sequence
  synthetic polynucleotide sequence
gggctgacaccgtggaca

SEQ ID NO: 7947 - DNA, 18 bp, Artificial sequence
  synthetic polynucleotide sequence
ccatggacctctggacca

SEQ ID NO: 7948 - DNA, 18 bp, Artificial sequence
  synthetic polynucleotide sequence
acatacaggccccttgga

SEQ ID NO: 7949 - DNA, 18 bp, Artificial sequence
  synthetic polynucleotide sequence
acctcaagcaggcaggaa

SEQ ID NO: 7950 - DNA, 18 bp, Artificial sequence
  synthetic polynucleotide sequence
ctggcacgcctccgtgca

SEQ ID NO: 7951 - DNA, 18 bp, Artificial sequence
  synthetic polynucleotide sequence
cccagtccctaacacaga

SEQ ID NO: 7952 - DNA, 18 bp, Artificial sequence
  synthetic polynucleotide sequence
agcaggacactactggca

SEQ ID NO: 7953 - DNA, 18 bp, Artificial sequence
  synthetic polynucleotide sequence
ccaccaccaaggagcaga

SEQ ID NO: 7954 - DNA, 18 bp, Artificial sequence
  synthetic polynucleotide sequence
ggagtgtgacgggtggga

SEQ ID NO: 7955 - DNA, 18 bp, Artificial sequence
  synthetic polynucleotide sequence
ggatgtgagccaggccca

SEQ ID NO: 7956 - DNA, 18 bp, Artificial sequence
  synthetic polynucleotide sequence
agggatccaggtgaccca

SEQ ID NO: 7957 - DNA, 18 bp, Artificial sequence
  synthetic polynucleotide sequence
gccgtcggacaacagtca

SEQ ID NO: 7958 - DNA, 18 bp, Artificial sequence
  synthetic polynucleotide sequence
tctggcgatggaggcaga

SEQ ID NO: 7959 - DNA, 18 bp, Artificial sequence
  synthetic polynucleotide sequence
ctgagccaggcactgtga

SEQ ID NO: 7960 - DNA, 18 bp, Artificial sequence
  synthetic polynucleotide sequence
tcagatggaccaagtcga

SEQ ID NO: 7961 - DNA, 18 bp, Artificial sequence
  synthetic polynucleotide sequence
ctggccaagcaattcaca

SEQ ID NO: 7962 - DNA, 18 bp, Artificial sequence
  synthetic polynucleotide sequence
gcgatgcctccataacca

SEQ ID NO: 7963 - DNA, 18 bp, Artificial sequence
  synthetic polynucleotide sequence
gtgacacctgtgacccca

SEQ ID NO: 7964 - DNA, 18 bp, Artificial sequence
  synthetic polynucleotide sequence
gctgtgaggacaggcaca

SEQ ID NO: 7965 - DNA, 18 bp, Artificial sequence
  synthetic polynucleotide sequence
ggagctcactgatgggca

SEQ ID NO: 7966 - DNA, 18 bp, Artificial sequence
  synthetic polynucleotide sequence
agcgttggcaggccacca

SEQ ID NO: 7967 - DNA, 18 bp, Artificial sequence
  synthetic polynucleotide sequence
actcggtggcagtcacca

SEQ ID NO: 7968 - DNA, 18 bp, Artificial sequence
  synthetic polynucleotide sequence
tggcaggtgggaagggga

SEQ ID NO: 7969 - DNA, 18 bp, Artificial sequence
  synthetic polynucleotide sequence
ctggaccctgaggacaca

SEQ ID NO: 7970 - DNA, 18 bp, Artificial sequence
  synthetic polynucleotide sequence
agtggccagttccaggca

SEQ ID NO: 7971 - DNA, 18 bp, Artificial sequence
  synthetic polynucleotide sequence
acgcgcagagcaaccaca

SEQ ID NO: 7972 - DNA, 18 bp, Artificial sequence
  synthetic polynucleotide sequence
cagagcgagtcatggcga

SEQ ID NO: 7973 - DNA, 18 bp, Artificial sequence
  synthetic polynucleotide sequence
gccagtgcgacaaagcca

SEQ ID NO: 7974 - DNA, 18 bp, Artificial sequence
  synthetic polynucleotide sequence
gcaagatggcccgaagga

SEQ ID NO: 7975 - DNA, 18 bp, Artificial sequence
  synthetic polynucleotide sequence
tcacacagggggtgagca

SEQ ID NO: 7976 - DNA, 18 bp, Artificial sequence
  synthetic polynucleotide sequence
gccttcaggacagggaca

SEQ ID NO: 7977 - DNA, 18 bp, Artificial sequence
  synthetic polynucleotide sequence
ccgacactgatgcagcca

SEQ ID NO: 7978 - DNA, 18 bp, Artificial sequence
  synthetic polynucleotide sequence
tggtctgggacagcacca

SEQ ID NO: 7979 - DNA, 18 bp, Artificial sequence
  synthetic polynucleotide sequence
caggtacccagaagccca

SEQ ID NO: 7980 - DNA, 18 bp, Artificial sequence
  synthetic polynucleotide sequence
caccgctttggagaggga

SEQ ID NO: 7981 - DNA, 18 bp, Artificial sequence
  synthetic polynucleotide sequence
tcacgtgactggccagga

SEQ ID NO: 7982 - DNA, 18 bp, Artificial sequence
  synthetic polynucleotide sequence
cgctcacagtgctgacca

SEQ ID NO: 7983 - DNA, 18 bp, Artificial sequence
  synthetic polynucleotide sequence
gagctggaagagagggca

SEQ ID NO: 7984 - DNA, 18 bp, Artificial sequence
  synthetic polynucleotide sequence
tgtagcagcctgggggca

SEQ ID NO: 7985 - DNA, 18 bp, Artificial sequence
  synthetic polynucleotide sequence
ggaccagtgccatcccaa

SEQ ID NO: 7986 - DNA, 18 bp, Artificial sequence
  synthetic polynucleotide sequence
ggcagcccttgatggaga

SEQ ID NO: 7987 - DNA, 18 bp, Artificial sequence
  synthetic polynucleotide sequence
gtgcaacgcggaggagca

SEQ ID NO: 7988 - DNA, 18 bp, Artificial sequence
  synthetic polynucleotide sequence
tgccgacgaggtaggcga

SEQ ID NO: 7989 - DNA, 18 bp, Artificial sequence
  synthetic polynucleotide sequence
gctgaacatcactcagga

SEQ ID NO: 7990 - DNA, 18 bp, Artificial sequence
  synthetic polynucleotide sequence
agcagtgtgagaacggca

SEQ ID NO: 7991 - DNA, 18 bp, Artificial sequence
  synthetic polynucleotide sequence
gaccccaacgcaacgcaa

SEQ ID NO: 7992 - DNA, 18 bp, Artificial sequence
  synthetic polynucleotide sequence
actcacgcacttgaagga

SEQ ID NO: 7993 - DNA, 18 bp, Artificial sequence
  synthetic polynucleotide sequence
ctacaaaggcagccccaa

SEQ ID NO: 7994 - DNA, 18 bp, Artificial sequence
  synthetic polynucleotide sequence
gctttgcagcagacacga

SEQ ID NO: 7995 - DNA, 18 bp, Artificial sequence
  synthetic polynucleotide sequence
atgtccgcatcgcaacca

SEQ ID NO: 7996 - DNA, 18 bp, Artificial sequence
  synthetic polynucleotide sequence
agcccagcagggtgagca

SEQ ID NO: 7997 - DNA, 18 bp, Artificial sequence
  synthetic polynucleotide sequence
ctacctgtcagacgccga

SEQ ID NO: 7998 - DNA, 18 bp, Artificial sequence
  synthetic polynucleotide sequence
gcccatacatgggcagga

SEQ ID NO: 7999 - DNA, 18 bp, Artificial sequence
  synthetic polynucleotide sequence
ggtcagaccgaggaccca

SEQ ID NO: 8000 - DNA, 18 bp, Artificial sequence
  synthetic polynucleotide sequence
caccacagctcaggccca

SEQ ID NO: 8001 - DNA, 18 bp, Artificial sequence
  synthetic polynucleotide sequence
ttaccagcagccccagca

SEQ ID NO: 8002 - DNA, 18 bp, Artificial sequence
  synthetic polynucleotide sequence
cggtaccgcttcccgcca

SEQ ID NO: 8003 - DNA, 18 bp, Artificial sequence
  synthetic polynucleotide sequence
cccctggcatccgagaca

SEQ ID NO: 8004 - DNA, 18 bp, Artificial sequence
  synthetic polynucleotide sequence
tagccgctccaggatgca

SEQ ID NO: 8005 - DNA, 18 bp, Artificial sequence
  synthetic polynucleotide sequence
ggagacctggaatgcaga

SEQ ID NO: 8006 - DNA, 18 bp, Artificial sequence
  synthetic polynucleotide sequence
tgacgaaggagcagcaga

SEQ ID NO: 8007 - DNA, 18 bp, Artificial sequence
  synthetic polynucleotide sequence
gagccgcaaaagcgccaa

SEQ ID NO: 8008 - DNA, 18 bp, Artificial sequence
  synthetic polynucleotide sequence
ttgcggacgggaacggga

SEQ ID NO: 8009 - DNA, 18 bp, Artificial sequence
  synthetic polynucleotide sequence
gggagaagccactcccga

SEQ ID NO: 8010 - DNA, 18 bp, Artificial sequence
  synthetic polynucleotide sequence
cactctccacgctcacca

SEQ ID NO: 8011 - DNA, 18 bp, Artificial sequence
  synthetic polynucleotide sequence
agccaggctctaccccaa

SEQ ID NO: 8012 - DNA, 18 bp, Artificial sequence
  synthetic polynucleotide sequence
tggccacactgagccgga

SEQ ID NO: 8013 - DNA, 18 bp, Artificial sequence
  synthetic polynucleotide sequence
ccgagaagctcgtgacga

SEQ ID NO: 8014 - DNA, 18 bp, Artificial sequence
  synthetic polynucleotide sequence
gtagggcacacgctgaca

SEQ ID NO: 8015 - DNA, 18 bp, Artificial sequence
  synthetic polynucleotide sequence
agcagcgcataaccacca

SEQ ID NO: 8016 - DNA, 18 bp, Artificial sequence
  synthetic polynucleotide sequence
ctgggagtcctgccagga

SEQ ID NO: 8017 - DNA, 18 bp, Artificial sequence
  synthetic polynucleotide sequence
agggatgaccaacccgga

SEQ ID NO: 8018 - DNA, 18 bp, Artificial sequence
  synthetic polynucleotide sequence
cagcacactgcgcaggta

SEQ ID NO: 8019 - DNA, 18 bp, Artificial sequence
  synthetic polynucleotide sequence
attcccagaagggactga

SEQ ID NO: 8020 - DNA, 18 bp, Artificial sequence
  synthetic polynucleotide sequence
gaggatacgccacagtga

SEQ ID NO: 8021 - DNA, 18 bp, Artificial sequence
  synthetic polynucleotide sequence
gtcgcacgtgaaggacca

SEQ ID NO: 8022 - DNA, 18 bp, Artificial sequence
  synthetic polynucleotide sequence
cgagcttcacccctcgga

SEQ ID NO: 8023 - DNA, 18 bp, Artificial sequence
  synthetic polynucleotide sequence
ggaggtgatcctgaggaa

SEQ ID NO: 8024 - DNA, 18 bp, Artificial sequence
  synthetic polynucleotide sequence
ccaggcggaggtagacca

SEQ ID NO: 8025 - DNA, 18 bp, Artificial sequence
  synthetic polynucleotide sequence
ggctggccgtcctcagga

SEQ ID NO: 8026 - DNA, 18 bp, Artificial sequence
  synthetic polynucleotide sequence
tcatccgagaggccctga

SEQ ID NO: 8027 - DNA, 18 bp, Artificial sequence
  synthetic polynucleotide sequence
cctccacgtccacatgga

SEQ ID NO: 8028 - DNA, 18 bp, Artificial sequence
  synthetic polynucleotide sequence
agtgtccctcggagccca

SEQ ID NO: 8029 - DNA, 18 bp, Artificial sequence
  synthetic polynucleotide sequence
ggagaaccaaggagctga

SEQ ID NO: 8030 - DNA, 18 bp, Artificial sequence
  synthetic polynucleotide sequence
ggtcgattgggacaggga

SEQ ID NO: 8031 - DNA, 18 bp, Artificial sequence
  synthetic polynucleotide sequence
tgggagggtgtgaccaga

SEQ ID NO: 8032 - DNA, 18 bp, Artificial sequence
  synthetic polynucleotide sequence
gctcgtccccgaactcca

SEQ ID NO: 8033 - DNA, 18 bp, Artificial sequence
  synthetic polynucleotide sequence
aaggccccttagacctca

SEQ ID NO: 8034 - DNA, 18 bp, Artificial sequence
  synthetic polynucleotide sequence
tagcatgccagccactga

SEQ ID NO: 8035 - DNA, 19 bp, Artificial sequence
  synthetic polynucleotide sequence
cccctttcaccattcagga

SEQ ID NO: 8036 - DNA, 19 bp, Artificial sequence
  synthetic polynucleotide sequence
cacagaagtcccaggacca

SEQ ID NO: 8037 - DNA, 18 bp, Artificial sequence
  synthetic polynucleotide sequence
gaactggactccgaggga

SEQ ID NO: 8038 - DNA, 18 bp, Artificial sequence
  synthetic polynucleotide sequence
caatgagcagaagtggca

SEQ ID NO: 8039 - DNA, 18 bp, Artificial sequence
  synthetic polynucleotide sequence
gaaggtgcgtggagagca

SEQ ID NO: 8040 - DNA, 18 bp, Artificial sequence
  synthetic polynucleotide sequence
agggaggatgcgagacca

SEQ ID NO: 8041 - DNA, 18 bp, Artificial sequence
  synthetic polynucleotide sequence
cttcagcatccggcagca

SEQ ID NO: 8042 - DNA, 18 bp, Artificial sequence
  synthetic polynucleotide sequence
gggctcgagtatcacaca

SEQ ID NO: 8043 - DNA, 18 bp, Artificial sequence
  synthetic polynucleotide sequence
ccgccagcagaacccaca

SEQ ID NO: 8044 - DNA, 18 bp, Artificial sequence
  synthetic polynucleotide sequence
caggtacctgactggaca

SEQ ID NO: 8045 - DNA, 18 bp, Artificial sequence
  synthetic polynucleotide sequence
ggtcctcaggtgccacca

SEQ ID NO: 8046 - DNA, 18 bp, Artificial sequence
  synthetic polynucleotide sequence
cggcccatggctaccaga

SEQ ID NO: 8047 - DNA, 18 bp, Artificial sequence
  synthetic polynucleotide sequence
atacagcccgaactgcaa

SEQ ID NO: 8048 - DNA, 18 bp, Artificial sequence
  synthetic polynucleotide sequence
aaggacccacccatgaca

SEQ ID NO: 8049 - DNA, 18 bp, Artificial sequence
  synthetic polynucleotide sequence
gcagctgccatggatgga

SEQ ID NO: 8050 - DNA, 18 bp, Artificial sequence
  synthetic polynucleotide sequence
aggcactttcaaccacca

SEQ ID NO: 8051 - DNA, 18 bp, Artificial sequence
  synthetic polynucleotide sequence
ccaccccacaagctgcca

SEQ ID NO: 8052 - DNA, 18 bp, Artificial sequence
  synthetic polynucleotide sequence
tccatcacagacagtcca

SEQ ID NO: 8053 - DNA, 18 bp, Artificial sequence
  synthetic polynucleotide sequence
cagcacacaaccacccga

SEQ ID NO: 8054 - DNA, 18 bp, Artificial sequence
  synthetic polynucleotide sequence
agcacgatggggaggaca

SEQ ID NO: 8055 - DNA, 18 bp, Artificial sequence
  synthetic polynucleotide sequence
gccgagatgtgccccaga

SEQ ID NO: 8056 - DNA, 18 bp, Artificial sequence
  synthetic polynucleotide sequence
ggttgaaggacagcgcca

SEQ ID NO: 8057 - DNA, 18 bp, Artificial sequence
  synthetic polynucleotide sequence
ctccggtgcccagccaga

SEQ ID NO: 8058 - DNA, 18 bp, Artificial sequence
  synthetic polynucleotide sequence
gggatcctgcagacccga

SEQ ID NO: 8059 - DNA, 18 bp, Artificial sequence
  synthetic polynucleotide sequence
gagggacaaagccagcca

SEQ ID NO: 8060 - DNA, 18 bp, Artificial sequence
  synthetic polynucleotide sequence
agactgggcaagcctcga

SEQ ID NO: 8061 - DNA, 18 bp, Artificial sequence
  synthetic polynucleotide sequence
gacgccatgaaggtggca

SEQ ID NO: 8062 - DNA, 18 bp, Artificial sequence
  synthetic polynucleotide sequence
cgtcgtcatcccagccaa

SEQ ID NO: 8063 - DNA, 18 bp, Artificial sequence
  synthetic polynucleotide sequence
gtgagttcggcaaagaga

SEQ ID NO: 8064 - DNA, 18 bp, Artificial sequence
  synthetic polynucleotide sequence
aggctccaataggcctga

SEQ ID NO: 8065 - DNA, 18 bp, Artificial sequence
  synthetic polynucleotide sequence
accgcactggcagggcca

SEQ ID NO: 8066 - DNA, 18 bp, Artificial sequence
  synthetic polynucleotide sequence
ccacagccatggcggtca

SEQ ID NO: 8067 - DNA, 18 bp, Artificial sequence
  synthetic polynucleotide sequence
gcacgtgaagcctcagca

SEQ ID NO: 8068 - DNA, 18 bp, Artificial sequence
  synthetic polynucleotide sequence
acgggagagggcatgcca

SEQ ID NO: 8069 - DNA, 18 bp, Artificial sequence
  synthetic polynucleotide sequence
aggagggaggcaggacca

SEQ ID NO: 8070 - DNA, 18 bp, Artificial sequence
  synthetic polynucleotide sequence
ctccttggcacgagcgca

SEQ ID NO: 8071 - DNA, 18 bp, Artificial sequence
  synthetic polynucleotide sequence
gtgaccctgaagcaccaa

SEQ ID NO: 8072 - DNA, 18 bp, Artificial sequence
  synthetic polynucleotide sequence
ccacacactcgtaagcca

SEQ ID NO: 8073 - DNA, 18 bp, Artificial sequence
  synthetic polynucleotide sequence
caaggcccaagaagccca

SEQ ID NO: 8074 - DNA, 18 bp, Artificial sequence
  synthetic polynucleotide sequence
atgggcacagcttggaca

SEQ ID NO: 8075 - DNA, 18 bp, Artificial sequence
  synthetic polynucleotide sequence
gtggacagagcaagcaca

SEQ ID NO: 8076 - DNA, 18 bp, Artificial sequence
  synthetic polynucleotide sequence
cactgagtgactgcacga

SEQ ID NO: 8077 - DNA, 18 bp, Artificial sequence
  synthetic polynucleotide sequence
gctggggcaagaaggcaa

SEQ ID NO: 8078 - DNA, 18 bp, Artificial sequence
  synthetic polynucleotide sequence
cgatggcagtgcggcaca

SEQ ID NO: 8079 - DNA, 18 bp, Artificial sequence
  synthetic polynucleotide sequence
gcatccattgaggccaga

SEQ ID NO: 8080 - DNA, 18 bp, Artificial sequence
  synthetic polynucleotide sequence
actcctgaagggacccga

SEQ ID NO: 8081 - DNA, 18 bp, Artificial sequence
  synthetic polynucleotide sequence
tcttcgaccccaaggaca

SEQ ID NO: 8082 - DNA, 18 bp, Artificial sequence
  synthetic polynucleotide sequence
tcttccaggccccagcga

SEQ ID NO: 8083 - DNA, 18 bp, Artificial sequence
  synthetic polynucleotide sequence
gcgaggacttgcaggaga

SEQ ID NO: 8084 - DNA, 18 bp, Artificial sequence
  synthetic polynucleotide sequence
ccatctccagctgcgaga

SEQ ID NO: 8085 - DNA, 18 bp, Artificial sequence
  synthetic polynucleotide sequence
gcaagcccagcctggaca

SEQ ID NO: 8086 - DNA, 18 bp, Artificial sequence
  synthetic polynucleotide sequence
agtcatcaggcagccgga

SEQ ID NO: 8087 - DNA, 18 bp, Artificial sequence
  synthetic polynucleotide sequence
cgcccacggcgacgccaa

SEQ ID NO: 8088 - DNA, 18 bp, Artificial sequence
  synthetic polynucleotide sequence
cttccaggctggaaggga

SEQ ID NO: 8089 - DNA, 18 bp, Artificial sequence
  synthetic polynucleotide sequence
aaccctcgcttcagcgaa

SEQ ID NO: 8090 - DNA, 18 bp, Artificial sequence
  synthetic polynucleotide sequence
gggctgaagcacaggtga

SEQ ID NO: 8091 - DNA, 18 bp, Artificial sequence
  synthetic polynucleotide sequence
aagtgccaccggagccta

SEQ ID NO: 8092 - DNA, 18 bp, Artificial sequence
  synthetic polynucleotide sequence
ggcttcaccgtgcccaga

SEQ ID NO: 8093 - DNA, 18 bp, Artificial sequence
  synthetic polynucleotide sequence
acctccccaccatccaga

SEQ ID NO: 8094 - DNA, 18 bp, Artificial sequence
  synthetic polynucleotide sequence
cgaagagcccttcgcaga

SEQ ID NO: 8095 - DNA, 18 bp, Artificial sequence
  synthetic polynucleotide sequence
cggtaccgtggtccggaa

SEQ ID NO: 8096 - DNA, 18 bp, Artificial sequence
  synthetic polynucleotide sequence
caccctctggaaggccga

SEQ ID NO: 8097 - DNA, 18 bp, Artificial sequence
  synthetic polynucleotide sequence
gctgtgcggggaggagca

SEQ ID NO: 8098 - DNA, 18 bp, Artificial sequence
  synthetic polynucleotide sequence
ctgacgcgatgatgagca

SEQ ID NO: 8099 - DNA, 18 bp, Artificial sequence
  synthetic polynucleotide sequence
acaggatcggcccagaga

SEQ ID NO: 8100 - DNA, 17 bp, Artificial sequence
  synthetic polynucleotide sequence
agctggggcgtgccaga

SEQ ID NO: 8101 - DNA, 18 bp, Artificial sequence
  synthetic polynucleotide sequence
gggggtctgaggagcgaa

SEQ ID NO: 8102 - DNA, 18 bp, Artificial sequence
  synthetic polynucleotide sequence
gctgaccatccacggcca

SEQ ID NO: 8103 - DNA, 18 bp, Artificial sequence
  synthetic polynucleotide sequence
cccagctcccattaccca

SEQ ID NO: 8104 - DNA, 18 bp, Artificial sequence
  synthetic polynucleotide sequence
ggatggcgggagtagaga

SEQ ID NO: 8105 - DNA, 18 bp, Artificial sequence
  synthetic polynucleotide sequence
aggtgatggtgaacggga

SEQ ID NO: 8106 - DNA, 18 bp, Artificial sequence
  synthetic polynucleotide sequence
caggctgggagaacggca

SEQ ID NO: 8107 - DNA, 18 bp, Artificial sequence
  synthetic polynucleotide sequence
ggaaaagaccttccggaa

SEQ ID NO: 8108 - DNA, 18 bp, Artificial sequence
  synthetic polynucleotide sequence
tagatgtgagagccacca

SEQ ID NO: 8109 - DNA, 18 bp, Artificial sequence
  synthetic polynucleotide sequence
catccccaacatggagga

SEQ ID NO: 8110 - DNA, 18 bp, Artificial sequence
  synthetic polynucleotide sequence
ccacctcatgacccggga

SEQ ID NO: 8111 - DNA, 18 bp, Artificial sequence
  synthetic polynucleotide sequence
gagtcgcacccagaagca

SEQ ID NO: 8112 - DNA, 18 bp, Artificial sequence
  synthetic polynucleotide sequence
tgtagcggctgaggcaca

SEQ ID NO: 8113 - DNA, 18 bp, Artificial sequence
  synthetic polynucleotide sequence
gctcatcgccagggacca

SEQ ID NO: 8114 - DNA, 18 bp, Artificial sequence
  synthetic polynucleotide sequence
tgtcaggctcaaggcgga

SEQ ID NO: 8115 - DNA, 18 bp, Artificial sequence
  synthetic polynucleotide sequence
agcagctcctgtccgaga

SEQ ID NO: 8116 - DNA, 18 bp, Artificial sequence
  synthetic polynucleotide sequence
ggagtgccagttgaagca

SEQ ID NO: 8117 - DNA, 18 bp, Artificial sequence
  synthetic polynucleotide sequence
cctcagtccccgaggaca

SEQ ID NO: 8118 - DNA, 18 bp, Artificial sequence
  synthetic polynucleotide sequence
gcgcctgtagggtgggca

SEQ ID NO: 8119 - DNA, 18 bp, Artificial sequence
  synthetic polynucleotide sequence
ccagctggagatggagga

SEQ ID NO: 8120 - DNA, 18 bp, Artificial sequence
  synthetic polynucleotide sequence
cagcgaacacggtcagca

SEQ ID NO: 8121 - DNA, 18 bp, Artificial sequence
  synthetic polynucleotide sequence
ggcatgggcatccaggga

SEQ ID NO: 8122 - DNA, 18 bp, Artificial sequence
  synthetic polynucleotide sequence
taggtgcacaccacctga

SEQ ID NO: 8123 - DNA, 18 bp, Artificial sequence
  synthetic polynucleotide sequence
ttacccaagacaccccga

SEQ ID NO: 8124 - DNA, 18 bp, Artificial sequence
  synthetic polynucleotide sequence
ctgaggctatgagcagca

SEQ ID NO: 8125 - DNA, 18 bp, Artificial sequence
  synthetic polynucleotide sequence
ggctgggacagtgaggaa

SEQ ID NO: 8126 - DNA, 18 bp, Artificial sequence
  synthetic polynucleotide sequence
cgtgcagtagtaggccca

SEQ ID NO: 8127 - DNA, 18 bp, Artificial sequence
  synthetic polynucleotide sequence
gcccagtgacgagcacca

SEQ ID NO: 8128 - DNA, 18 bp, Artificial sequence
  synthetic polynucleotide sequence
gctgcagcagcaggtcca

SEQ ID NO: 8129 - DNA, 18 bp, Artificial sequence
  synthetic polynucleotide sequence
gacatcctggcgcaccca

SEQ ID NO: 8130 - DNA, 18 bp, Artificial sequence
  synthetic polynucleotide sequence
cgccccaccgttgaccga

SEQ ID NO: 8131 - DNA, 18 bp, Artificial sequence
  synthetic polynucleotide sequence
gcgcaacctcttacggca

SEQ ID NO: 8132 - DNA, 18 bp, Artificial sequence
  synthetic polynucleotide sequence
tgagcgaggcgttggaga

SEQ ID NO: 8133 - DNA, 18 bp, Artificial sequence
  synthetic polynucleotide sequence
tctgaccacgggcgacca

SEQ ID NO: 8134 - DNA, 18 bp, Artificial sequence
  synthetic polynucleotide sequence
tgaagtaaggcagggcca

SEQ ID NO: 8135 - DNA, 18 bp, Artificial sequence
  synthetic polynucleotide sequence
acatcacccgggaccaga

SEQ ID NO: 8136 - DNA, 18 bp, Artificial sequence
  synthetic polynucleotide sequence
acagcacgttgctaagga

SEQ ID NO: 8137 - DNA, 18 bp, Artificial sequence
  synthetic polynucleotide sequence
agctggagggactgcaca

SEQ ID NO: 8138 - DNA, 18 bp, Artificial sequence
  synthetic polynucleotide sequence
gcccctcctacagggtca

SEQ ID NO: 8139 - DNA, 18 bp, Artificial sequence
  synthetic polynucleotide sequence
tgtggagacagagggcga

SEQ ID NO: 8140 - DNA, 18 bp, Artificial sequence
  synthetic polynucleotide sequence
catcagcccctcgcagga

SEQ ID NO: 8141 - DNA, 18 bp, Artificial sequence
  synthetic polynucleotide sequence
caagtgtgcaggaggcca

SEQ ID NO: 8142 - DNA, 18 bp, Artificial sequence
  synthetic polynucleotide sequence
gtgatctcccacacggca

SEQ ID NO: 8143 - DNA, 18 bp, Artificial sequence
  synthetic polynucleotide sequence
aagctccaccaagcagca

SEQ ID NO: 8144 - DNA, 18 bp, Artificial sequence
  synthetic polynucleotide sequence
aaacgcaaggtgcagcca

SEQ ID NO: 8145 - DNA, 18 bp, Artificial sequence
  synthetic polynucleotide sequence
caccctcagcccatcaca

SEQ ID NO: 8146 - DNA, 18 bp, Artificial sequence
  synthetic polynucleotide sequence
gcagaatcccgaggacca

SEQ ID NO: 8147 - DNA, 18 bp, Artificial sequence
  synthetic polynucleotide sequence
ccaagctcagcagaacca

SEQ ID NO: 8148 - DNA, 18 bp, Artificial sequence
  synthetic polynucleotide sequence
agggggtcactggggaga

SEQ ID NO: 8149 - DNA, 18 bp, Artificial sequence
  synthetic polynucleotide sequence
ccgtgagcccaagtcgca

SEQ ID NO: 8150 - DNA, 18 bp, Artificial sequence
  synthetic polynucleotide sequence
gtcgtagccggcatcaga

SEQ ID NO: 8151 - DNA, 18 bp, Artificial sequence
  synthetic polynucleotide sequence
gatgctacggcgcacaca

SEQ ID NO: 8152 - DNA, 18 bp, Artificial sequence
  synthetic polynucleotide sequence
cgggtcccatgactgaca

SEQ ID NO: 8153 - DNA, 18 bp, Artificial sequence
  synthetic polynucleotide sequence
ctgtgacccccagccaca

SEQ ID NO: 8154 - DNA, 18 bp, Artificial sequence
  synthetic polynucleotide sequence
aggtgtgaggcagtccca

SEQ ID NO: 8155 - DNA, 18 bp, Artificial sequence
  synthetic polynucleotide sequence
caaagaaggggcagccca

SEQ ID NO: 8156 - DNA, 18 bp, Artificial sequence
  synthetic polynucleotide sequence
tcacaggactcatgggga

SEQ ID NO: 8157 - DNA, 18 bp, Artificial sequence
  synthetic polynucleotide sequence
ctccagacctaggagaga

SEQ ID NO: 8158 - DNA, 18 bp, Artificial sequence
  synthetic polynucleotide sequence
ggggcttcagatgcagca

SEQ ID NO: 8159 - DNA, 18 bp, Artificial sequence
  synthetic polynucleotide sequence
cctgaactcccagcccca

SEQ ID NO: 8160 - DNA, 18 bp, Artificial sequence
  synthetic polynucleotide sequence
cggctgcactgagagtga

SEQ ID NO: 8161 - DNA, 18 bp, Artificial sequence
  synthetic polynucleotide sequence
gatgaagacccccaggca

SEQ ID NO: 8162 - DNA, 18 bp, Artificial sequence
  synthetic polynucleotide sequence
gaggcttcagatgcagca

SEQ ID NO: 8163 - DNA, 18 bp, Artificial sequence
  synthetic polynucleotide sequence
tacagggtcagtccccca

SEQ ID NO: 8164 - DNA, 18 bp, Artificial sequence
  synthetic polynucleotide sequence
gacgccagtgttggagga

SEQ ID NO: 8165 - DNA, 18 bp, Artificial sequence
  synthetic polynucleotide sequence
cgttccacccctgccgaa

SEQ ID NO: 8166 - DNA, 18 bp, Artificial sequence
  synthetic polynucleotide sequence
cggaagcagctgatgtga

SEQ ID NO: 8167 - DNA, 18 bp, Artificial sequence
  synthetic polynucleotide sequence
ctcccagtgaaaggcgga

SEQ ID NO: 8168 - DNA, 18 bp, Artificial sequence
  synthetic polynucleotide sequence
gcccacaggaagagcaca

SEQ ID NO: 8169 - DNA, 18 bp, Artificial sequence
  synthetic polynucleotide sequence
agagccacagcaggggaa

SEQ ID NO: 8170 - DNA, 18 bp, Artificial sequence
  synthetic polynucleotide sequence
aggcttgcagaccctgga

SEQ ID NO: 8171 - DNA, 18 bp, Artificial sequence
  synthetic polynucleotide sequence
tcaagaagccagaccgca

SEQ ID NO: 8172 - DNA, 17 bp, Artificial sequence
  synthetic polynucleotide sequence
cgcacaggacgatccca

SEQ ID NO: 8173 - DNA, 18 bp, Artificial sequence
  synthetic polynucleotide sequence
agcatgcagaagcgcaga

SEQ ID NO: 8174 - DNA, 18 bp, Artificial sequence
  synthetic polynucleotide sequence
gcggacatgaggctacca

SEQ ID NO: 8175 - DNA, 21 bp, Artificial sequence
  synthetic polynucleotide sequence
gagtcaatacgggtaacagga

SEQ ID NO: 8176 - DNA, 19 bp, Artificial sequence
  synthetic polynucleotide sequence
gatgatcaaggccaccaca

SEQ ID NO: 8177 - DNA, 18 bp, Artificial sequence
  synthetic polynucleotide sequence
agggagaggccaacagca

SEQ ID NO: 8178 - DNA, 18 bp, Artificial sequence
  synthetic polynucleotide sequence
agaagaggacgacgccca

SEQ ID NO: 8179 - DNA, 18 bp, Artificial sequence
  synthetic polynucleotide sequence
gaagtggctgggtaccca

SEQ ID NO: 8180 - DNA, 18 bp, Artificial sequence
  synthetic polynucleotide sequence
tgcacagaagttccagca

SEQ ID NO: 8181 - DNA, 18 bp, Artificial sequence
  synthetic polynucleotide sequence
gggaagtgcccccagcaa

SEQ ID NO: 8182 - DNA, 18 bp, Artificial sequence
  synthetic polynucleotide sequence
cgatcgctcgtgggagca

SEQ ID NO: 8183 - DNA, 18 bp, Artificial sequence
  synthetic polynucleotide sequence
ctgctgggccatcaagca

SEQ ID NO: 8184 - DNA, 18 bp, Artificial sequence
  synthetic polynucleotide sequence
ggtccatgaggctcagca

SEQ ID NO: 8185 - DNA, 18 bp, Artificial sequence
  synthetic polynucleotide sequence
gtggaacggtggcaagga

SEQ ID NO: 8186 - DNA, 18 bp, Artificial sequence
  synthetic polynucleotide sequence
gggcatccattgcccaga

SEQ ID NO: 8187 - DNA, 18 bp, Artificial sequence
  synthetic polynucleotide sequence
ggtctacaccgaggagga

SEQ ID NO: 8188 - DNA, 18 bp, Artificial sequence
  synthetic polynucleotide sequence
gcggggttgagacaggta

SEQ ID NO: 8189 - DNA, 18 bp, Artificial sequence
  synthetic polynucleotide sequence
caaggtacaagctcagga

SEQ ID NO: 8190 - DNA, 18 bp, Artificial sequence
  synthetic polynucleotide sequence
tcataccgacacagctga

SEQ ID NO: 8191 - DNA, 18 bp, Artificial sequence
  synthetic polynucleotide sequence
tgcaaccaccagagagca

SEQ ID NO: 8192 - DNA, 18 bp, Artificial sequence
  synthetic polynucleotide sequence
acagtcacagtccacaca

SEQ ID NO: 8193 - DNA, 18 bp, Artificial sequence
  synthetic polynucleotide sequence
gtggacaggaggtcagga

SEQ ID NO: 8194 - DNA, 18 bp, Artificial sequence
  synthetic polynucleotide sequence
ctcacaccgtccctggga

SEQ ID NO: 8195 - DNA, 18 bp, Artificial sequence
  synthetic polynucleotide sequence
atacccagccagcgccca

SEQ ID NO: 8196 - DNA, 18 bp, Artificial sequence
  synthetic polynucleotide sequence
agcccgctatgcacccca

SEQ ID NO: 8197 - DNA, 18 bp, Artificial sequence
  synthetic polynucleotide sequence
ggtgagcgcgaagaccaa

SEQ ID NO: 8198 - DNA, 18 bp, Artificial sequence
  synthetic polynucleotide sequence
acccaggttggtgaggca

SEQ ID NO: 8199 - DNA, 18 bp, Artificial sequence
  synthetic polynucleotide sequence
gccctgacatgcagggaa

SEQ ID NO: 8200 - DNA, 18 bp, Artificial sequence
  synthetic polynucleotide sequence
cgcccaggttggtaagga

SEQ ID NO: 8201 - DNA, 18 bp, Artificial sequence
  synthetic polynucleotide sequence
caagcagctgaaccggca

SEQ ID NO: 8202 - DNA, 18 bp, Artificial sequence
  synthetic polynucleotide sequence
gcccatgctgcccaggca

SEQ ID NO: 8203 - DNA, 18 bp, Artificial sequence
  synthetic polynucleotide sequence
acacgcccgacgaggaga

SEQ ID NO: 8204 - DNA, 18 bp, Artificial sequence
  synthetic polynucleotide sequence
gatgcccaggagagcgca

SEQ ID NO: 8205 - DNA, 18 bp, Artificial sequence
  synthetic polynucleotide sequence
cacagccattgtccgcaa

SEQ ID NO: 8206 - DNA, 18 bp, Artificial sequence
  synthetic polynucleotide sequence
tgatggaggaggtgccga

SEQ ID NO: 8207 - DNA, 18 bp, Artificial sequence
  synthetic polynucleotide sequence
gacctggtgtggaaggca

SEQ ID NO: 8208 - DNA, 18 bp, Artificial sequence
  synthetic polynucleotide sequence
ccacagtcactgagcgca

SEQ ID NO: 8209 - DNA, 18 bp, Artificial sequence
  synthetic polynucleotide sequence
gtgacagtatcccgagca

SEQ ID NO: 8210 - DNA, 18 bp, Artificial sequence
  synthetic polynucleotide sequence
tccagtggctgaggcgga

SEQ ID NO: 8211 - DNA, 18 bp, Artificial sequence
  synthetic polynucleotide sequence
tcttggagggggaggaga

SEQ ID NO: 8212 - DNA, 18 bp, Artificial sequence
  synthetic polynucleotide sequence
cgccatccgcgttaacca

SEQ ID NO: 8213 - DNA, 18 bp, Artificial sequence
  synthetic polynucleotide sequence
cctctacaccaaggccaa

SEQ ID NO: 8214 - DNA, 18 bp, Artificial sequence
  synthetic polynucleotide sequence
cccgcatcaccatctcga

SEQ ID NO: 8215 - DNA, 18 bp, Artificial sequence
  synthetic polynucleotide sequence
ggactgcctgagctgcga

SEQ ID NO: 8216 - DNA, 18 bp, Artificial sequence
  synthetic polynucleotide sequence
tgtcacaggatgcgcaga

SEQ ID NO: 8217 - DNA, 18 bp, Artificial sequence
  synthetic polynucleotide sequence
cagtcagtgggaagcgca

SEQ ID NO: 8218 - DNA, 18 bp, Artificial sequence
  synthetic polynucleotide sequence
gaagagcctccgaggtca

SEQ ID NO: 8219 - DNA, 18 bp, Artificial sequence
  synthetic polynucleotide sequence
gcaaaggcaggcacagga

SEQ ID NO: 8220 - DNA, 18 bp, Artificial sequence
  synthetic polynucleotide sequence
aggggtggagccaaggga

SEQ ID NO: 8221 - DNA, 18 bp, Artificial sequence
  synthetic polynucleotide sequence
ccagatgcctggagacca

SEQ ID NO: 8222 - DNA, 18 bp, Artificial sequence
  synthetic polynucleotide sequence
cccactctggactgcaga

SEQ ID NO: 8223 - DNA, 18 bp, Artificial sequence
  synthetic polynucleotide sequence
actcagcctacacccgaa

SEQ ID NO: 8224 - DNA, 18 bp, Artificial sequence
  synthetic polynucleotide sequence
gtgacctgaagagcctga

SEQ ID NO: 8225 - DNA, 18 bp, Artificial sequence
  synthetic polynucleotide sequence
agtgttgagcccggagga

SEQ ID NO: 8226 - DNA, 18 bp, Artificial sequence
  synthetic polynucleotide sequence
agttcgaccccatccaca

SEQ ID NO: 8227 - DNA, 18 bp, Artificial sequence
  synthetic polynucleotide sequence
gtgtccgcaacctgcaga

SEQ ID NO: 8228 - DNA, 18 bp, Artificial sequence
  synthetic polynucleotide sequence
ccattgcggtccaggcca

SEQ ID NO: 8229 - DNA, 18 bp, Artificial sequence
  synthetic polynucleotide sequence
gatgaaggagtccgccca

SEQ ID NO: 8230 - DNA, 18 bp, Artificial sequence
  synthetic polynucleotide sequence
ctccagctgggaagtgca

SEQ ID NO: 8231 - DNA, 17 bp, Artificial sequence
  synthetic polynucleotide sequence
gcactgccgacattgaa

SEQ ID NO: 8232 - DNA, 19 bp, Artificial sequence
  synthetic polynucleotide sequence
cgtgggtctacagggagaa

SEQ ID NO: 8233 - DNA, 18 bp, Artificial sequence
  synthetic polynucleotide sequence
cggcatggtgggcgacga

SEQ ID NO: 8234 - DNA, 18 bp, Artificial sequence
  synthetic polynucleotide sequence
gccaccaggtctgggaga

SEQ ID NO: 8235 - DNA, 18 bp, Artificial sequence
  synthetic polynucleotide sequence
tctgcctggaggacagca

SEQ ID NO: 8236 - DNA, 18 bp, Artificial sequence
  synthetic polynucleotide sequence
cgatccactggcagtcga

SEQ ID NO: 8237 - DNA, 18 bp, Artificial sequence
  synthetic polynucleotide sequence
gaccacctacctggagga

SEQ ID NO: 8238 - DNA, 18 bp, Artificial sequence
  synthetic polynucleotide sequence
tctgggaggagaagcgca

SEQ ID NO: 8239 - DNA, 18 bp, Artificial sequence
  synthetic polynucleotide sequence
cccatcatggcacccaca

SEQ ID NO: 8240 - DNA, 18 bp, Artificial sequence
  synthetic polynucleotide sequence
aggcggtctcctgcacca

SEQ ID NO: 8241 - DNA, 18 bp, Artificial sequence
  synthetic polynucleotide sequence
atggactggccctacgga

SEQ ID NO: 8242 - DNA, 18 bp, Artificial sequence
  synthetic polynucleotide sequence
tcagccaccttggagcca

SEQ ID NO: 8243 - DNA, 18 bp, Artificial sequence
  synthetic polynucleotide sequence
gcctcaagtggagccgaa

SEQ ID NO: 8244 - DNA, 18 bp, Artificial sequence
  synthetic polynucleotide sequence
agcagcagtcagcaccca

SEQ ID NO: 8245 - DNA, 18 bp, Artificial sequence
  synthetic polynucleotide sequence
cgacggatcccaatgtca

SEQ ID NO: 8246 - DNA, 18 bp, Artificial sequence
  synthetic polynucleotide sequence
taacagtcagaggcacga

SEQ ID NO: 8247 - DNA, 18 bp, Artificial sequence
  synthetic polynucleotide sequence
ggcggaatcgggatacca

SEQ ID NO: 8248 - DNA, 18 bp, Artificial sequence
  synthetic polynucleotide sequence
ataggccagcacgtcgca

SEQ ID NO: 8249 - DNA, 18 bp, Artificial sequence
  synthetic polynucleotide sequence
gtgatcggaggaagtgca

SEQ ID NO: 8250 - DNA, 18 bp, Artificial sequence
  synthetic polynucleotide sequence
aagcaggcttctgaggca

SEQ ID NO: 8251 - DNA, 18 bp, Artificial sequence
  synthetic polynucleotide sequence
gggcaaggcaaagtggga

SEQ ID NO: 8252 - DNA, 18 bp, Artificial sequence
  synthetic polynucleotide sequence
cgtgccagagggccagga

SEQ ID NO: 8253 - DNA, 18 bp, Artificial sequence
  synthetic polynucleotide sequence
ggaaccacctgctgacca

SEQ ID NO: 8254 - DNA, 18 bp, Artificial sequence
  synthetic polynucleotide sequence
cagggtgtccatgccaca

SEQ ID NO: 8255 - DNA, 18 bp, Artificial sequence
  synthetic polynucleotide sequence
cttacggggcagcagcaa

SEQ ID NO: 8256 - DNA, 18 bp, Artificial sequence
  synthetic polynucleotide sequence
gggttggtacagaaggga

SEQ ID NO: 8257 - DNA, 18 bp, Artificial sequence
  synthetic polynucleotide sequence
agtgatgaggagcgcgca

SEQ ID NO: 8258 - DNA, 18 bp, Artificial sequence
  synthetic polynucleotide sequence
gctcggaagtcagccgga

SEQ ID NO: 8259 - DNA, 18 bp, Artificial sequence
  synthetic polynucleotide sequence
gggcaaagactggaccca

SEQ ID NO: 8260 - DNA, 18 bp, Artificial sequence
  synthetic polynucleotide sequence
gaacaagctgctggggga

SEQ ID NO: 8261 - DNA, 18 bp, Artificial sequence
  synthetic polynucleotide sequence
atggcaccgtggccgaga

SEQ ID NO: 8262 - DNA, 18 bp, Artificial sequence
  synthetic polynucleotide sequence
gccgggactgctccacca

SEQ ID NO: 8263 - DNA, 18 bp, Artificial sequence
  synthetic polynucleotide sequence
ctctcacagccgcagaca

SEQ ID NO: 8264 - DNA, 18 bp, Artificial sequence
  synthetic polynucleotide sequence
cccgacccctttccacca

SEQ ID NO: 8265 - DNA, 18 bp, Artificial sequence
  synthetic polynucleotide sequence
caacaagctccgagggca

SEQ ID NO: 8266 - DNA, 18 bp, Artificial sequence
  synthetic polynucleotide sequence
ctcggagaatccgctcca

SEQ ID NO: 8267 - DNA, 18 bp, Artificial sequence
  synthetic polynucleotide sequence
aacacgctgctctgagca

SEQ ID NO: 8268 - DNA, 18 bp, Artificial sequence
  synthetic polynucleotide sequence
accagcaatcacgtccga

SEQ ID NO: 8269 - DNA, 18 bp, Artificial sequence
  synthetic polynucleotide sequence
cggtcacctacacagcga

SEQ ID NO: 8270 - DNA, 18 bp, Artificial sequence
  synthetic polynucleotide sequence
gcacaacgcaggtgacca

SEQ ID NO: 8271 - DNA, 18 bp, Artificial sequence
  synthetic polynucleotide sequence
cacgcagtaccgcagcca

SEQ ID NO: 8272 - DNA, 18 bp, Artificial sequence
  synthetic polynucleotide sequence
aggccaggtaggcagcga

SEQ ID NO: 8273 - DNA, 18 bp, Artificial sequence
  synthetic polynucleotide sequence
cctgcggagaaagggcaa

SEQ ID NO: 8274 - DNA, 18 bp, Artificial sequence
  synthetic polynucleotide sequence
ataagcccgtgtggggga

SEQ ID NO: 8275 - DNA, 18 bp, Artificial sequence
  synthetic polynucleotide sequence
cacagtgcccaagggcca

SEQ ID NO: 8276 - DNA, 18 bp, Artificial sequence
  synthetic polynucleotide sequence
gggcagtaggccaagcca

SEQ ID NO: 8277 - DNA, 18 bp, Artificial sequence
  synthetic polynucleotide sequence
ggcactgctcaacgagga

SEQ ID NO: 8278 - DNA, 18 bp, Artificial sequence
  synthetic polynucleotide sequence
ggactgatcggggtgcca

SEQ ID NO: 8279 - DNA, 18 bp, Artificial sequence
  synthetic polynucleotide sequence
cgtgaccacgtgacagca

SEQ ID NO: 8280 - DNA, 18 bp, Artificial sequence
  synthetic polynucleotide sequence
ccagtagtcaaggcgcca

SEQ ID NO: 8281 - DNA, 18 bp, Artificial sequence
  synthetic polynucleotide sequence
agagcgcactcggagaga

SEQ ID NO: 8282 - DNA, 18 bp, Artificial sequence
  synthetic polynucleotide sequence
gggtagcagcacagccca

SEQ ID NO: 8283 - DNA, 18 bp, Artificial sequence
  synthetic polynucleotide sequence
cctcctgggagaaccaga

SEQ ID NO: 8284 - DNA, 18 bp, Artificial sequence
  synthetic polynucleotide sequence
gaggcctgtgatgccaga

SEQ ID NO: 8285 - DNA, 18 bp, Artificial sequence
  synthetic polynucleotide sequence
ctgacctcacggccacca

SEQ ID NO: 8286 - DNA, 18 bp, Artificial sequence
  synthetic polynucleotide sequence
cccgaaccagcaaggcca

SEQ ID NO: 8287 - DNA, 18 bp, Artificial sequence
  synthetic polynucleotide sequence
ggcaacacaaggtcacca

SEQ ID NO: 8288 - DNA, 18 bp, Artificial sequence
  synthetic polynucleotide sequence
tggacacggactggggca

SEQ ID NO: 8289 - DNA, 18 bp, Artificial sequence
  synthetic polynucleotide sequence
tgaccagaacctgagcga

SEQ ID NO: 8290 - DNA, 18 bp, Artificial sequence
  synthetic polynucleotide sequence
acttggccactgccagga

SEQ ID NO: 8291 - DNA, 18 bp, Artificial sequence
  synthetic polynucleotide sequence
ctcaggccaatgggcaca

SEQ ID NO: 8292 - DNA, 18 bp, Artificial sequence
  synthetic polynucleotide sequence
acgcagacccagcacaga

SEQ ID NO: 8293 - DNA, 18 bp, Artificial sequence
  synthetic polynucleotide sequence
ggccactgttggaccgaa

SEQ ID NO: 8294 - DNA, 18 bp, Artificial sequence
  synthetic polynucleotide sequence
ggatcacactgaggcgca

SEQ ID NO: 8295 - DNA, 18 bp, Artificial sequence
  synthetic polynucleotide sequence
gaaaggacaaggaagcca

SEQ ID NO: 8296 - DNA, 18 bp, Artificial sequence
  synthetic polynucleotide sequence
gtgggagcggcatccaca

SEQ ID NO: 8297 - DNA, 18 bp, Artificial sequence
  synthetic polynucleotide sequence
cgctggaagtgtgacgga

SEQ ID NO: 8298 - DNA, 18 bp, Artificial sequence
  synthetic polynucleotide sequence
atcagagcggtccccaca

SEQ ID NO: 8299 - DNA, 18 bp, Artificial sequence
  synthetic polynucleotide sequence
tcactgcccctagagcca

SEQ ID NO: 8300 - DNA, 18 bp, Artificial sequence
  synthetic polynucleotide sequence
catcttccagggccagga

SEQ ID NO: 8301 - DNA, 18 bp, Artificial sequence
  synthetic polynucleotide sequence
gcctactccacaggagga

SEQ ID NO: 8302 - DNA, 18 bp, Artificial sequence
  synthetic polynucleotide sequence
ttgcggtccaggcccaga

SEQ ID NO: 8303 - DNA, 18 bp, Artificial sequence
  synthetic polynucleotide sequence
cgctgcatccccaagaga

SEQ ID NO: 8304 - DNA, 18 bp, Artificial sequence
  synthetic polynucleotide sequence
ctgggaatgcaacgccca

SEQ ID NO: 8305 - DNA, 18 bp, Artificial sequence
  synthetic polynucleotide sequence
ggagtgcacagagagcga

SEQ ID NO: 8306 - DNA, 18 bp, Artificial sequence
  synthetic polynucleotide sequence
gcctggcagtatgcacca

SEQ ID NO: 8307 - DNA, 18 bp, Artificial sequence
  synthetic polynucleotide sequence
gtgccaacctcaacggca

SEQ ID NO: 8308 - DNA, 18 bp, Artificial sequence
  synthetic polynucleotide sequence
ccaggttctgccacagca

SEQ ID NO: 8309 - DNA, 18 bp, Artificial sequence
  synthetic polynucleotide sequence
ggaagtcagcctggagga

SEQ ID NO: 8310 - DNA, 18 bp, Artificial sequence
  synthetic polynucleotide sequence
gtggactgggcatgagca

SEQ ID NO: 8311 - DNA, 18 bp, Artificial sequence
  synthetic polynucleotide sequence
gtggccaaaaccgcacca

SEQ ID NO: 8312 - DNA, 18 bp, Artificial sequence
  synthetic polynucleotide sequence
agagtagtgggcagggca

SEQ ID NO: 8313 - DNA, 18 bp, Artificial sequence
  synthetic polynucleotide sequence
cgacctggtgaagcggaa

SEQ ID NO: 8314 - DNA, 18 bp, Artificial sequence
  synthetic polynucleotide sequence
tgccaggccctctggaga

SEQ ID NO: 8315 - DNA, 18 bp, Artificial sequence
  synthetic polynucleotide sequence
gcacacggagctgaagga

SEQ ID NO: 8316 - DNA, 18 bp, Artificial sequence
  synthetic polynucleotide sequence
gccaggtcccacaggtca

SEQ ID NO: 8317 - DNA, 18 bp, Artificial sequence
  synthetic polynucleotide sequence
aacgcaagttaggcggga

SEQ ID NO: 8318 - DNA, 18 bp, Artificial sequence
  synthetic polynucleotide sequence
cctggatgacacgggtca

SEQ ID NO: 8319 - DNA, 18 bp, Artificial sequence
  synthetic polynucleotide sequence
gcatgacccaggcccaga

SEQ ID NO: 8320 - DNA, 18 bp, Artificial sequence
  synthetic polynucleotide sequence
tgcagcagcaacagccga

SEQ ID NO: 8321 - DNA, 18 bp, Artificial sequence
  synthetic polynucleotide sequence
ggcagtgtgagaagccga

SEQ ID NO: 8322 - DNA, 18 bp, Artificial sequence
  synthetic polynucleotide sequence
cctgaggccaaccaggca

SEQ ID NO: 8323 - DNA, 18 bp, Artificial sequence
  synthetic polynucleotide sequence
acctggccagcctgcaga

SEQ ID NO: 8324 - DNA, 18 bp, Artificial sequence
  synthetic polynucleotide sequence
tccaggcgatcctcacca

SEQ ID NO: 8325 - DNA, 18 bp, Artificial sequence
  synthetic polynucleotide sequence
actcagctgctgcggcaa

SEQ ID NO: 8326 - DNA, 18 bp, Artificial sequence
  synthetic polynucleotide sequence
gcacgtggctcagggaca

SEQ ID NO: 8327 - DNA, 18 bp, Artificial sequence
  synthetic polynucleotide sequence
cctcatccccaacgagga

SEQ ID NO: 8328 - DNA, 18 bp, Artificial sequence
  synthetic polynucleotide sequence
caggaggcctgttcgcaa

SEQ ID NO: 8329 - DNA, 18 bp, Artificial sequence
  synthetic polynucleotide sequence
tgctgccaacgacgctga

SEQ ID NO: 8330 - DNA, 18 bp, Artificial sequence
  synthetic polynucleotide sequence
accatagtgaaccagcca

SEQ ID NO: 8331 - DNA, 18 bp, Artificial sequence
  synthetic polynucleotide sequence
cgctgactgtcagagcga

SEQ ID NO: 8332 - DNA, 18 bp, Artificial sequence
  synthetic polynucleotide sequence
catctgccaaggccagca

SEQ ID NO: 8333 - DNA, 18 bp, Artificial sequence
  synthetic polynucleotide sequence
ccgagctcaaatgccgca

SEQ ID NO: 8334 - DNA, 18 bp, Artificial sequence
  synthetic polynucleotide sequence
gcgtgccgtcatgcagga

SEQ ID NO: 8335 - DNA, 18 bp, Artificial sequence
  synthetic polynucleotide sequence
ttggagagctgagcagca

SEQ ID NO: 8336 - DNA, 18 bp, Artificial sequence
  synthetic polynucleotide sequence
gaagagttgctaccacga

SEQ ID NO: 8337 - DNA, 18 bp, Artificial sequence
  synthetic polynucleotide sequence
tcccctggaactcgagca

SEQ ID NO: 8338 - DNA, 18 bp, Artificial sequence
  synthetic polynucleotide sequence
ccatggtacgcctggaga

SEQ ID NO: 8339 - DNA, 18 bp, Artificial sequence
  synthetic polynucleotide sequence
gtcagaatcccccatcca

SEQ ID NO: 8340 - DNA, 18 bp, Artificial sequence
  synthetic polynucleotide sequence
caggccatcattagcgca

SEQ ID NO: 8341 - DNA, 18 bp, Artificial sequence
  synthetic polynucleotide sequence
cacctacatcccagagca

SEQ ID NO: 8342 - DNA, 18 bp, Artificial sequence
  synthetic polynucleotide sequence
ggaagaggtgggaaggca

SEQ ID NO: 8343 - DNA, 18 bp, Artificial sequence
  synthetic polynucleotide sequence
ctcaagaagctggcggca

SEQ ID NO: 8344 - DNA, 18 bp, Artificial sequence
  synthetic polynucleotide sequence
acagcctgagcgtgacca

SEQ ID NO: 8345 - DNA, 18 bp, Artificial sequence
  synthetic polynucleotide sequence
aggaggttccagcgcaca

SEQ ID NO: 8346 - DNA, 18 bp, Artificial sequence
  synthetic polynucleotide sequence
cctgctggagaaccagga

SEQ ID NO: 8347 - DNA, 18 bp, Artificial sequence
  synthetic polynucleotide sequence
gccagatgaaggacccga

SEQ ID NO: 8348 - DNA, 18 bp, Artificial sequence
  synthetic polynucleotide sequence
caccttcatcccagggca

SEQ ID NO: 8349 - DNA, 18 bp, Artificial sequence
  synthetic polynucleotide sequence
ccgagacctgaaacccca

SEQ ID NO: 8350 - DNA, 18 bp, Artificial sequence
  synthetic polynucleotide sequence
gcaacttcaggtgcacga

SEQ ID NO: 8351 - DNA, 18 bp, Artificial sequence
  synthetic polynucleotide sequence
tgcagaaccacagcctga

SEQ ID NO: 8352 - DNA, 18 bp, Artificial sequence
  synthetic polynucleotide sequence
gacttcaagtcagcgcca

SEQ ID NO: 8353 - DNA, 18 bp, Artificial sequence
  synthetic polynucleotide sequence
cctcaggcagctcagaca

SEQ ID NO: 8354 - DNA, 18 bp, Artificial sequence
  synthetic polynucleotide sequence
gggcagacatggcagcca

SEQ ID NO: 8355 - DNA, 18 bp, Artificial sequence
  synthetic polynucleotide sequence
gccttcggaagctgcaga

SEQ ID NO: 8356 - DNA, 18 bp, Artificial sequence
  synthetic polynucleotide sequence
aagaagagcgtgtgcaga

SEQ ID NO: 8357 - DNA, 18 bp, Artificial sequence
  synthetic polynucleotide sequence
gacggtgggagccacaga

SEQ ID NO: 8358 - DNA, 18 bp, Artificial sequence
  synthetic polynucleotide sequence
taaccagcaggatgacga

SEQ ID NO: 8359 - DNA, 18 bp, Artificial sequence
  synthetic polynucleotide sequence
aacgctacccagccagca

SEQ ID NO: 8360 - DNA, 18 bp, Artificial sequence
  synthetic polynucleotide sequence
atatgtgcagggcccaga

SEQ ID NO: 8361 - DNA, 18 bp, Artificial sequence
  synthetic polynucleotide sequence
cagagcctgctaagccca

SEQ ID NO: 8362 - DNA, 18 bp, Artificial sequence
  synthetic polynucleotide sequence
gatgcagacgacgccgca

SEQ ID NO: 8363 - DNA, 18 bp, Artificial sequence
  synthetic polynucleotide sequence
ccagcctcatcgaggaca

SEQ ID NO: 8364 - DNA, 18 bp, Artificial sequence
  synthetic polynucleotide sequence
ccacatgaatacgctcca

SEQ ID NO: 8365 - DNA, 18 bp, Artificial sequence
  synthetic polynucleotide sequence
gggacaagttctggcgga

SEQ ID NO: 8366 - DNA, 18 bp, Artificial sequence
  synthetic polynucleotide sequence
gtcggggatgcgcaggta

SEQ ID NO: 8367 - DNA, 18 bp, Artificial sequence
  synthetic polynucleotide sequence
cgggtaaagttccaggga

SEQ ID NO: 8368 - DNA, 18 bp, Artificial sequence
  synthetic polynucleotide sequence
caatggtgccgtccagca

SEQ ID NO: 8369 - DNA, 18 bp, Artificial sequence
  synthetic polynucleotide sequence
ggacggagagcgcgagga

SEQ ID NO: 8370 - DNA, 18 bp, Artificial sequence
  synthetic polynucleotide sequence
gcagtcacggtcagtgca

SEQ ID NO: 8371 - DNA, 18 bp, Artificial sequence
  synthetic polynucleotide sequence
agcagcccaggacaccca

SEQ ID NO: 8372 - DNA, 18 bp, Artificial sequence
  synthetic polynucleotide sequence
gtggtagggctcagggga

SEQ ID NO: 8373 - DNA, 18 bp, Artificial sequence
  synthetic polynucleotide sequence
ccaagacgactcgaggga

SEQ ID NO: 8374 - DNA, 18 bp, Artificial sequence
  synthetic polynucleotide sequence
ataggggaggtccccgga

SEQ ID NO: 8375 - DNA, 18 bp, Artificial sequence
  synthetic polynucleotide sequence
ctaccgccagatgcgcaa

SEQ ID NO: 8376 - DNA, 18 bp, Artificial sequence
  synthetic polynucleotide sequence
ctcggtgacatggggaca

SEQ ID NO: 8377 - DNA, 18 bp, Artificial sequence
  synthetic polynucleotide sequence
caggaactccactatgca

SEQ ID NO: 8378 - DNA, 18 bp, Artificial sequence
  synthetic polynucleotide sequence
acccgcctgggttgagga

SEQ ID NO: 8379 - DNA, 18 bp, Artificial sequence
  synthetic polynucleotide sequence
tatccagggctgcaggaa

SEQ ID NO: 8380 - DNA, 18 bp, Artificial sequence
  synthetic polynucleotide sequence
tgaggactaggtggggga

SEQ ID NO: 8381 - DNA, 18 bp, Artificial sequence
  synthetic polynucleotide sequence
cagacgctccagagggca

SEQ ID NO: 8382 - DNA, 18 bp, Artificial sequence
  synthetic polynucleotide sequence
attgaatgcagagccgca

SEQ ID NO: 8383 - DNA, 18 bp, Artificial sequence
  synthetic polynucleotide sequence
ggccaggagacaagggta

SEQ ID NO: 8384 - DNA, 18 bp, Artificial sequence
  synthetic polynucleotide sequence
ctctcgcgaagtccacca

SEQ ID NO: 8385 - DNA, 18 bp, Artificial sequence
  synthetic polynucleotide sequence
cggagccagaagtggcaa

SEQ ID NO: 8386 - DNA, 18 bp, Artificial sequence
  synthetic polynucleotide sequence
gacagctggggttgacca

SEQ ID NO: 8387 - DNA, 18 bp, Artificial sequence
  synthetic polynucleotide sequence
gtgaccagggcttcgaga

SEQ ID NO: 8388 - DNA, 18 bp, Artificial sequence
  synthetic polynucleotide sequence
ctccaggtcactggcaca

SEQ ID NO: 8389 - DNA, 18 bp, Artificial sequence
  synthetic polynucleotide sequence
gtgaacgagtgcgaggca

SEQ ID NO: 8390 - DNA, 18 bp, Artificial sequence
  synthetic polynucleotide sequence
gttcaggtccacgcacga

SEQ ID NO: 8391 - DNA, 18 bp, Artificial sequence
  synthetic polynucleotide sequence
agccactgcccccagaga

SEQ ID NO: 8392 - DNA, 18 bp, Artificial sequence
  synthetic polynucleotide sequence
gcggacgcctcttgagca

SEQ ID NO: 8393 - DNA, 18 bp, Artificial sequence
  synthetic polynucleotide sequence
ccaggtgaactgcagcga

SEQ ID NO: 8394 - DNA, 18 bp, Artificial sequence
  synthetic polynucleotide sequence
agtgggcgagcaggccga

SEQ ID NO: 8395 - DNA, 18 bp, Artificial sequence
  synthetic polynucleotide sequence
gcctcgatggcaaacgga

SEQ ID NO: 8396 - DNA, 18 bp, Artificial sequence
  synthetic polynucleotide sequence
atccgagacaccacggca

SEQ ID NO: 8397 - DNA, 18 bp, Artificial sequence
  synthetic polynucleotide sequence
gtgcctaagacccccaca

SEQ ID NO: 8398 - DNA, 18 bp, Artificial sequence
  synthetic polynucleotide sequence
gaggggcttgaggccaga

SEQ ID NO: 8399 - DNA, 18 bp, Artificial sequence
  synthetic polynucleotide sequence
ggacgagaagcgcagcaa

SEQ ID NO: 8400 - DNA, 18 bp, Artificial sequence
  synthetic polynucleotide sequence
gtgaacaattccgcagga

SEQ ID NO: 8401 - DNA, 18 bp, Artificial sequence
  synthetic polynucleotide sequence
gccctgaaagctacccaa

SEQ ID NO: 8402 - DNA, 18 bp, Artificial sequence
  synthetic polynucleotide sequence
agaatgagccactgcaga

SEQ ID NO: 8403 - DNA, 18 bp, Artificial sequence
  synthetic polynucleotide sequence
agcagctcttgacaggga

SEQ ID NO: 8404 - DNA, 18 bp, Artificial sequence
  synthetic polynucleotide sequence
ggtgggagtaacatccga

SEQ ID NO: 8405 - DNA, 18 bp, Artificial sequence
  synthetic polynucleotide sequence
ggacaagaaactgcacca

SEQ ID NO: 8406 - DNA, 18 bp, Artificial sequence
  synthetic polynucleotide sequence
ataaccacaggcaaccca

SEQ ID NO: 8407 - DNA, 18 bp, Artificial sequence
  synthetic polynucleotide sequence
gcttgaaccagaagagca

SEQ ID NO: 8408 - DNA, 18 bp, Artificial sequence
  synthetic polynucleotide sequence
ccaatgccggcactagca

SEQ ID NO: 8409 - DNA, 18 bp, Artificial sequence
  synthetic polynucleotide sequence
ctggaccccatggtcaca

SEQ ID NO: 8410 - DNA, 18 bp, Artificial sequence
  synthetic polynucleotide sequence
aagagtccagcctgggga

SEQ ID NO: 8411 - DNA, 18 bp, Artificial sequence
  synthetic polynucleotide sequence
cagcgccgtggcaagcca

SEQ ID NO: 8412 - DNA, 18 bp, Artificial sequence
  synthetic polynucleotide sequence
ctggcaagagacaggtca

SEQ ID NO: 8413 - DNA, 18 bp, Artificial sequence
  synthetic polynucleotide sequence
tggtccccagcagacgca

SEQ ID NO: 8414 - DNA, 18 bp, Artificial sequence
  synthetic polynucleotide sequence
ccgtggaaggggcacaga

SEQ ID NO: 8415 - DNA, 18 bp, Artificial sequence
  synthetic polynucleotide sequence
cagtgtccgaatcaccga

SEQ ID NO: 8416 - DNA, 18 bp, Artificial sequence
  synthetic polynucleotide sequence
aacgaagtcacaggagga

SEQ ID NO: 8417 - DNA, 18 bp, Artificial sequence
  synthetic polynucleotide sequence
ctcccagcgaacggacga

SEQ ID NO: 8418 - DNA, 18 bp, Artificial sequence
  synthetic polynucleotide sequence
cgctgcacaaccagcgga

SEQ ID NO: 8419 - DNA, 18 bp, Artificial sequence
  synthetic polynucleotide sequence
gcagacagacgttgcaga

SEQ ID NO: 8420 - DNA, 18 bp, Artificial sequence
  synthetic polynucleotide sequence
tgaaggagcgcctgcaca

SEQ ID NO: 8421 - DNA, 18 bp, Artificial sequence
  synthetic polynucleotide sequence
agcgacagcggcttggaa

SEQ ID NO: 8422 - DNA, 18 bp, Artificial sequence
  synthetic polynucleotide sequence
ttgggcagagccgcctca

SEQ ID NO: 8423 - DNA, 18 bp, Artificial sequence
  synthetic polynucleotide sequence
ctgaggtgcacaagccca

SEQ ID NO: 8424 - DNA, 18 bp, Artificial sequence
  synthetic polynucleotide sequence
acatatggagtgacggga

SEQ ID NO: 8425 - DNA, 18 bp, Artificial sequence
  synthetic polynucleotide sequence
gacgccgtggaacagcaa

SEQ ID NO: 8426 - DNA, 18 bp, Artificial sequence
  synthetic polynucleotide sequence
gggacttcctccccacca

SEQ ID NO: 8427 - DNA, 18 bp, Artificial sequence
  synthetic polynucleotide sequence
ggctctcaagctcccaca

SEQ ID NO: 8428 - DNA, 18 bp, Artificial sequence
  synthetic polynucleotide sequence
gcacccccactgtaggca

SEQ ID NO: 8429 - DNA, 18 bp, Artificial sequence
  synthetic polynucleotide sequence
agggaaagccatggcgga

SEQ ID NO: 8430 - DNA, 18 bp, Artificial sequence
  synthetic polynucleotide sequence
ggcaccgacagggtggta

SEQ ID NO: 8431 - DNA, 18 bp, Artificial sequence
  synthetic polynucleotide sequence
gttcaccaacagccggga

SEQ ID NO: 8432 - DNA, 18 bp, Artificial sequence
  synthetic polynucleotide sequence
gccgcaccaggaagccga

SEQ ID NO: 8433 - DNA, 18 bp, Artificial sequence
  synthetic polynucleotide sequence
cccaagccacagaagcca

SEQ ID NO: 8434 - DNA, 18 bp, Artificial sequence
  synthetic polynucleotide sequence
tccaggaaggcttgcaca

SEQ ID NO: 8435 - DNA, 18 bp, Artificial sequence
  synthetic polynucleotide sequence
cctgagggactccaccca

SEQ ID NO: 8436 - DNA, 18 bp, Artificial sequence
  synthetic polynucleotide sequence
ggatatcggggcagccta

SEQ ID NO: 8437 - DNA, 18 bp, Artificial sequence
  synthetic polynucleotide sequence
cgggatcatgtaccgcaa

SEQ ID NO: 8438 - DNA, 18 bp, Artificial sequence
  synthetic polynucleotide sequence
ccctggggagcagaagga

SEQ ID NO: 8439 - DNA, 18 bp, Artificial sequence
  synthetic polynucleotide sequence
ccttccagggggactcca

SEQ ID NO: 8440 - DNA, 18 bp, Artificial sequence
  synthetic polynucleotide sequence
cgggcagggtctggccga

SEQ ID NO: 8441 - DNA, 18 bp, Artificial sequence
  synthetic polynucleotide sequence
ccaccaggaccgcagcaa

SEQ ID NO: 8442 - DNA, 18 bp, Artificial sequence
  synthetic polynucleotide sequence
ccaacagaagggctgcca

SEQ ID NO: 8443 - DNA, 18 bp, Artificial sequence
  synthetic polynucleotide sequence
acagggactgcaagggga

SEQ ID NO: 8444 - DNA, 18 bp, Artificial sequence
  synthetic polynucleotide sequence
gcagagataagaccggca

SEQ ID NO: 8445 - DNA, 18 bp, Artificial sequence
  synthetic polynucleotide sequence
agccacggaagaagcaca

SEQ ID NO: 8446 - DNA, 18 bp, Artificial sequence
  synthetic polynucleotide sequence
gagcgtgcattacggcaa

SEQ ID NO: 8447 - DNA, 18 bp, Artificial sequence
  synthetic polynucleotide sequence
gtgtcacgatggaacaga

SEQ ID NO: 8448 - DNA, 18 bp, Artificial sequence
  synthetic polynucleotide sequence
gaggactgggaggaggga

SEQ ID NO: 8449 - DNA, 18 bp, Artificial sequence
  synthetic polynucleotide sequence
aggcgaaccagcagctga

SEQ ID NO: 8450 - DNA, 18 bp, Artificial sequence
  synthetic polynucleotide sequence
atcaggacacccacccca

SEQ ID NO: 8451 - DNA, 18 bp, Artificial sequence
  synthetic polynucleotide sequence
ggcaaaaccccaggagca

SEQ ID NO: 8452 - DNA, 18 bp, Artificial sequence
  synthetic polynucleotide sequence
aagctacagcatcagcga

SEQ ID NO: 8453 - DNA, 18 bp, Artificial sequence
  synthetic polynucleotide sequence
gccatctacgagaacaca

SEQ ID NO: 8454 - DNA, 18 bp, Artificial sequence
  synthetic polynucleotide sequence
ccgggaccaggtgggcca

SEQ ID NO: 8455 - DNA, 18 bp, Artificial sequence
  synthetic polynucleotide sequence
tccactgcgcaaaaagga

SEQ ID NO: 8456 - DNA, 18 bp, Artificial sequence
  synthetic polynucleotide sequence
ccggcctgaacagtgcaa

SEQ ID NO: 8457 - DNA, 18 bp, Artificial sequence
  synthetic polynucleotide sequence
gatggtaggaaagctgga

SEQ ID NO: 8458 - DNA, 18 bp, Artificial sequence
  synthetic polynucleotide sequence
gctgacaagaaggcctca

SEQ ID NO: 8459 - DNA, 18 bp, Artificial sequence
  synthetic polynucleotide sequence
caagcccaaggagcagga

SEQ ID NO: 8460 - DNA, 18 bp, Artificial sequence
  synthetic polynucleotide sequence
gtcccacgggtgtgacca

SEQ ID NO: 8461 - DNA, 18 bp, Artificial sequence
  synthetic polynucleotide sequence
agagcacacccaggagga

SEQ ID NO: 8462 - DNA, 18 bp, Artificial sequence
  synthetic polynucleotide sequence
gagcgcagagttgggaca

SEQ ID NO: 8463 - DNA, 18 bp, Artificial sequence
  synthetic polynucleotide sequence
gtccaaggaggtggcaga

SEQ ID NO: 8464 - DNA, 18 bp, Artificial sequence
  synthetic polynucleotide sequence
ggccttgaagatgaggca

SEQ ID NO: 8465 - DNA, 18 bp, Artificial sequence
  synthetic polynucleotide sequence
caaacctgcgggtgacca

SEQ ID NO: 8466 - DNA, 18 bp, Artificial sequence
  synthetic polynucleotide sequence
tggggcagaagcctcaga

SEQ ID NO: 8467 - DNA, 18 bp, Artificial sequence
  synthetic polynucleotide sequence
gcaccaagtgccacagga

SEQ ID NO: 8468 - DNA, 18 bp, Artificial sequence
  synthetic polynucleotide sequence
gacgtcaggctcacacca

SEQ ID NO: 8469 - DNA, 18 bp, Artificial sequence
  synthetic polynucleotide sequence
cggcctgcacttcgacga

SEQ ID NO: 8470 - DNA, 18 bp, Artificial sequence
  synthetic polynucleotide sequence
aagcggcaggactgggca

SEQ ID NO: 8471 - DNA, 18 bp, Artificial sequence
  synthetic polynucleotide sequence
cggcttcagcaaggagga

SEQ ID NO: 8472 - DNA, 18 bp, Artificial sequence
  synthetic polynucleotide sequence
gcggcaggactgcgcgta

SEQ ID NO: 8473 - DNA, 18 bp, Artificial sequence
  synthetic polynucleotide sequence
gacgtgaagaaggagcca

SEQ ID NO: 8474 - DNA, 18 bp, Artificial sequence
  synthetic polynucleotide sequence
agctgggcgacgagggca

SEQ ID NO: 8475 - DNA, 18 bp, Artificial sequence
  synthetic polynucleotide sequence
ggtgacacggctcaagca

SEQ ID NO: 8476 - DNA, 18 bp, Artificial sequence
  synthetic polynucleotide sequence
ctcgcgctccagctccga

SEQ ID NO: 8477 - DNA, 18 bp, Artificial sequence
  synthetic polynucleotide sequence
ggaacctctatggcgcca

SEQ ID NO: 8478 - DNA, 18 bp, Artificial sequence
  synthetic polynucleotide sequence
ctgctgaacaggacggga

SEQ ID NO: 8479 - DNA, 18 bp, Artificial sequence
  synthetic polynucleotide sequence
tgaaggaagcagacccca

SEQ ID NO: 8480 - DNA, 18 bp, Artificial sequence
  synthetic polynucleotide sequence
gcaatcatgaccaggaca

SEQ ID NO: 8481 - DNA, 18 bp, Artificial sequence
  synthetic polynucleotide sequence
agtggaccccactagcca

SEQ ID NO: 8482 - DNA, 18 bp, Artificial sequence
  synthetic polynucleotide sequence
ttccagcatacaccccca

SEQ ID NO: 8483 - DNA, 18 bp, Artificial sequence
  synthetic polynucleotide sequence
tatcgagccagggagcca

SEQ ID NO: 8484 - DNA, 18 bp, Artificial sequence
  synthetic polynucleotide sequence
ggatgtacaagtggccga

SEQ ID NO: 8485 - DNA, 18 bp, Artificial sequence
  synthetic polynucleotide sequence
gccggtcacaaaggcaga

SEQ ID NO: 8486 - DNA, 18 bp, Artificial sequence
  synthetic polynucleotide sequence
ttgtcacccagcaggcca

SEQ ID NO: 8487 - DNA, 18 bp, Artificial sequence
  synthetic polynucleotide sequence
accggcaggtacccggca

SEQ ID NO: 8488 - DNA, 18 bp, Artificial sequence
  synthetic polynucleotide sequence
cgcagggatgggtaggca

SEQ ID NO: 8489 - DNA, 18 bp, Artificial sequence
  synthetic polynucleotide sequence
tgatggaagtggacccca

SEQ ID NO: 8490 - DNA, 18 bp, Artificial sequence
  synthetic polynucleotide sequence
ttgtcacccagcaggcca

SEQ ID NO: 8491 - DNA, 18 bp, Artificial sequence
  synthetic polynucleotide sequence
ctggaagctcatcaccaa

SEQ ID NO: 8492 - DNA, 18 bp, Artificial sequence
  synthetic polynucleotide sequence
ataggctctcggacccca

SEQ ID NO: 8493 - DNA, 18 bp, Artificial sequence
  synthetic polynucleotide sequence
tgagtgatgagcagggca

SEQ ID NO: 8494 - DNA, 18 bp, Artificial sequence
  synthetic polynucleotide sequence
gagctcttggaccccaca

SEQ ID NO: 8495 - DNA, 18 bp, Artificial sequence
  synthetic polynucleotide sequence
cacagtaggcctcaccga

SEQ ID NO: 8496 - DNA, 17 bp, Artificial sequence
  synthetic polynucleotide sequence
aatgtccctgcacccaa

SEQ ID NO: 8497 - DNA, 18 bp, Artificial sequence
  synthetic polynucleotide sequence
cgcagagtcctccccaga

SEQ ID NO: 8498 - DNA, 18 bp, Artificial sequence
  synthetic polynucleotide sequence
actgcaccaactcagcca

SEQ ID NO: 8499 - DNA, 18 bp, Artificial sequence
  synthetic polynucleotide sequence
ggtcctccagactggcaa

SEQ ID NO: 8500 - DNA, 18 bp, Artificial sequence
  synthetic polynucleotide sequence
ggcacgcgagttgggaga

SEQ ID NO: 8501 - DNA, 18 bp, Artificial sequence
  synthetic polynucleotide sequence
gagagcccaaatgggcca

SEQ ID NO: 8502 - DNA, 18 bp, Artificial sequence
  synthetic polynucleotide sequence
gcacccccatcctccaga

SEQ ID NO: 8503 - DNA, 19 bp, Artificial sequence
  synthetic polynucleotide sequence
ctgaaagtaggagaccgga

SEQ ID NO: 8504 - DNA, 18 bp, Artificial sequence
  synthetic polynucleotide sequence
gaggactcatccccagga

SEQ ID NO: 8505 - DNA, 18 bp, Artificial sequence
  synthetic polynucleotide sequence
tgcccagagaacgggaga

SEQ ID NO: 8506 - DNA, 18 bp, Artificial sequence
  synthetic polynucleotide sequence
gcgaagccttcaggggga

SEQ ID NO: 8507 - DNA, 18 bp, Artificial sequence
  synthetic polynucleotide sequence
gccagatcgcagcccaga

SEQ ID NO: 8508 - DNA, 18 bp, Artificial sequence
  synthetic polynucleotide sequence
agcgtcgtccgggatgga

SEQ ID NO: 8509 - DNA, 18 bp, Artificial sequence
  synthetic polynucleotide sequence
tggaagcagtcaagccca

SEQ ID NO: 8510 - DNA, 18 bp, Artificial sequence
  synthetic polynucleotide sequence
caagtccaataccagcca

SEQ ID NO: 8511 - DNA, 18 bp, Artificial sequence
  synthetic polynucleotide sequence
tcaggagaaaccgccaca

SEQ ID NO: 8512 - DNA, 18 bp, Artificial sequence
  synthetic polynucleotide sequence
tggaatgggaggctccga

SEQ ID NO: 8513 - DNA, 18 bp, Artificial sequence
  synthetic polynucleotide sequence
cacctacaggcactacca

SEQ ID NO: 8514 - DNA, 18 bp, Artificial sequence
  synthetic polynucleotide sequence
agaacaccgcatggacca

SEQ ID NO: 8515 - DNA, 17 bp, Artificial sequence
  synthetic polynucleotide sequence
tggaagcagcagccaca

SEQ ID NO: 8516 - DNA, 19 bp, Artificial sequence
  synthetic polynucleotide sequence
cagacccaaactgcaacca

SEQ ID NO: 8517 - DNA, 18 bp, Artificial sequence
  synthetic polynucleotide sequence
gcctgtaccacgggacca

SEQ ID NO: 8518 - DNA, 18 bp, Artificial sequence
  synthetic polynucleotide sequence
gaagaacgaggctgccga

SEQ ID NO: 8519 - DNA, 18 bp, Artificial sequence
  synthetic polynucleotide sequence
ttaccgggagcaccccaa

SEQ ID NO: 8520 - DNA, 18 bp, Artificial sequence
  synthetic polynucleotide sequence
catccacagcattacgca

SEQ ID NO: 8521 - DNA, 18 bp, Artificial sequence
  synthetic polynucleotide sequence
cccacttcctacacagga

SEQ ID NO: 8522 - DNA, 18 bp, Artificial sequence
  synthetic polynucleotide sequence
ccagagactcctcgcaga

SEQ ID NO: 8523 - DNA, 18 bp, Artificial sequence
  synthetic polynucleotide sequence
gaccacaccacaggccaa

SEQ ID NO: 8524 - DNA, 18 bp, Artificial sequence
  synthetic polynucleotide sequence
ctcatggctaggcgcaga

SEQ ID NO: 8525 - DNA, 18 bp, Artificial sequence
  synthetic polynucleotide sequence
cctggcagcatcagggaa

SEQ ID NO: 8526 - DNA, 18 bp, Artificial sequence
  synthetic polynucleotide sequence
ctgagctcatgggagcca

SEQ ID NO: 8527 - DNA, 18 bp, Artificial sequence
  synthetic polynucleotide sequence
ccacctaccttagggcca

SEQ ID NO: 8528 - DNA, 18 bp, Artificial sequence
  synthetic polynucleotide sequence
gaagcggactcctgcaga

SEQ ID NO: 8529 - DNA, 18 bp, Artificial sequence
  synthetic polynucleotide sequence
cgcaagtctagcagcgga

SEQ ID NO: 8530 - DNA, 18 bp, Artificial sequence
  synthetic polynucleotide sequence
catcagccccgagtgcga

SEQ ID NO: 8531 - DNA, 18 bp, Artificial sequence
  synthetic polynucleotide sequence
aaggacgatggacgcgga

SEQ ID NO: 8532 - DNA, 18 bp, Artificial sequence
  synthetic polynucleotide sequence
gggctgtgtccagcagca

SEQ ID NO: 8533 - DNA, 18 bp, Artificial sequence
  synthetic polynucleotide sequence
gaaaggccatcgagggga

SEQ ID NO: 8534 - DNA, 18 bp, Artificial sequence
  synthetic polynucleotide sequence
tgcagcacagcctccaga

SEQ ID NO: 8535 - DNA, 18 bp, Artificial sequence
  synthetic polynucleotide sequence
gccgtagtcgcagcgaga

SEQ ID NO: 8536 - DNA, 18 bp, Artificial sequence
  synthetic polynucleotide sequence
ctcaagagaagcccagga

SEQ ID NO: 8537 - DNA, 18 bp, Artificial sequence
  synthetic polynucleotide sequence
cgtccatggaacacgcaa

SEQ ID NO: 8538 - DNA, 18 bp, Artificial sequence
  synthetic polynucleotide sequence
tgaagtgcggcactcaga

SEQ ID NO: 8539 - DNA, 18 bp, Artificial sequence
  synthetic polynucleotide sequence
ctatgagacggccctgca

SEQ ID NO: 8540 - DNA, 18 bp, Artificial sequence
  synthetic polynucleotide sequence
ggtgaggcaggtagtcca

SEQ ID NO: 8541 - DNA, 18 bp, Artificial sequence
  synthetic polynucleotide sequence
gcagttcctcccagggca

SEQ ID NO: 8542 - DNA, 18 bp, Artificial sequence
  synthetic polynucleotide sequence
ccgagaggattctaccca

SEQ ID NO: 8543 - DNA, 18 bp, Artificial sequence
  synthetic polynucleotide sequence
tcgggaaggtgaccgaga

SEQ ID NO: 8544 - DNA, 18 bp, Artificial sequence
  synthetic polynucleotide sequence
gatcttcagcaggccaga

SEQ ID NO: 8545 - DNA, 18 bp, Artificial sequence
  synthetic polynucleotide sequence
cacagcccatcaccacca

SEQ ID NO: 8546 - DNA, 18 bp, Artificial sequence
  synthetic polynucleotide sequence
ttgtgggccaggaagcca

SEQ ID NO: 8547 - DNA, 18 bp, Artificial sequence
  synthetic polynucleotide sequence
ggtcgacaaggctgcaga

SEQ ID NO: 8548 - DNA, 18 bp, Artificial sequence
  synthetic polynucleotide sequence
aggttctcggccaggaga

SEQ ID NO: 8549 - DNA, 18 bp, Artificial sequence
  synthetic polynucleotide sequence
cctcacccacagtgacca

SEQ ID NO: 8550 - DNA, 18 bp, Artificial sequence
  synthetic polynucleotide sequence
accaggcacaggtccaca

SEQ ID NO: 8551 - DNA, 18 bp, Artificial sequence
  synthetic polynucleotide sequence
accccgacgactcagcaa

SEQ ID NO: 8552 - DNA, 18 bp, Artificial sequence
  synthetic polynucleotide sequence
cagtgacatcctcagcca

SEQ ID NO: 8553 - DNA, 18 bp, Artificial sequence
  synthetic polynucleotide sequence
ccccgcagagagagcaga

SEQ ID NO: 8554 - DNA, 18 bp, Artificial sequence
  synthetic polynucleotide sequence
gagcagagccaacctgca

SEQ ID NO: 8555 - DNA, 18 bp, Artificial sequence
  synthetic polynucleotide sequence
cctccgagagaagcacca

SEQ ID NO: 8556 - DNA, 18 bp, Artificial sequence
  synthetic polynucleotide sequence
cgacggccagctccacca

SEQ ID NO: 8557 - DNA, 18 bp, Artificial sequence
  synthetic polynucleotide sequence
ggagcctgggcatcacca

SEQ ID NO: 8558 - DNA, 18 bp, Artificial sequence
  synthetic polynucleotide sequence
gggacggctcctccacca

SEQ ID NO: 8559 - DNA, 18 bp, Artificial sequence
  synthetic polynucleotide sequence
cttcggcatcagtggaca

SEQ ID NO: 8560 - DNA, 18 bp, Artificial sequence
  synthetic polynucleotide sequence
cagacatcagagcggaca

SEQ ID NO: 8561 - DNA, 18 bp, Artificial sequence
  synthetic polynucleotide sequence
agcgggcagatcatggca

SEQ ID NO: 8562 - DNA, 18 bp, Artificial sequence
  synthetic polynucleotide sequence
ggtgacagtgaatggaca

SEQ ID NO: 8563 - DNA, 18 bp, Artificial sequence
  synthetic polynucleotide sequence
cgcttctgcccggacaca

SEQ ID NO: 8564 - DNA, 18 bp, Artificial sequence
  synthetic polynucleotide sequence
ccttgaaccaggacgcca

SEQ ID NO: 8565 - DNA, 18 bp, Artificial sequence
  synthetic polynucleotide sequence
gcagtggaagcagcccga

SEQ ID NO: 8566 - DNA, 18 bp, Artificial sequence
  synthetic polynucleotide sequence
gtagacagggtcagcaca

SEQ ID NO: 8567 - DNA, 18 bp, Artificial sequence
  synthetic polynucleotide sequence
gcaaggtgtacaggggca

SEQ ID NO: 8568 - DNA, 18 bp, Artificial sequence
  synthetic polynucleotide sequence
gcacagcccagttgacca

SEQ ID NO: 8569 - DNA, 19 bp, Artificial sequence
  synthetic polynucleotide sequence
tggcagagaagctagacga

SEQ ID NO: 8570 - DNA, 19 bp, Artificial sequence
  synthetic polynucleotide sequence
cacagcttgcccagagaca

SEQ ID NO: 8571 - DNA, 18 bp, Artificial sequence
  synthetic polynucleotide sequence
gcaaacgcctgcagacga

SEQ ID NO: 8572 - DNA, 18 bp, Artificial sequence
  synthetic polynucleotide sequence
ccaccacagtgcagccca

SEQ ID NO: 8573 - DNA, 18 bp, Artificial sequence
  synthetic polynucleotide sequence
tcagccggtcatcgccaa

SEQ ID NO: 8574 - DNA, 18 bp, Artificial sequence
  synthetic polynucleotide sequence
tccacgcggtcaatggca

SEQ ID NO: 8575 - DNA, 18 bp, Artificial sequence
  synthetic polynucleotide sequence
aggcggtacagacagcca

SEQ ID NO: 8576 - DNA, 18 bp, Artificial sequence
  synthetic polynucleotide sequence
tcacgcctgaggtagcca

SEQ ID NO: 8577 - DNA, 18 bp, Artificial sequence
  synthetic polynucleotide sequence
gcaccaggagcagaagca

SEQ ID NO: 8578 - DNA, 18 bp, Artificial sequence
  synthetic polynucleotide sequence
ggtctgtgcagaagcgca

SEQ ID NO: 8579 - DNA, 18 bp, Artificial sequence
  synthetic polynucleotide sequence
agtgataacgcgtcggaa

SEQ ID NO: 8580 - DNA, 18 bp, Artificial sequence
  synthetic polynucleotide sequence
cattgaagggcgctggga

SEQ ID NO: 8581 - DNA, 18 bp, Artificial sequence
  synthetic polynucleotide sequence
gctgctgagtaggaagga

SEQ ID NO: 8582 - DNA, 18 bp, Artificial sequence
  synthetic polynucleotide sequence
gattgaagtagccagcca

SEQ ID NO: 8583 - DNA, 18 bp, Artificial sequence
  synthetic polynucleotide sequence
gcaatgggttgagcccca

SEQ ID NO: 8584 - DNA, 18 bp, Artificial sequence
  synthetic polynucleotide sequence
tgccggttggcagaagga

SEQ ID NO: 8585 - DNA, 18 bp, Artificial sequence
  synthetic polynucleotide sequence
gcacacctgagatcccca

SEQ ID NO: 8586 - DNA, 18 bp, Artificial sequence
  synthetic polynucleotide sequence
cactacaggcctggggga

SEQ ID NO: 8587 - DNA, 18 bp, Artificial sequence
  synthetic polynucleotide sequence
catgaagcagcgggagga

SEQ ID NO: 8588 - DNA, 18 bp, Artificial sequence
  synthetic polynucleotide sequence
cacgcagtagagccagga

SEQ ID NO: 8589 - DNA, 18 bp, Artificial sequence
  synthetic polynucleotide sequence
ccagattacccccacaca

SEQ ID NO: 8590 - DNA, 18 bp, Artificial sequence
  synthetic polynucleotide sequence
ggtgttggaggaagacca

SEQ ID NO: 8591 - DNA, 18 bp, Artificial sequence
  synthetic polynucleotide sequence
agtgccatggccacagca

SEQ ID NO: 8592 - DNA, 18 bp, Artificial sequence
  synthetic polynucleotide sequence
tcacggactcggggacca

SEQ ID NO: 8593 - DNA, 18 bp, Artificial sequence
  synthetic polynucleotide sequence
ttctgcaggcaccaccga

SEQ ID NO: 8594 - DNA, 18 bp, Artificial sequence
  synthetic polynucleotide sequence
cagccacacgttgagcca

SEQ ID NO: 8595 - DNA, 18 bp, Artificial sequence
  synthetic polynucleotide sequence
ggatctgagggaaacgca

SEQ ID NO: 8596 - DNA, 18 bp, Artificial sequence
  synthetic polynucleotide sequence
caaggtcatcagcagtca

SEQ ID NO: 8597 - DNA, 18 bp, Artificial sequence
  synthetic polynucleotide sequence
ggaacaggctgttcccaa

SEQ ID NO: 8598 - DNA, 18 bp, Artificial sequence
  synthetic polynucleotide sequence
ccagatatgggtgggcca

SEQ ID NO: 8599 - DNA, 18 bp, Artificial sequence
  synthetic polynucleotide sequence
tgacccagccgaagtgga

SEQ ID NO: 8600 - DNA, 18 bp, Artificial sequence
  synthetic polynucleotide sequence
actgctgcacctgaagga

SEQ ID NO: 8601 - DNA, 18 bp, Artificial sequence
  synthetic polynucleotide sequence
ttgaggccaaggagcgca

SEQ ID NO: 8602 - DNA, 18 bp, Artificial sequence
  synthetic polynucleotide sequence
ggggcttgaagctgagga

SEQ ID NO: 8603 - DNA, 18 bp, Artificial sequence
  synthetic polynucleotide sequence
atgaagggcctccccgaa

SEQ ID NO: 8604 - DNA, 18 bp, Artificial sequence
  synthetic polynucleotide sequence
cgaagtagggatgggcca

SEQ ID NO: 8605 - DNA, 18 bp, Artificial sequence
  synthetic polynucleotide sequence
gctggcgcgacatgcaga

SEQ ID NO: 8606 - DNA, 18 bp, Artificial sequence
  synthetic polynucleotide sequence
agtgcatccagctgagga

SEQ ID NO: 8607 - DNA, 18 bp, Artificial sequence
  synthetic polynucleotide sequence
actggctcggcacacaga

SEQ ID NO: 8608 - DNA, 18 bp, Artificial sequence
  synthetic polynucleotide sequence
cagtcaacagctcggcca

SEQ ID NO: 8609 - DNA, 18 bp, Artificial sequence
  synthetic polynucleotide sequence
cggatcacagtggaggaa

SEQ ID NO: 8610 - DNA, 18 bp, Artificial sequence
  synthetic polynucleotide sequence
gctccatggcgaaggtga

SEQ ID NO: 8611 - DNA, 16 bp, Artificial sequence
  synthetic polynucleotide sequence
agcgacctgcaccaga

SEQ ID NO: 8612 - DNA, 14 bp, Artificial sequence
  synthetic polynucleotide sequence
caggccacgagcca

SEQ ID NO: 8613 - DNA, 18 bp, Artificial sequence
  synthetic polynucleotide sequence
cagaagctccaccaccaa

SEQ ID NO: 8614 - DNA, 18 bp, Artificial sequence
  synthetic polynucleotide sequence
gacgacgatgatgatgga

SEQ ID NO: 8615 - DNA, 18 bp, Artificial sequence
  synthetic polynucleotide sequence
gcacgtcatccagcccaa

SEQ ID NO: 8616 - DNA, 18 bp, Artificial sequence
  synthetic polynucleotide sequence
agtccaggcggatggaca

SEQ ID NO: 8617 - DNA, 18 bp, Artificial sequence
  synthetic polynucleotide sequence
gaagcagagcgagcccaa

SEQ ID NO: 8618 - DNA, 18 bp, Artificial sequence
  synthetic polynucleotide sequence
gttctcgcggaccaggca

SEQ ID NO: 8619 - DNA, 18 bp, Artificial sequence
  synthetic polynucleotide sequence
ccaaaaggcccaacgcca

SEQ ID NO: 8620 - DNA, 18 bp, Artificial sequence
  synthetic polynucleotide sequence
ggggatacccacacagca

SEQ ID NO: 8621 - DNA, 18 bp, Artificial sequence
  synthetic polynucleotide sequence
cacagaccccactccaca

SEQ ID NO: 8622 - DNA, 18 bp, Artificial sequence
  synthetic polynucleotide sequence
cgcatagtggccaaggca

SEQ ID NO: 8623 - DNA, 18 bp, Artificial sequence
  synthetic polynucleotide sequence
tgagcagccgagaggcaa

SEQ ID NO: 8624 - DNA, 18 bp, Artificial sequence
  synthetic polynucleotide sequence
gtcagggttgagacggca

SEQ ID NO: 8625 - DNA, 18 bp, Artificial sequence
  synthetic polynucleotide sequence
actcaacgtcagtgacca

SEQ ID NO: 8626 - DNA, 18 bp, Artificial sequence
  synthetic polynucleotide sequence
ttcaaggcaatggagcca

SEQ ID NO: 8627 - DNA, 18 bp, Artificial sequence
  synthetic polynucleotide sequence
gcgagaacgccaaagcca

SEQ ID NO: 8628 - DNA, 18 bp, Artificial sequence
  synthetic polynucleotide sequence
gctggggcgagtctacca

SEQ ID NO: 8629 - DNA, 18 bp, Artificial sequence
  synthetic polynucleotide sequence
cagaagggagaccaggga

SEQ ID NO: 8630 - DNA, 18 bp, Artificial sequence
  synthetic polynucleotide sequence
gtaacccagcatgcggca

SEQ ID NO: 8631 - DNA, 18 bp, Artificial sequence
  synthetic polynucleotide sequence
gaacagctgccagagcga

SEQ ID NO: 8632 - DNA, 18 bp, Artificial sequence
  synthetic polynucleotide sequence
tcgaaccccgttgagaga

SEQ ID NO: 8633 - DNA, 18 bp, Artificial sequence
  synthetic polynucleotide sequence
tagtgcagccaccccaga

SEQ ID NO: 8634 - DNA, 18 bp, Artificial sequence
  synthetic polynucleotide sequence
ggagaggcaggagggcca

SEQ ID NO: 8635 - DNA, 18 bp, Artificial sequence
  synthetic polynucleotide sequence
cagccacagcaaagggca

SEQ ID NO: 8636 - DNA, 18 bp, Artificial sequence
  synthetic polynucleotide sequence
tgcaggggatgggccaca

SEQ ID NO: 8637 - DNA, 18 bp, Artificial sequence
  synthetic polynucleotide sequence
catggcagtgggacagca

SEQ ID NO: 8638 - DNA, 18 bp, Artificial sequence
  synthetic polynucleotide sequence
taagaaccccactgccga

SEQ ID NO: 8639 - DNA, 18 bp, Artificial sequence
  synthetic polynucleotide sequence
gagctgttggagagccca

SEQ ID NO: 8640 - DNA, 18 bp, Artificial sequence
  synthetic polynucleotide sequence
agccgctgacgatgacca

SEQ ID NO: 8641 - DNA, 18 bp, Artificial sequence
  synthetic polynucleotide sequence
tgcagaggtgacagcgga

SEQ ID NO: 8642 - DNA, 18 bp, Artificial sequence
  synthetic polynucleotide sequence
tcatggaaccccaggaca

SEQ ID NO: 8643 - DNA, 18 bp, Artificial sequence
  synthetic polynucleotide sequence
ccccacctagagtcggaa

SEQ ID NO: 8644 - DNA, 18 bp, Artificial sequence
  synthetic polynucleotide sequence
gcggagagcaggaagaga

SEQ ID NO: 8645 - DNA, 18 bp, Artificial sequence
  synthetic polynucleotide sequence
tcaaaggccgagaccgga

SEQ ID NO: 8646 - DNA, 18 bp, Artificial sequence
  synthetic polynucleotide sequence
atccaggaggcctgagca

SEQ ID NO: 8647 - DNA, 18 bp, Artificial sequence
  synthetic polynucleotide sequence
ctcccaccggttcagcaa

SEQ ID NO: 8648 - DNA, 18 bp, Artificial sequence
  synthetic polynucleotide sequence
ctcagccggatgtcagca

SEQ ID NO: 8649 - DNA, 18 bp, Artificial sequence
  synthetic polynucleotide sequence
agccctgactgggaggta

SEQ ID NO: 8650 - DNA, 18 bp, Artificial sequence
  synthetic polynucleotide sequence
catgcgcacgaggttgga

SEQ ID NO: 8651 - DNA, 18 bp, Artificial sequence
  synthetic polynucleotide sequence
tctaccacctacagccaa

SEQ ID NO: 8652 - DNA, 18 bp, Artificial sequence
  synthetic polynucleotide sequence
tttgccacccaacgagca

SEQ ID NO: 8653 - DNA, 18 bp, Artificial sequence
  synthetic polynucleotide sequence
gggtcgcttccacaccaa

SEQ ID NO: 8654 - DNA, 18 bp, Artificial sequence
  synthetic polynucleotide sequence
gcctagccccactggaca

SEQ ID NO: 8655 - DNA, 18 bp, Artificial sequence
  synthetic polynucleotide sequence
ggctggccctgaaacaca

SEQ ID NO: 8656 - DNA, 18 bp, Artificial sequence
  synthetic polynucleotide sequence
cgtccgtcggtgaacaca

SEQ ID NO: 8657 - DNA, 18 bp, Artificial sequence
  synthetic polynucleotide sequence
cccatgggtgtcagcaca

SEQ ID NO: 8658 - DNA, 18 bp, Artificial sequence
  synthetic polynucleotide sequence
ggccccatcactcacaca

SEQ ID NO: 8659 - DNA, 18 bp, Artificial sequence
  synthetic polynucleotide sequence
gagctgtcaggtccggga

SEQ ID NO: 8660 - DNA, 18 bp, Artificial sequence
  synthetic polynucleotide sequence
cgcacgctcttggagcca

SEQ ID NO: 8661 - DNA, 18 bp, Artificial sequence
  synthetic polynucleotide sequence
cgggagccaccatacaga

SEQ ID NO: 8662 - DNA, 18 bp, Artificial sequence
  synthetic polynucleotide sequence
gggttgagactaggacca

SEQ ID NO: 8663 - DNA, 18 bp, Artificial sequence
  synthetic polynucleotide sequence
cgaccggaagttccagga

SEQ ID NO: 8664 - DNA, 18 bp, Artificial sequence
  synthetic polynucleotide sequence
gccggtacagcaccacca

SEQ ID NO: 8665 - DNA, 18 bp, Artificial sequence
  synthetic polynucleotide sequence
ggctgacaaacgggctca

SEQ ID NO: 8666 - DNA, 18 bp, Artificial sequence
  synthetic polynucleotide sequence
atgggactgagtcccgca

SEQ ID NO: 8667 - DNA, 18 bp, Artificial sequence
  synthetic polynucleotide sequence
cagccagggtcctcacca

SEQ ID NO: 8668 - DNA, 18 bp, Artificial sequence
  synthetic polynucleotide sequence
gctgagagctcacaggca

SEQ ID NO: 8669 - DNA, 18 bp, Artificial sequence
  synthetic polynucleotide sequence
ccccgtgaagtacctgga

SEQ ID NO: 8670 - DNA, 18 bp, Artificial sequence
  synthetic polynucleotide sequence
gccccctgggcatcagca

SEQ ID NO: 8671 - DNA, 18 bp, Artificial sequence
  synthetic polynucleotide sequence
cccatcacagtccccaga

SEQ ID NO: 8672 - DNA, 18 bp, Artificial sequence
  synthetic polynucleotide sequence
ctgaccagacactgggca

SEQ ID NO: 8673 - DNA, 18 bp, Artificial sequence
  synthetic polynucleotide sequence
gaagagcgagtacagcaa

SEQ ID NO: 8674 - DNA, 18 bp, Artificial sequence
  synthetic polynucleotide sequence
tatcagcagctcgcgaca

SEQ ID NO: 8675 - DNA, 18 bp, Artificial sequence
  synthetic polynucleotide sequence
ccgacgaggacatcagga

SEQ ID NO: 8676 - DNA, 18 bp, Artificial sequence
  synthetic polynucleotide sequence
cctccccgtcacgggcca

SEQ ID NO: 8677 - DNA, 18 bp, Artificial sequence
  synthetic polynucleotide sequence
ccatcccacgaacacaga

SEQ ID NO: 8678 - DNA, 18 bp, Artificial sequence
  synthetic polynucleotide sequence
agcgatgagaagcttcca

SEQ ID NO: 8679 - DNA, 18 bp, Artificial sequence
  synthetic polynucleotide sequence
ccagccttcagcaggaga

SEQ ID NO: 8680 - DNA, 18 bp, Artificial sequence
  synthetic polynucleotide sequence
ccttggaacgcctggaga

SEQ ID NO: 8681 - DNA, 18 bp, Artificial sequence
  synthetic polynucleotide sequence
ccagtgtcaccacggcaa

SEQ ID NO: 8682 - DNA, 18 bp, Artificial sequence
  synthetic polynucleotide sequence
cccaactggccagagaga

SEQ ID NO: 8683 - DNA, 18 bp, Artificial sequence
  synthetic polynucleotide sequence
gaacgagggtgaacccaa

SEQ ID NO: 8684 - DNA, 18 bp, Artificial sequence
  synthetic polynucleotide sequence
ggaactcacagacggcca

SEQ ID NO: 8685 - DNA, 18 bp, Artificial sequence
  synthetic polynucleotide sequence
accaacggtgccaccgca

SEQ ID NO: 8686 - DNA, 18 bp, Artificial sequence
  synthetic polynucleotide sequence
gggaacacttgtggcaga

SEQ ID NO: 8687 - DNA, 18 bp, Artificial sequence
  synthetic polynucleotide sequence
gggatcctggcaggccca

SEQ ID NO: 8688 - DNA, 18 bp, Artificial sequence
  synthetic polynucleotide sequence
taacaaggacagcccaca

SEQ ID NO: 8689 - DNA, 18 bp, Artificial sequence
  synthetic polynucleotide sequence
cctgccccagaagtcaca

SEQ ID NO: 8690 - DNA, 18 bp, Artificial sequence
  synthetic polynucleotide sequence
ggtgtgcgaggcgtcaca

SEQ ID NO: 8691 - DNA, 18 bp, Artificial sequence
  synthetic polynucleotide sequence
tgccatatgcacagccca

SEQ ID NO: 8692 - DNA, 18 bp, Artificial sequence
  synthetic polynucleotide sequence
ggaatccgtcagctagca

SEQ ID NO: 8693 - DNA, 18 bp, Artificial sequence
  synthetic polynucleotide sequence
tggccgctacaaccagga

SEQ ID NO: 8694 - DNA, 18 bp, Artificial sequence
  synthetic polynucleotide sequence
agaaggccaggaccacca

SEQ ID NO: 8695 - DNA, 18 bp, Artificial sequence
  synthetic polynucleotide sequence
gggccatcacactgacca

SEQ ID NO: 8696 - DNA, 18 bp, Artificial sequence
  synthetic polynucleotide sequence
tctgggctccggaaggca

SEQ ID NO: 8697 - DNA, 18 bp, Artificial sequence
  synthetic polynucleotide sequence
gcatcatgaccgtgagga

SEQ ID NO: 8698 - DNA, 18 bp, Artificial sequence
  synthetic polynucleotide sequence
agagggtgcccatgagga

SEQ ID NO: 8699 - DNA, 18 bp, Artificial sequence
  synthetic polynucleotide sequence
acgtcaacggcacggcaa

SEQ ID NO: 8700 - DNA, 18 bp, Artificial sequence
  synthetic polynucleotide sequence
ccagctccaggaagagga

SEQ ID NO: 8701 - DNA, 18 bp, Artificial sequence
  synthetic polynucleotide sequence
gtacggcaaggagacgaa

SEQ ID NO: 8702 - DNA, 18 bp, Artificial sequence
  synthetic polynucleotide sequence
gtcaatgccgcctggcga

SEQ ID NO: 8703 - DNA, 18 bp, Artificial sequence
  synthetic polynucleotide sequence
ggccacgataacaaagga

SEQ ID NO: 8704 - DNA, 18 bp, Artificial sequence
  synthetic polynucleotide sequence
aactgagacccaagacca

SEQ ID NO: 8705 - DNA, 18 bp, Artificial sequence
  synthetic polynucleotide sequence
agatgacgtcccctccca

SEQ ID NO: 8706 - DNA, 18 bp, Artificial sequence
  synthetic polynucleotide sequence
gggcctggtacagctcca

SEQ ID NO: 8707 - DNA, 18 bp, Artificial sequence
  synthetic polynucleotide sequence
ccagacttcaagctccca

SEQ ID NO: 8708 - DNA, 18 bp, Artificial sequence
  synthetic polynucleotide sequence
tccacacagaacctgtca

SEQ ID NO: 8709 - DNA, 18 bp, Artificial sequence
  synthetic polynucleotide sequence
cggagatcgcaaggagga

SEQ ID NO: 8710 - DNA, 18 bp, Artificial sequence
  synthetic polynucleotide sequence
ccacaggttgtgaggcca

SEQ ID NO: 8711 - DNA, 18 bp, Artificial sequence
  synthetic polynucleotide sequence
gggagtgaacaggcacca

SEQ ID NO: 8712 - DNA, 19 bp, Artificial sequence
  synthetic polynucleotide sequence
ataaccaggagatggccaa

SEQ ID NO: 8713 - DNA, 18 bp, Artificial sequence
  synthetic polynucleotide sequence
cagccgcatacgtgagga

SEQ ID NO: 8714 - DNA, 18 bp, Artificial sequence
  synthetic polynucleotide sequence
agtagggtgcccagcaca

SEQ ID NO: 8715 - DNA, 18 bp, Artificial sequence
  synthetic polynucleotide sequence
ggatgccagatgctgcaa

SEQ ID NO: 8716 - DNA, 18 bp, Artificial sequence
  synthetic polynucleotide sequence
acatgataaggggcagca

SEQ ID NO: 8717 - DNA, 18 bp, Artificial sequence
  synthetic polynucleotide sequence
accttcgggagcaggcca

SEQ ID NO: 8718 - DNA, 18 bp, Artificial sequence
  synthetic polynucleotide sequence
catccccaacccgtcgta

SEQ ID NO: 8719 - DNA, 16 bp, Artificial sequence
  synthetic polynucleotide sequence
gcggatctgcagtcca

SEQ ID NO: 8720 - DNA, 19 bp, Artificial sequence
  synthetic polynucleotide sequence
tgaagctgcatacgaggca

SEQ ID NO: 8721 - DNA, 18 bp, Artificial sequence
  synthetic polynucleotide sequence
ccattacggtgcggcaca

SEQ ID NO: 8722 - DNA, 18 bp, Artificial sequence
  synthetic polynucleotide sequence
tctccagcatcacgcgga

SEQ ID NO: 8723 - DNA, 18 bp, Artificial sequence
  synthetic polynucleotide sequence
tcgccagccagatgccaa

SEQ ID NO: 8724 - DNA, 18 bp, Artificial sequence
  synthetic polynucleotide sequence
acacatccaagagggcca

SEQ ID NO: 8725 - DNA, 18 bp, Artificial sequence
  synthetic polynucleotide sequence
ggacgccgttgagaagga

SEQ ID NO: 8726 - DNA, 18 bp, Artificial sequence
  synthetic polynucleotide sequence
gtcaagggaatgggggca

SEQ ID NO: 8727 - DNA, 18 bp, Artificial sequence
  synthetic polynucleotide sequence
ccgcttagcagaagccca

SEQ ID NO: 8728 - DNA, 18 bp, Artificial sequence
  synthetic polynucleotide sequence
acgatgccagtccgggga

SEQ ID NO: 8729 - DNA, 18 bp, Artificial sequence
  synthetic polynucleotide sequence
cttcgccacagaggcaga

SEQ ID NO: 8730 - DNA, 18 bp, Artificial sequence
  synthetic polynucleotide sequence
ccctgacagggtaccgga

SEQ ID NO: 8731 - DNA, 18 bp, Artificial sequence
  synthetic polynucleotide sequence
tgcgacagcttgagagca

SEQ ID NO: 8732 - DNA, 18 bp, Artificial sequence
  synthetic polynucleotide sequence
atcccgttcacaggagca

SEQ ID NO: 8733 - DNA, 18 bp, Artificial sequence
  synthetic polynucleotide sequence
cgtggagatgaggcgaga

SEQ ID NO: 8734 - DNA, 18 bp, Artificial sequence
  synthetic polynucleotide sequence
ctcagacgtgccagagca

SEQ ID NO: 8735 - DNA, 18 bp, Artificial sequence
  synthetic polynucleotide sequence
gctacaggcagcgtgcaa

SEQ ID NO: 8736 - DNA, 18 bp, Artificial sequence
  synthetic polynucleotide sequence
tcaccaagtaccagggca

SEQ ID NO: 8737 - DNA, 18 bp, Artificial sequence
  synthetic polynucleotide sequence
gtcacctctgagcccaca

SEQ ID NO: 8738 - DNA, 18 bp, Artificial sequence
  synthetic polynucleotide sequence
tcaagggctgtgggcaca

SEQ ID NO: 8739 - DNA, 18 bp, Artificial sequence
  synthetic polynucleotide sequence
gtcctgggacaagcgtca

SEQ ID NO: 8740 - DNA, 18 bp, Artificial sequence
  synthetic polynucleotide sequence
ccatgatgccacagtcca

SEQ ID NO: 8741 - DNA, 18 bp, Artificial sequence
  synthetic polynucleotide sequence
gcagtggactcagaggga

SEQ ID NO: 8742 - DNA, 18 bp, Artificial sequence
  synthetic polynucleotide sequence
cgggaggccatgtcacca

SEQ ID NO: 8743 - DNA, 18 bp, Artificial sequence
  synthetic polynucleotide sequence
cggcaaggacaggatcga

SEQ ID NO: 8744 - DNA, 18 bp, Artificial sequence
  synthetic polynucleotide sequence
ttgcccaagcgccactca

SEQ ID NO: 8745 - DNA, 18 bp, Artificial sequence
  synthetic polynucleotide sequence
cagatgtcaaccatgcca

SEQ ID NO: 8746 - DNA, 18 bp, Artificial sequence
  synthetic polynucleotide sequence
agcagacatggcactgga

SEQ ID NO: 8747 - DNA, 18 bp, Artificial sequence
  synthetic polynucleotide sequence
ctctcagtgcacccccaa

SEQ ID NO: 8748 - DNA, 18 bp, Artificial sequence
  synthetic polynucleotide sequence
cggcatacgccatggaga

SEQ ID NO: 8749 - DNA, 18 bp, Artificial sequence
  synthetic polynucleotide sequence
cacccccagcagcaagga

SEQ ID NO: 8750 - DNA, 18 bp, Artificial sequence
  synthetic polynucleotide sequence
cccatcacacgcacccca

SEQ ID NO: 8751 - DNA, 18 bp, Artificial sequence
  synthetic polynucleotide sequence
tcaggcaggggagagtga

SEQ ID NO: 8752 - DNA, 18 bp, Artificial sequence
  synthetic polynucleotide sequence
attctcacgaagggccca

SEQ ID NO: 8753 - DNA, 18 bp, Artificial sequence
  synthetic polynucleotide sequence
agccactgctactacaga

SEQ ID NO: 8754 - DNA, 18 bp, Artificial sequence
  synthetic polynucleotide sequence
aggtaggcagtgtgggga

SEQ ID NO: 8755 - DNA, 18 bp, Artificial sequence
  synthetic polynucleotide sequence
cgtccgactgtacccaga

SEQ ID NO: 8756 - DNA, 18 bp, Artificial sequence
  synthetic polynucleotide sequence
aagcagccgcaccgggca

SEQ ID NO: 8757 - DNA, 18 bp, Artificial sequence
  synthetic polynucleotide sequence
gagaggctgccctaggga

SEQ ID NO: 8758 - DNA, 18 bp, Artificial sequence
  synthetic polynucleotide sequence
tctgagaatgcaccacca

SEQ ID NO: 8759 - DNA, 18 bp, Artificial sequence
  synthetic polynucleotide sequence
actcagccccagagagca

SEQ ID NO: 8760 - DNA, 18 bp, Artificial sequence
  synthetic polynucleotide sequence
agacggccagcacctgca

SEQ ID NO: 8761 - DNA, 18 bp, Artificial sequence
  synthetic polynucleotide sequence
ggagagcagccttacaga

SEQ ID NO: 8762 - DNA, 18 bp, Artificial sequence
  synthetic polynucleotide sequence
cagttcagaatgaggcga

SEQ ID NO: 8763 - DNA, 18 bp, Artificial sequence
  synthetic polynucleotide sequence
aggagaccgtactcccca

SEQ ID NO: 8764 - DNA, 18 bp, Artificial sequence
  synthetic polynucleotide sequence
tctcaccgagggtggaca

SEQ ID NO: 8765 - DNA, 18 bp, Artificial sequence
  synthetic polynucleotide sequence
gtgttgccacaccaccca

SEQ ID NO: 8766 - DNA, 18 bp, Artificial sequence
  synthetic polynucleotide sequence
ccctgaggtggaagcaga

SEQ ID NO: 8767 - DNA, 18 bp, Artificial sequence
  synthetic polynucleotide sequence
ggagaagagacaggcgga

SEQ ID NO: 8768 - DNA, 18 bp, Artificial sequence
  synthetic polynucleotide sequence
atgggagcactgggagca

SEQ ID NO: 8769 - DNA, 18 bp, Artificial sequence
  synthetic polynucleotide sequence
ggctgcagcaagcacaga

SEQ ID NO: 8770 - DNA, 18 bp, Artificial sequence
  synthetic polynucleotide sequence
agctgggagacaggacca

SEQ ID NO: 8771 - DNA, 18 bp, Artificial sequence
  synthetic polynucleotide sequence
gggagtggtgcataggga

SEQ ID NO: 8772 - DNA, 18 bp, Artificial sequence
  synthetic polynucleotide sequence
ctccatggcaaccaggca

SEQ ID NO: 8773 - DNA, 18 bp, Artificial sequence
  synthetic polynucleotide sequence
ggagcaggagctacagga

SEQ ID NO: 8774 - DNA, 18 bp, Artificial sequence
  synthetic polynucleotide sequence
caccacttggggaggcca

SEQ ID NO: 8775 - DNA, 18 bp, Artificial sequence
  synthetic polynucleotide sequence
gggcagagaagcaaggaa

SEQ ID NO: 8776 - DNA, 18 bp, Artificial sequence
  synthetic polynucleotide sequence
gcaataaggcaagggcca

SEQ ID NO: 8777 - DNA, 18 bp, Artificial sequence
  synthetic polynucleotide sequence
agcttacgggaggctgga

SEQ ID NO: 8778 - DNA, 18 bp, Artificial sequence
  synthetic polynucleotide sequence
agggccaccagcatggga

SEQ ID NO: 8779 - DNA, 18 bp, Artificial sequence
  synthetic polynucleotide sequence
tcagcagggggtcagcaa

SEQ ID NO: 8780 - DNA, 18 bp, Artificial sequence
  synthetic polynucleotide sequence
actacgcatggccaggca

SEQ ID NO: 8781 - DNA, 18 bp, Artificial sequence
  synthetic polynucleotide sequence
agacgcggaaggagcaca

SEQ ID NO: 8782 - DNA, 18 bp, Artificial sequence
  synthetic polynucleotide sequence
ggaactgagggcacacca

SEQ ID NO: 8783 - DNA, 18 bp, Artificial sequence
  synthetic polynucleotide sequence
agagcagtgatggaccca

SEQ ID NO: 8784 - DNA, 18 bp, Artificial sequence
  synthetic polynucleotide sequence
gggtaggggaggctgtca

SEQ ID NO: 8785 - DNA, 18 bp, Artificial sequence
  synthetic polynucleotide sequence
agcaagacaccaccccca

SEQ ID NO: 8786 - DNA, 18 bp, Artificial sequence
  synthetic polynucleotide sequence
ctccggggaggaagggga

SEQ ID NO: 8787 - DNA, 18 bp, Artificial sequence
  synthetic polynucleotide sequence
accaccaccccttcgaga

SEQ ID NO: 8788 - DNA, 18 bp, Artificial sequence
  synthetic polynucleotide sequence
gtccaatgggggagtgga

SEQ ID NO: 8789 - DNA, 18 bp, Artificial sequence
  synthetic polynucleotide sequence
cagaaccggtgtccccaa

SEQ ID NO: 8790 - DNA, 18 bp, Artificial sequence
  synthetic polynucleotide sequence
gctgggctgctgagacca

SEQ ID NO: 8791 - DNA, 18 bp, Artificial sequence
  synthetic polynucleotide sequence
ggaggtggaggttggaga

SEQ ID NO: 8792 - DNA, 18 bp, Artificial sequence
  synthetic polynucleotide sequence
atcaccacccagtagcca

SEQ ID NO: 8793 - DNA, 18 bp, Artificial sequence
  synthetic polynucleotide sequence
tgcacctgtgccccagga

SEQ ID NO: 8794 - DNA, 18 bp, Artificial sequence
  synthetic polynucleotide sequence
ccatgtgccactgggaca

SEQ ID NO: 8795 - DNA, 18 bp, Artificial sequence
  synthetic polynucleotide sequence
cgggcaacactgtgagca

SEQ ID NO: 8796 - DNA, 18 bp, Artificial sequence
  synthetic polynucleotide sequence
tgcctgtgacagcaccca

SEQ ID NO: 8797 - DNA, 18 bp, Artificial sequence
  synthetic polynucleotide sequence
tggagcagcctgtgacca

SEQ ID NO: 8798 - DNA, 18 bp, Artificial sequence
  synthetic polynucleotide sequence
caggagccattcacggca

SEQ ID NO: 8799 - DNA, 18 bp, Artificial sequence
  synthetic polynucleotide sequence
tgccagccaccaaggaca

SEQ ID NO: 8800 - DNA, 18 bp, Artificial sequence
  synthetic polynucleotide sequence
aagcaaggcctccaggca

SEQ ID NO: 8801 - DNA, 18 bp, Artificial sequence
  synthetic polynucleotide sequence
gtagcttcccccagcaca

SEQ ID NO: 8802 - DNA, 18 bp, Artificial sequence
  synthetic polynucleotide sequence
ggaacagccacgccctca

SEQ ID NO: 8803 - DNA, 18 bp, Artificial sequence
  synthetic polynucleotide sequence
cgcggtcttcgccaagca

SEQ ID NO: 8804 - DNA, 18 bp, Artificial sequence
  synthetic polynucleotide sequence
tgacgaggtcgatgggca

SEQ ID NO: 8805 - DNA, 18 bp, Artificial sequence
  synthetic polynucleotide sequence
gacttggaccaggagcga

SEQ ID NO: 8806 - DNA, 18 bp, Artificial sequence
  synthetic polynucleotide sequence
atggggagcccaggccca

SEQ ID NO: 8807 - DNA, 18 bp, Artificial sequence
  synthetic polynucleotide sequence
ctggaagatgtgaccgca

SEQ ID NO: 8808 - DNA, 18 bp, Artificial sequence
  synthetic polynucleotide sequence
gttcggggagtagcagca

SEQ ID NO: 8809 - DNA, 18 bp, Artificial sequence
  synthetic polynucleotide sequence
gggagcaaagccagggca

SEQ ID NO: 8810 - DNA, 18 bp, Artificial sequence
  synthetic polynucleotide sequence
cgtcgtagaatcgcagca

SEQ ID NO: 8811 - DNA, 18 bp, Artificial sequence
  synthetic polynucleotide sequence
tcacccacctcagccaga

SEQ ID NO: 8812 - DNA, 18 bp, Artificial sequence
  synthetic polynucleotide sequence
ggctcaggctgacaggta

SEQ ID NO: 8813 - DNA, 18 bp, Artificial sequence
  synthetic polynucleotide sequence
gctccacccgagacacca

SEQ ID NO: 8814 - DNA, 18 bp, Artificial sequence
  synthetic polynucleotide sequence
caagggtgatgatcagca

SEQ ID NO: 8815 - DNA, 18 bp, Artificial sequence
  synthetic polynucleotide sequence
ctcacaatggcctgagga

SEQ ID NO: 8816 - DNA, 18 bp, Artificial sequence
  synthetic polynucleotide sequence
tcgcagtcactggcccca

SEQ ID NO: 8817 - DNA, 18 bp, Artificial sequence
  synthetic polynucleotide sequence
caggttgaagcagcccga

SEQ ID NO: 8818 - DNA, 18 bp, Artificial sequence
  synthetic polynucleotide sequence
ggttccgaacgtcaggca

SEQ ID NO: 8819 - DNA, 18 bp, Artificial sequence
  synthetic polynucleotide sequence
cgagcctctggcagggca

SEQ ID NO: 8820 - DNA, 18 bp, Artificial sequence
  synthetic polynucleotide sequence
tcccaggcgtagctccca

SEQ ID NO: 8821 - DNA, 18 bp, Artificial sequence
  synthetic polynucleotide sequence
cctgagactcaccgtcca

SEQ ID NO: 8822 - DNA, 18 bp, Artificial sequence
  synthetic polynucleotide sequence
ctgcccacatgtcccaca

SEQ ID NO: 8823 - DNA, 18 bp, Artificial sequence
  synthetic polynucleotide sequence
tggccacgggacaacaca

SEQ ID NO: 8824 - DNA, 18 bp, Artificial sequence
  synthetic polynucleotide sequence
gtgccaccagccatagga

SEQ ID NO: 8825 - DNA, 18 bp, Artificial sequence
  synthetic polynucleotide sequence
agtgatgaagtcgggcca

SEQ ID NO: 8826 - DNA, 18 bp, Artificial sequence
  synthetic polynucleotide sequence
gtcaccgcagtccaacca

SEQ ID NO: 8827 - DNA, 18 bp, Artificial sequence
  synthetic polynucleotide sequence
tgaaaggaggggaggcaa

SEQ ID NO: 8828 - DNA, 18 bp, Artificial sequence
  synthetic polynucleotide sequence
atccagccatctgcggca

SEQ ID NO: 8829 - DNA, 18 bp, Artificial sequence
  synthetic polynucleotide sequence
cgtgtcctccgccagaca

SEQ ID NO: 8830 - DNA, 18 bp, Artificial sequence
  synthetic polynucleotide sequence
cctcgtaggcacggcgga

SEQ ID NO: 8831 - DNA, 18 bp, Artificial sequence
  synthetic polynucleotide sequence
cgaggctccatccagcaa

SEQ ID NO: 8832 - DNA, 18 bp, Artificial sequence
  synthetic polynucleotide sequence
gcacgccacactccagca

SEQ ID NO: 8833 - DNA, 18 bp, Artificial sequence
  synthetic polynucleotide sequence
ccctggcagcaaagacca

SEQ ID NO: 8834 - DNA, 18 bp, Artificial sequence
  synthetic polynucleotide sequence
ggtgggtcagccatcaca

SEQ ID NO: 8835 - DNA, 18 bp, Artificial sequence
  synthetic polynucleotide sequence
tcacctgcctagacccaa

SEQ ID NO: 8836 - DNA, 18 bp, Artificial sequence
  synthetic polynucleotide sequence
tccggacctcctgcagga

SEQ ID NO: 8837 - DNA, 18 bp, Artificial sequence
  synthetic polynucleotide sequence
gactggaaaacccacaga

SEQ ID NO: 8838 - DNA, 18 bp, Artificial sequence
  synthetic polynucleotide sequence
gctgatcacagcggtcca

SEQ ID NO: 8839 - DNA, 18 bp, Artificial sequence
  synthetic polynucleotide sequence
cgcagaggaagtcagcca

SEQ ID NO: 8840 - DNA, 18 bp, Artificial sequence
  synthetic polynucleotide sequence
gagctagaggtggaacca

SEQ ID NO: 8841 - DNA, 18 bp, Artificial sequence
  synthetic polynucleotide sequence
aagtcatcccagccccaa

SEQ ID NO: 8842 - DNA, 18 bp, Artificial sequence
  synthetic polynucleotide sequence
gacagaggtcagctcgga

SEQ ID NO: 8843 - DNA, 18 bp, Artificial sequence
  synthetic polynucleotide sequence
ctggatggcagaagcaga

SEQ ID NO: 8844 - DNA, 18 bp, Artificial sequence
  synthetic polynucleotide sequence
gtgacagagtaggaggca

SEQ ID NO: 8845 - DNA, 18 bp, Artificial sequence
  synthetic polynucleotide sequence
tgaccaagagggtggaca

SEQ ID NO: 8846 - DNA, 18 bp, Artificial sequence
  synthetic polynucleotide sequence
agctcggtggacgtgaca

SEQ ID NO: 8847 - DNA, 18 bp, Artificial sequence
  synthetic polynucleotide sequence
ggtcagcgcagaggagga

SEQ ID NO: 8848 - DNA, 18 bp, Artificial sequence
  synthetic polynucleotide sequence
gtggcagctgcggaacca

SEQ ID NO: 8849 - DNA, 18 bp, Artificial sequence
  synthetic polynucleotide sequence
tcgccagccaaagtagga

SEQ ID NO: 8850 - DNA, 19 bp, Artificial sequence
  synthetic polynucleotide sequence
gcagcaagaaacagcagca

SEQ ID NO: 8851 - DNA, 18 bp, Artificial sequence
  synthetic polynucleotide sequence
gacaggcatcatcaccca

SEQ ID NO: 8852 - DNA, 18 bp, Artificial sequence
  synthetic polynucleotide sequence
gtcccagttgccagggaa

SEQ ID NO: 8853 - DNA, 18 bp, Artificial sequence
  synthetic polynucleotide sequence
gaccaacctagctgggca

SEQ ID NO: 8854 - DNA, 18 bp, Artificial sequence
  synthetic polynucleotide sequence
catccgacctgtgcacca

SEQ ID NO: 8855 - DNA, 18 bp, Artificial sequence
  synthetic polynucleotide sequence
ccactcccgagatccaga

SEQ ID NO: 8856 - DNA, 18 bp, Artificial sequence
  synthetic polynucleotide sequence
ggacttggctgacacgca

SEQ ID NO: 8857 - DNA, 18 bp, Artificial sequence
  synthetic polynucleotide sequence
gaatgagctgcaccgcca

SEQ ID NO: 8858 - DNA, 18 bp, Artificial sequence
  synthetic polynucleotide sequence
tctgactccgcacagaca

SEQ ID NO: 8859 - DNA, 18 bp, Artificial sequence
  synthetic polynucleotide sequence
cagagccacagccccaca

SEQ ID NO: 8860 - DNA, 18 bp, Artificial sequence
  synthetic polynucleotide sequence
agtcatcaggcagccgga

SEQ ID NO: 8861 - DNA, 18 bp, Artificial sequence
  synthetic polynucleotide sequence
cccaggcagcaagtgcaa

SEQ ID NO: 8862 - DNA, 18 bp, Artificial sequence
  synthetic polynucleotide sequence
atgccaccattggccaca

SEQ ID NO: 8863 - DNA, 18 bp, Artificial sequence
  synthetic polynucleotide sequence
ccccctgagctgaggaca

SEQ ID NO: 8864 - DNA, 18 bp, Artificial sequence
  synthetic polynucleotide sequence
ggatcaccaagcaggcca

SEQ ID NO: 8865 - DNA, 18 bp, Artificial sequence
  synthetic polynucleotide sequence
gctcactggggaccacga

SEQ ID NO: 8866 - DNA, 18 bp, Artificial sequence
  synthetic polynucleotide sequence
ccactcccaggagggtga

SEQ ID NO: 8867 - DNA, 18 bp, Artificial sequence
  synthetic polynucleotide sequence
gaggcaagggaggaggaa

SEQ ID NO: 8868 - DNA, 18 bp, Artificial sequence
  synthetic polynucleotide sequence
tgacagaaggcgtgggga

SEQ ID NO: 8869 - DNA, 18 bp, Artificial sequence
  synthetic polynucleotide sequence
gtcatcacccgctccaca

SEQ ID NO: 8870 - DNA, 18 bp, Artificial sequence
  synthetic polynucleotide sequence
cccagctgcatccagcga

SEQ ID NO: 8871 - DNA, 18 bp, Artificial sequence
  synthetic polynucleotide sequence
ccgcaagggtgtgagcca

SEQ ID NO: 8872 - DNA, 18 bp, Artificial sequence
  synthetic polynucleotide sequence
acctgcagctggggagca

SEQ ID NO: 8873 - DNA, 18 bp, Artificial sequence
  synthetic polynucleotide sequence
gcagcaagagtgccctga

SEQ ID NO: 8874 - DNA, 18 bp, Artificial sequence
  synthetic polynucleotide sequence
gggtcaaggctagaccca

SEQ ID NO: 8875 - DNA, 18 bp, Artificial sequence
  synthetic polynucleotide sequence
ctacgatggctggaccga

SEQ ID NO: 8876 - DNA, 18 bp, Artificial sequence
  synthetic polynucleotide sequence
catacactgcctgcagca

SEQ ID NO: 8877 - DNA, 18 bp, Artificial sequence
  synthetic polynucleotide sequence
ggcaacggaagaacagga

SEQ ID NO: 8878 - DNA, 18 bp, Artificial sequence
  synthetic polynucleotide sequence
aggttggctacaacacca

SEQ ID NO: 8879 - DNA, 18 bp, Artificial sequence
  synthetic polynucleotide sequence
gaacatcgagcacccgga

SEQ ID NO: 8880 - DNA, 18 bp, Artificial sequence
  synthetic polynucleotide sequence
tctggatcgagaggcgca

SEQ ID NO: 8881 - DNA, 18 bp, Artificial sequence
  synthetic polynucleotide sequence
tccctcataccccagaca

SEQ ID NO: 8882 - DNA, 18 bp, Artificial sequence
  synthetic polynucleotide sequence
ggtcccgtccactgagga

SEQ ID NO: 8883 - DNA, 18 bp, Artificial sequence
  synthetic polynucleotide sequence
gcggtcacgagcagccaa

SEQ ID NO: 8884 - DNA, 18 bp, Artificial sequence
  synthetic polynucleotide sequence
actacgacaccctaacca

SEQ ID NO: 8885 - DNA, 18 bp, Artificial sequence
  synthetic polynucleotide sequence
actccatgggaggcgcca

SEQ ID NO: 8886 - DNA, 18 bp, Artificial sequence
  synthetic polynucleotide sequence
gggacaagtttggcagca

SEQ ID NO: 8887 - DNA, 18 bp, Artificial sequence
  synthetic polynucleotide sequence
cctggcaggcaaccccaa

SEQ ID NO: 8888 - DNA, 18 bp, Artificial sequence
  synthetic polynucleotide sequence
acgggatgaggatgggga

SEQ ID NO: 8889 - DNA, 18 bp, Artificial sequence
  synthetic polynucleotide sequence
tcaggaagcgccgaggga

SEQ ID NO: 8890 - DNA, 17 bp, Artificial sequence
  synthetic polynucleotide sequence
aggggtgcagccagaca

SEQ ID NO: 8891 - DNA, 18 bp, Artificial sequence
  synthetic polynucleotide sequence
acgtgtacgcagagccca

SEQ ID NO: 8892 - DNA, 18 bp, Artificial sequence
  synthetic polynucleotide sequence
gctgtagaggggtcggga

SEQ ID NO: 8893 - DNA, 18 bp, Artificial sequence
  synthetic polynucleotide sequence
agtcactgggtcaccaga

SEQ ID NO: 8894 - DNA, 18 bp, Artificial sequence
  synthetic polynucleotide sequence
caattcccagggcaccta

SEQ ID NO: 8895 - DNA, 18 bp, Artificial sequence
  synthetic polynucleotide sequence
cacgggagaacccagcaa

SEQ ID NO: 8896 - DNA, 18 bp, Artificial sequence
  synthetic polynucleotide sequence
ttgtgcccaccaagccca

SEQ ID NO: 8897 - DNA, 18 bp, Artificial sequence
  synthetic polynucleotide sequence
gctgtgtgcggaccagga

SEQ ID NO: 8898 - DNA, 18 bp, Artificial sequence
  synthetic polynucleotide sequence
cccggtgaatggtcagga

SEQ ID NO: 8899 - DNA, 18 bp, Artificial sequence
  synthetic polynucleotide sequence
gaagaccaagttccagca

SEQ ID NO: 8900 - DNA, 18 bp, Artificial sequence
  synthetic polynucleotide sequence
gactccagacacagctga

SEQ ID NO: 8901 - DNA, 18 bp, Artificial sequence
  synthetic polynucleotide sequence
caggctgtcagctgcaga

SEQ ID NO: 8902 - DNA, 18 bp, Artificial sequence
  synthetic polynucleotide sequence
agcacgagctttgagcca

SEQ ID NO: 8903 - DNA, 18 bp, Artificial sequence
  synthetic polynucleotide sequence
cgaggcctcagagggcaa

SEQ ID NO: 8904 - DNA, 18 bp, Artificial sequence
  synthetic polynucleotide sequence
ttcccatcaggcaggaca

SEQ ID NO: 8905 - DNA, 18 bp, Artificial sequence
  synthetic polynucleotide sequence
ctgacacccccatcccaa

SEQ ID NO: 8906 - DNA, 18 bp, Artificial sequence
  synthetic polynucleotide sequence
cacagaggcgttccagga

SEQ ID NO: 8907 - DNA, 18 bp, Artificial sequence
  synthetic polynucleotide sequence
ggagcagaacggacacca

SEQ ID NO: 8908 - DNA, 18 bp, Artificial sequence
  synthetic polynucleotide sequence
cttcggaccatccaggca

SEQ ID NO: 8909 - DNA, 18 bp, Artificial sequence
  synthetic polynucleotide sequence
gagccacaacacccagca

SEQ ID NO: 8910 - DNA, 18 bp, Artificial sequence
  synthetic polynucleotide sequence
caccagcgccttcccaga

SEQ ID NO: 8911 - DNA, 18 bp, Artificial sequence
  synthetic polynucleotide sequence
tgaacgcttcaccagcca

SEQ ID NO: 8912 - DNA, 18 bp, Artificial sequence
  synthetic polynucleotide sequence
cagagcgcccaggaagca

SEQ ID NO: 8913 - DNA, 18 bp, Artificial sequence
  synthetic polynucleotide sequence
agtccatccgcaacgaca

SEQ ID NO: 8914 - DNA, 18 bp, Artificial sequence
  synthetic polynucleotide sequence
ccaagtggcccaggtcca

SEQ ID NO: 8915 - DNA, 18 bp, Artificial sequence
  synthetic polynucleotide sequence
ataatccgcccacgtcga

SEQ ID NO: 8916 - DNA, 18 bp, Artificial sequence
  synthetic polynucleotide sequence
gggtcccacaggagctga

SEQ ID NO: 8917 - DNA, 18 bp, Artificial sequence
  synthetic polynucleotide sequence
ctccgagctcacccagca

SEQ ID NO: 8918 - DNA, 18 bp, Artificial sequence
  synthetic polynucleotide sequence
caggctgcagagcgcgca

SEQ ID NO: 8919 - DNA, 18 bp, Artificial sequence
  synthetic polynucleotide sequence
ccgaggaaaggatcggca

SEQ ID NO: 8920 - DNA, 18 bp, Artificial sequence
  synthetic polynucleotide sequence
gccccgagatggtatcca

SEQ ID NO: 8921 - DNA, 18 bp, Artificial sequence
  synthetic polynucleotide sequence
acggcaggatatgcgaca

SEQ ID NO: 8922 - DNA, 18 bp, Artificial sequence
  synthetic polynucleotide sequence
aactggtgatgagccgca

SEQ ID NO: 8923 - DNA, 18 bp, Artificial sequence
  synthetic polynucleotide sequence
cctggctgtcgaaaacca

SEQ ID NO: 8924 - DNA, 18 bp, Artificial sequence
  synthetic polynucleotide sequence
ccctgaaccaactaagca

SEQ ID NO: 8925 - DNA, 18 bp, Artificial sequence
  synthetic polynucleotide sequence
cgggatgtatcagcccca

SEQ ID NO: 8926 - DNA, 18 bp, Artificial sequence
  synthetic polynucleotide sequence
gtgccaggggtagaagga

SEQ ID NO: 8927 - DNA, 18 bp, Artificial sequence
  synthetic polynucleotide sequence
gagaacagcaacgcgcaa

SEQ ID NO: 8928 - DNA, 18 bp, Artificial sequence
  synthetic polynucleotide sequence
agagcagagacccgtgga

SEQ ID NO: 8929 - DNA, 18 bp, Artificial sequence
  synthetic polynucleotide sequence
tgctccccacctcagaga

SEQ ID NO: 8930 - DNA, 18 bp, Artificial sequence
  synthetic polynucleotide sequence
taagggagggcttgcaga

SEQ ID NO: 8931 - DNA, 18 bp, Artificial sequence
  synthetic polynucleotide sequence
tcaccgactccacaggga

SEQ ID NO: 8932 - DNA, 18 bp, Artificial sequence
  synthetic polynucleotide sequence
agagccaggctgggacga

SEQ ID NO: 8933 - DNA, 18 bp, Artificial sequence
  synthetic polynucleotide sequence
ggaggtcttcacggacca

SEQ ID NO: 8934 - DNA, 18 bp, Artificial sequence
  synthetic polynucleotide sequence
ccccgcagtgacccacga

SEQ ID NO: 8935 - DNA, 18 bp, Artificial sequence
  synthetic polynucleotide sequence
gagcatccaggagggcaa

SEQ ID NO: 8936 - DNA, 18 bp, Artificial sequence
  synthetic polynucleotide sequence
ctctgcaggaccatggga

SEQ ID NO: 8937 - DNA, 18 bp, Artificial sequence
  synthetic polynucleotide sequence
atggatgctgcccagaga

SEQ ID NO: 8938 - DNA, 18 bp, Artificial sequence
  synthetic polynucleotide sequence
ctccatgcagatcccaca

SEQ ID NO: 8939 - DNA, 18 bp, Artificial sequence
  synthetic polynucleotide sequence
tgcagaccttgcacccca

SEQ ID NO: 8940 - DNA, 18 bp, Artificial sequence
  synthetic polynucleotide sequence
ctccatgcagatgccaca

SEQ ID NO: 8941 - DNA, 18 bp, Artificial sequence
  synthetic polynucleotide sequence
gcatagcacagctcacga

SEQ ID NO: 8942 - DNA, 18 bp, Artificial sequence
  synthetic polynucleotide sequence
tggacacctccccctgga

SEQ ID NO: 8943 - DNA, 18 bp, Artificial sequence
  synthetic polynucleotide sequence
tgaggagtggcaaagtga

SEQ ID NO: 8944 - DNA, 18 bp, Artificial sequence
  synthetic polynucleotide sequence
cgggagccaggattctca

SEQ ID NO: 8945 - DNA, 18 bp, Artificial sequence
  synthetic polynucleotide sequence
tccgggagacacggagga

SEQ ID NO: 8946 - DNA, 18 bp, Artificial sequence
  synthetic polynucleotide sequence
gagcgctggaggatgtga

SEQ ID NO: 8947 - DNA, 18 bp, Artificial sequence
  synthetic polynucleotide sequence
acttccagcaaccccaga

SEQ ID NO: 8948 - DNA, 18 bp, Artificial sequence
  synthetic polynucleotide sequence
gccaaggcccactgagga

SEQ ID NO: 8949 - DNA, 18 bp, Artificial sequence
  synthetic polynucleotide sequence
tccagaccaccggaggca

SEQ ID NO: 8950 - DNA, 18 bp, Artificial sequence
  synthetic polynucleotide sequence
ctggaatggcagctggca

SEQ ID NO: 8951 - DNA, 18 bp, Artificial sequence
  synthetic polynucleotide sequence
gcaggaagtcctacccca

SEQ ID NO: 8952 - DNA, 18 bp, Artificial sequence
  synthetic polynucleotide sequence
ccgctggggtgataagga

SEQ ID NO: 8953 - DNA, 18 bp, Artificial sequence
  synthetic polynucleotide sequence
tctgagcctggggaacca

SEQ ID NO: 8954 - DNA, 18 bp, Artificial sequence
  synthetic polynucleotide sequence
gcatcagctgaggcgaca

SEQ ID NO: 8955 - DNA, 18 bp, Artificial sequence
  synthetic polynucleotide sequence
ggccaaggagcagaagga

SEQ ID NO: 8956 - DNA, 18 bp, Artificial sequence
  synthetic polynucleotide sequence
tcccacaggcctcacaca

SEQ ID NO: 8957 - DNA, 18 bp, Artificial sequence
  synthetic polynucleotide sequence
gggcagaacgagtggaca

SEQ ID NO: 8958 - DNA, 18 bp, Artificial sequence
  synthetic polynucleotide sequence
tgctgaggcaggaggaca

SEQ ID NO: 8959 - DNA, 18 bp, Artificial sequence
  synthetic polynucleotide sequence
ctgaacagcacggcacca

SEQ ID NO: 8960 - DNA, 18 bp, Artificial sequence
  synthetic polynucleotide sequence
gggactacggcagcagca

SEQ ID NO: 8961 - DNA, 18 bp, Artificial sequence
  synthetic polynucleotide sequence
cggccaaggacaagagca

SEQ ID NO: 8962 - DNA, 18 bp, Artificial sequence
  synthetic polynucleotide sequence
tgactgggcagactcgga

SEQ ID NO: 8963 - DNA, 18 bp, Artificial sequence
  synthetic polynucleotide sequence
gctcaacaaggctcagga

SEQ ID NO: 8964 - DNA, 18 bp, Artificial sequence
  synthetic polynucleotide sequence
ggagtctgcataacccca

SEQ ID NO: 8965 - DNA, 18 bp, Artificial sequence
  synthetic polynucleotide sequence
ccaggagaaaaaccctga

SEQ ID NO: 8966 - DNA, 18 bp, Artificial sequence
  synthetic polynucleotide sequence
caagtccagttcgaagga

SEQ ID NO: 8967 - DNA, 18 bp, Artificial sequence
  synthetic polynucleotide sequence
ggagggcttcacccacga

SEQ ID NO: 8968 - DNA, 18 bp, Artificial sequence
  synthetic polynucleotide sequence
cgtgcaagtggaagacga

SEQ ID NO: 8969 - DNA, 18 bp, Artificial sequence
  synthetic polynucleotide sequence
aagcctaccccatcccca

SEQ ID NO: 8970 - DNA, 18 bp, Artificial sequence
  synthetic polynucleotide sequence
ggttctgaggaggagcca

SEQ ID NO: 8971 - DNA, 18 bp, Artificial sequence
  synthetic polynucleotide sequence
ccttactaggggcaggca

SEQ ID NO: 8972 - DNA, 18 bp, Artificial sequence
  synthetic polynucleotide sequence
ggtagagccagccagaga

SEQ ID NO: 8973 - DNA, 18 bp, Artificial sequence
  synthetic polynucleotide sequence
ggcctcagaagtccagca

SEQ ID NO: 8974 - DNA, 18 bp, Artificial sequence
  synthetic polynucleotide sequence
tcccagccactcgaggga

SEQ ID NO: 8975 - DNA, 18 bp, Artificial sequence
  synthetic polynucleotide sequence
gaacccgtacgctgcaca

SEQ ID NO: 8976 - DNA, 18 bp, Artificial sequence
  synthetic polynucleotide sequence
gagagcgggcagagagca

SEQ ID NO: 8977 - DNA, 18 bp, Artificial sequence
  synthetic polynucleotide sequence
catcaactggatggcgga

SEQ ID NO: 8978 - DNA, 18 bp, Artificial sequence
  synthetic polynucleotide sequence
cttggagccgaggtagga

SEQ ID NO: 8979 - DNA, 18 bp, Artificial sequence
  synthetic polynucleotide sequence
ccagtgcacattgcagga

SEQ ID NO: 8980 - DNA, 18 bp, Artificial sequence
  synthetic polynucleotide sequence
gcaggatgaaggccgtga

SEQ ID NO: 8981 - DNA, 18 bp, Artificial sequence
  synthetic polynucleotide sequence
atggccgctacaagccaa

SEQ ID NO: 8982 - DNA, 18 bp, Artificial sequence
  synthetic polynucleotide sequence
aacgatgaagagggcaca

SEQ ID NO: 8983 - DNA, 18 bp, Artificial sequence
  synthetic polynucleotide sequence
aggacacgaaatcaccca

SEQ ID NO: 8984 - DNA, 18 bp, Artificial sequence
  synthetic polynucleotide sequence
acctgccaggtcccagga

SEQ ID NO: 8985 - DNA, 18 bp, Artificial sequence
  synthetic polynucleotide sequence
cccaggtattggagggga

SEQ ID NO: 8986 - DNA, 18 bp, Artificial sequence
  synthetic polynucleotide sequence
gctagctgaacatcacca

SEQ ID NO: 8987 - DNA, 18 bp, Artificial sequence
  synthetic polynucleotide sequence
aggtgatgcgcaagccca

SEQ ID NO: 8988 - DNA, 18 bp, Artificial sequence
  synthetic polynucleotide sequence
cacttcggcatgccagga

SEQ ID NO: 8989 - DNA, 18 bp, Artificial sequence
  synthetic polynucleotide sequence
tctcgccactggcaggga

SEQ ID NO: 8990 - DNA, 18 bp, Artificial sequence
  synthetic polynucleotide sequence
tctcgggaccccagacca

SEQ ID NO: 8991 - DNA, 18 bp, Artificial sequence
  synthetic polynucleotide sequence
agtgatccaaaggccgta

SEQ ID NO: 8992 - DNA, 18 bp, Artificial sequence
  synthetic polynucleotide sequence
tacagggactgaatgcca

SEQ ID NO: 8993 - DNA, 18 bp, Artificial sequence
  synthetic polynucleotide sequence
aggaccctggagcactca

SEQ ID NO: 8994 - DNA, 18 bp, Artificial sequence
  synthetic polynucleotide sequence
catcgtcatcaggaagca

SEQ ID NO: 8995 - DNA, 18 bp, Artificial sequence
  synthetic polynucleotide sequence
ctggctaccccaagcaca

SEQ ID NO: 8996 - DNA, 18 bp, Artificial sequence
  synthetic polynucleotide sequence
cagggatcccttcccaga

SEQ ID NO: 8997 - DNA, 18 bp, Artificial sequence
  synthetic polynucleotide sequence
ggcgcttcaacgaggaga

SEQ ID NO: 8998 - DNA, 18 bp, Artificial sequence
  synthetic polynucleotide sequence
ctttaggggaggcaggga

SEQ ID NO: 8999 - DNA, 18 bp, Artificial sequence
  synthetic polynucleotide sequence
ccaatgaccccactgcca

SEQ ID NO: 9000 - DNA, 18 bp, Artificial sequence
  synthetic polynucleotide sequence
tagagcggtgtgggggca

SEQ ID NO: 9001 - DNA, 18 bp, Artificial sequence
  synthetic polynucleotide sequence
ggcgctacgatgaccaca

SEQ ID NO: 9002 - DNA, 18 bp, Artificial sequence
  synthetic polynucleotide sequence
ccagctcgccatccagca

SEQ ID NO: 9003 - DNA, 18 bp, Artificial sequence
  synthetic polynucleotide sequence
ctggcgcctcaaccagca

SEQ ID NO: 9004 - DNA, 18 bp, Artificial sequence
  synthetic polynucleotide sequence
atgcccgtacctgaggga

SEQ ID NO: 9005 - DNA, 18 bp, Artificial sequence
  synthetic polynucleotide sequence
accccaagccactgacca

SEQ ID NO: 9006 - DNA, 18 bp, Artificial sequence
  synthetic polynucleotide sequence
tgcaggtccacgacggca

SEQ ID NO: 9007 - DNA, 18 bp, Artificial sequence
  synthetic polynucleotide sequence
caggaattcggcccagca

SEQ ID NO: 9008 - DNA, 18 bp, Artificial sequence
  synthetic polynucleotide sequence
cagtgcccctctcagcca

SEQ ID NO: 9009 - DNA, 18 bp, Artificial sequence
  synthetic polynucleotide sequence
cctacaggacgggatcca

SEQ ID NO: 9010 - DNA, 18 bp, Artificial sequence
  synthetic polynucleotide sequence
gatccctcacaggagcca

SEQ ID NO: 9011 - DNA, 18 bp, Artificial sequence
  synthetic polynucleotide sequence
tcaccgtgtggaagggca

SEQ ID NO: 9012 - DNA, 18 bp, Artificial sequence
  synthetic polynucleotide sequence
ggatgcaggggatgacca

SEQ ID NO: 9013 - DNA, 18 bp, Artificial sequence
  synthetic polynucleotide sequence
ggtgttccaggaccggca

SEQ ID NO: 9014 - DNA, 18 bp, Artificial sequence
  synthetic polynucleotide sequence
acgagaacacggcgtcca

SEQ ID NO: 9015 - DNA, 18 bp, Artificial sequence
  synthetic polynucleotide sequence
catccgcagtgaaagaca

SEQ ID NO: 9016 - DNA, 18 bp, Artificial sequence
  synthetic polynucleotide sequence
gcatggcctaagatacca

SEQ ID NO: 9017 - DNA, 18 bp, Artificial sequence
  synthetic polynucleotide sequence
gcaggcacctatggagga

SEQ ID NO: 9018 - DNA, 18 bp, Artificial sequence
  synthetic polynucleotide sequence
tgcagatcagctggcaga

SEQ ID NO: 9019 - DNA, 18 bp, Artificial sequence
  synthetic polynucleotide sequence
ccaaagctcccacctcca

SEQ ID NO: 9020 - DNA, 18 bp, Artificial sequence
  synthetic polynucleotide sequence
gacgagtcatctggcgca

SEQ ID NO: 9021 - DNA, 18 bp, Artificial sequence
  synthetic polynucleotide sequence
ggcgcaaatccctcagga

SEQ ID NO: 9022 - DNA, 18 bp, Artificial sequence
  synthetic polynucleotide sequence
tgcggcatccacgcctga

SEQ ID NO: 9023 - DNA, 18 bp, Artificial sequence
  synthetic polynucleotide sequence
gctggacggatggtagca

SEQ ID NO: 9024 - DNA, 18 bp, Artificial sequence
  synthetic polynucleotide sequence
aggaatgtcccataccca

SEQ ID NO: 9025 - DNA, 18 bp, Artificial sequence
  synthetic polynucleotide sequence
ggccaaggtattggagga

SEQ ID NO: 9026 - DNA, 18 bp, Artificial sequence
  synthetic polynucleotide sequence
atcaaggcaccagggtca

SEQ ID NO: 9027 - DNA, 18 bp, Artificial sequence
  synthetic polynucleotide sequence
ctcgacctgtaccagcga

SEQ ID NO: 9028 - DNA, 18 bp, Artificial sequence
  synthetic polynucleotide sequence
ggctcaggttcagggcga

SEQ ID NO: 9029 - DNA, 18 bp, Artificial sequence
  synthetic polynucleotide sequence
gtcccaggtgggaaagga

SEQ ID NO: 9030 - DNA, 18 bp, Artificial sequence
  synthetic polynucleotide sequence
ggcccactgtatccagga

SEQ ID NO: 9031 - DNA, 18 bp, Artificial sequence
  synthetic polynucleotide sequence
tcagcgcagcttggagca

SEQ ID NO: 9032 - DNA, 18 bp, Artificial sequence
  synthetic polynucleotide sequence
cccaaggcacctggcaca

SEQ ID NO: 9033 - DNA, 18 bp, Artificial sequence
  synthetic polynucleotide sequence
ccgagcagattccagcca

SEQ ID NO: 9034 - DNA, 18 bp, Artificial sequence
  synthetic polynucleotide sequence
ttcgaggcagggagcaga

SEQ ID NO: 9035 - DNA, 18 bp, Artificial sequence
  synthetic polynucleotide sequence
tacgggaacgtccagaca

SEQ ID NO: 9036 - DNA, 18 bp, Artificial sequence
  synthetic polynucleotide sequence
gtcagctgcagccctgca

SEQ ID NO: 9037 - DNA, 18 bp, Artificial sequence
  synthetic polynucleotide sequence
ggagaaggccaaacccca

SEQ ID NO: 9038 - DNA, 18 bp, Artificial sequence
  synthetic polynucleotide sequence
agaatgcagggaccgcca

SEQ ID NO: 9039 - DNA, 18 bp, Artificial sequence
  synthetic polynucleotide sequence
gaagtggaacgacaggaa

SEQ ID NO: 9040 - DNA, 18 bp, Artificial sequence
  synthetic polynucleotide sequence
agcagagcaacagggaga

SEQ ID NO: 9041 - DNA, 18 bp, Artificial sequence
  synthetic polynucleotide sequence
cacctgcacccaccgcaa

SEQ ID NO: 9042 - DNA, 18 bp, Artificial sequence
  synthetic polynucleotide sequence
ggatgatccacagctgca

SEQ ID NO: 9043 - DNA, 18 bp, Artificial sequence
  synthetic polynucleotide sequence
gctggagctggagcacca

SEQ ID NO: 9044 - DNA, 18 bp, Artificial sequence
  synthetic polynucleotide sequence
ctcggtgagcatgagcga

SEQ ID NO: 9045 - DNA, 18 bp, Artificial sequence
  synthetic polynucleotide sequence
ccaggtggcctgtaggaa

SEQ ID NO: 9046 - DNA, 18 bp, Artificial sequence
  synthetic polynucleotide sequence
gaagggctggatcaggca

SEQ ID NO: 9047 - DNA, 18 bp, Artificial sequence
  synthetic polynucleotide sequence
cctgcaaccgcctgcgaa

SEQ ID NO: 9048 - DNA, 18 bp, Artificial sequence
  synthetic polynucleotide sequence
ctgcccacagcagcccca

SEQ ID NO: 9049 - DNA, 18 bp, Artificial sequence
  synthetic polynucleotide sequence
cagtgtcagaagcaagca

SEQ ID NO: 9050 - DNA, 18 bp, Artificial sequence
  synthetic polynucleotide sequence
gctcacagcttcaagaga

SEQ ID NO: 9051 - DNA, 18 bp, Artificial sequence
  synthetic polynucleotide sequence
gaggaggcagcaatggaa

SEQ ID NO: 9052 - DNA, 18 bp, Artificial sequence
  synthetic polynucleotide sequence
tgtactgcaggcagagga

SEQ ID NO: 9053 - DNA, 18 bp, Artificial sequence
  synthetic polynucleotide sequence
tgtagggggtgcccagga

SEQ ID NO: 9054 - DNA, 18 bp, Artificial sequence
  synthetic polynucleotide sequence
tggaagacaccacggcca

SEQ ID NO: 9055 - DNA, 18 bp, Artificial sequence
  synthetic polynucleotide sequence
gtccggtgagccgccaga

SEQ ID NO: 9056 - DNA, 18 bp, Artificial sequence
  synthetic polynucleotide sequence
ctggcaccaatgctgcca

SEQ ID NO: 9057 - DNA, 18 bp, Artificial sequence
  synthetic polynucleotide sequence
ggcagcacagcaaaagca

SEQ ID NO: 9058 - DNA, 18 bp, Artificial sequence
  synthetic polynucleotide sequence
gcaggacggggatccaca

SEQ ID NO: 9059 - DNA, 18 bp, Artificial sequence
  synthetic polynucleotide sequence
gctgagagatcccagaga

SEQ ID NO: 9060 - DNA, 18 bp, Artificial sequence
  synthetic polynucleotide sequence
caagaagcggcctgggca

SEQ ID NO: 9061 - DNA, 18 bp, Artificial sequence
  synthetic polynucleotide sequence
gcgccacatctcctgaga

SEQ ID NO: 9062 - DNA, 18 bp, Artificial sequence
  synthetic polynucleotide sequence
cgatggtactcaggagga

SEQ ID NO: 9063 - DNA, 18 bp, Artificial sequence
  synthetic polynucleotide sequence
aggaggcacatacaccca

SEQ ID NO: 9064 - DNA, 18 bp, Artificial sequence
  synthetic polynucleotide sequence
ctcgaagacggcagcgga

SEQ ID NO: 9065 - DNA, 18 bp, Artificial sequence
  synthetic polynucleotide sequence
aggcagagactgtggcaa

SEQ ID NO: 9066 - DNA, 18 bp, Artificial sequence
  synthetic polynucleotide sequence
catgatcaggagcgggca

SEQ ID NO: 9067 - DNA, 18 bp, Artificial sequence
  synthetic polynucleotide sequence
cgagcaaagccaaaggaa

SEQ ID NO: 9068 - DNA, 18 bp, Artificial sequence
  synthetic polynucleotide sequence
gtagagaggcaccagcga

SEQ ID NO: 9069 - DNA, 18 bp, Artificial sequence
  synthetic polynucleotide sequence
gcacttgcccaaagccca

SEQ ID NO: 9070 - DNA, 18 bp, Artificial sequence
  synthetic polynucleotide sequence
cctcaggtaccatgcgga

SEQ ID NO: 9071 - DNA, 18 bp, Artificial sequence
  synthetic polynucleotide sequence
cgagtgctatcaccccaa

SEQ ID NO: 9072 - DNA, 18 bp, Artificial sequence
  synthetic polynucleotide sequence
ccagcctcaatcacccca

SEQ ID NO: 9073 - DNA, 18 bp, Artificial sequence
  synthetic polynucleotide sequence
gcaccctccggaaaggca

SEQ ID NO: 9074 - DNA, 18 bp, Artificial sequence
  synthetic polynucleotide sequence
tcactgggctccagggga

SEQ ID NO: 9075 - DNA, 18 bp, Artificial sequence
  synthetic polynucleotide sequence
cggaagtcggcaaagcca

SEQ ID NO: 9076 - DNA, 18 bp, Artificial sequence
  synthetic polynucleotide sequence
gcaaggggcttccatgga

SEQ ID NO: 9077 - DNA, 18 bp, Artificial sequence
  synthetic polynucleotide sequence
cccaacacggagtcagga

SEQ ID NO: 9078 - DNA, 18 bp, Artificial sequence
  synthetic polynucleotide sequence
ccaatgaagagcacgcca

SEQ ID NO: 9079 - DNA, 18 bp, Artificial sequence
  synthetic polynucleotide sequence
ctagggtggagaccgcca

SEQ ID NO: 9080 - DNA, 18 bp, Artificial sequence
  synthetic polynucleotide sequence
ctggaagtgagggccaca

SEQ ID NO: 9081 - DNA, 18 bp, Artificial sequence
  synthetic polynucleotide sequence
cgagcctctgaagcgcaa

SEQ ID NO: 9082 - DNA, 18 bp, Artificial sequence
  synthetic polynucleotide sequence
accgatcaccatcccgga

SEQ ID NO: 9083 - DNA, 18 bp, Artificial sequence
  synthetic polynucleotide sequence
ctcctagcgaagccccga

SEQ ID NO: 9084 - DNA, 18 bp, Artificial sequence
  synthetic polynucleotide sequence
tatgggacagggtacaca

SEQ ID NO: 9085 - DNA, 18 bp, Artificial sequence
  synthetic polynucleotide sequence
tgggcgctacctggagca

SEQ ID NO: 9086 - DNA, 18 bp, Artificial sequence
  synthetic polynucleotide sequence
tgacatccagcacgcaca

SEQ ID NO: 9087 - DNA, 18 bp, Artificial sequence
  synthetic polynucleotide sequence
gcaagcattcgaggcaga

SEQ ID NO: 9088 - DNA, 18 bp, Artificial sequence
  synthetic polynucleotide sequence
tggccaataatgcccgaa

SEQ ID NO: 9089 - DNA, 18 bp, Artificial sequence
  synthetic polynucleotide sequence
tgctcaacacggtgcaga

SEQ ID NO: 9090 - DNA, 18 bp, Artificial sequence
  synthetic polynucleotide sequence
acagtgcatacggacgca

SEQ ID NO: 9091 - DNA, 18 bp, Artificial sequence
  synthetic polynucleotide sequence
acctcatccctgagggca

SEQ ID NO: 9092 - DNA, 18 bp, Artificial sequence
  synthetic polynucleotide sequence
acagctccacacagccca

SEQ ID NO: 9093 - DNA, 18 bp, Artificial sequence
  synthetic polynucleotide sequence
cactactcccaagggcaa

SEQ ID NO: 9094 - DNA, 18 bp, Artificial sequence
  synthetic polynucleotide sequence
gtccaggctggacaacga

SEQ ID NO: 9095 - DNA, 18 bp, Artificial sequence
  synthetic polynucleotide sequence
ggtgaagaacccacctga

SEQ ID NO: 9096 - DNA, 18 bp, Artificial sequence
  synthetic polynucleotide sequence
ccagagccaggaagtgga

SEQ ID NO: 9097 - DNA, 18 bp, Artificial sequence
  synthetic polynucleotide sequence
acctatcaggcgtgggca

SEQ ID NO: 9098 - DNA, 18 bp, Artificial sequence
  synthetic polynucleotide sequence
acaaggacaatggaccca

SEQ ID NO: 9099 - DNA, 18 bp, Artificial sequence
  synthetic polynucleotide sequence
acagctgggcaggaggaa

SEQ ID NO: 9100 - DNA, 18 bp, Artificial sequence
  synthetic polynucleotide sequence
tagacgatgaggaagcca

SEQ ID NO: 9101 - DNA, 18 bp, Artificial sequence
  synthetic polynucleotide sequence
gacgactcccgaacccaa

SEQ ID NO: 9102 - DNA, 18 bp, Artificial sequence
  synthetic polynucleotide sequence
tccacccagagctcgaca

SEQ ID NO: 9103 - DNA, 18 bp, Artificial sequence
  synthetic polynucleotide sequence
cggcaggttcgaagggaa

SEQ ID NO: 9104 - DNA, 18 bp, Artificial sequence
  synthetic polynucleotide sequence
ctgcagcatcaagtgcaa

SEQ ID NO: 9105 - DNA, 18 bp, Artificial sequence
  synthetic polynucleotide sequence
cacgggctgtgaacacca

SEQ ID NO: 9106 - DNA, 18 bp, Artificial sequence
  synthetic polynucleotide sequence
tccagagcctcacagcca

SEQ ID NO: 9107 - DNA, 18 bp, Artificial sequence
  synthetic polynucleotide sequence
aaagctcaggatgaggca

SEQ ID NO: 9108 - DNA, 18 bp, Artificial sequence
  synthetic polynucleotide sequence
aggtccttcaccacgcga

SEQ ID NO: 9109 - DNA, 18 bp, Artificial sequence
  synthetic polynucleotide sequence
accctgtggggacacgaa

SEQ ID NO: 9110 - DNA, 18 bp, Artificial sequence
  synthetic polynucleotide sequence
aatggccagcaccttgga

SEQ ID NO: 9111 - DNA, 18 bp, Artificial sequence
  synthetic polynucleotide sequence
ggcagaggccataaagga

SEQ ID NO: 9112 - DNA, 18 bp, Artificial sequence
  synthetic polynucleotide sequence
taggatcaacacgaccca

SEQ ID NO: 9113 - DNA, 18 bp, Artificial sequence
  synthetic polynucleotide sequence
cgccccagaattcaccaa

SEQ ID NO: 9114 - DNA, 18 bp, Artificial sequence
  synthetic polynucleotide sequence
ctcacgagtggaggccga

SEQ ID NO: 9115 - DNA, 18 bp, Artificial sequence
  synthetic polynucleotide sequence
ctggatcatcgccacaga

SEQ ID NO: 9116 - DNA, 18 bp, Artificial sequence
  synthetic polynucleotide sequence
tgagggtccccacaggca

SEQ ID NO: 9117 - DNA, 18 bp, Artificial sequence
  synthetic polynucleotide sequence
tgccagccgccagtggaa

SEQ ID NO: 9118 - DNA, 18 bp, Artificial sequence
  synthetic polynucleotide sequence
gcttgccaagcagcgtga

SEQ ID NO: 9119 - DNA, 18 bp, Artificial sequence
  synthetic polynucleotide sequence
gcggacacgggtgcagca

SEQ ID NO: 9120 - DNA, 18 bp, Artificial sequence
  synthetic polynucleotide sequence
ccagctgcacgtaggcga

SEQ ID NO: 9121 - DNA, 18 bp, Artificial sequence
  synthetic polynucleotide sequence
gggagggctgaacacaca

SEQ ID NO: 9122 - DNA, 18 bp, Artificial sequence
  synthetic polynucleotide sequence
tgacctggcggtggagca

SEQ ID NO: 9123 - DNA, 18 bp, Artificial sequence
  synthetic polynucleotide sequence
agtccgctacactaagga

SEQ ID NO: 9124 - DNA, 18 bp, Artificial sequence
  synthetic polynucleotide sequence
gcacagcacccttgggca

SEQ ID NO: 9125 - DNA, 18 bp, Artificial sequence
  synthetic polynucleotide sequence
cggggaacagaacacaca

SEQ ID NO: 9126 - DNA, 18 bp, Artificial sequence
  synthetic polynucleotide sequence
atgcccagcttcaaggca

SEQ ID NO: 9127 - DNA, 18 bp, Artificial sequence
  synthetic polynucleotide sequence
cgaaactactgggagcga

SEQ ID NO: 9128 - DNA, 18 bp, Artificial sequence
  synthetic polynucleotide sequence
aatgctggtccccacgga

SEQ ID NO: 9129 - DNA, 18 bp, Artificial sequence
  synthetic polynucleotide sequence
cgagcaacatcaaacgca

SEQ ID NO: 9130 - DNA, 18 bp, Artificial sequence
  synthetic polynucleotide sequence
tgagcattcggcgaagga

SEQ ID NO: 9131 - DNA, 18 bp, Artificial sequence
  synthetic polynucleotide sequence
gctggtgcagtgagagca

SEQ ID NO: 9132 - DNA, 18 bp, Artificial sequence
  synthetic polynucleotide sequence
cgtccagtggacaatgca

SEQ ID NO: 9133 - DNA, 18 bp, Artificial sequence
  synthetic polynucleotide sequence
agcccgtggtggtgcaga

SEQ ID NO: 9134 - DNA, 18 bp, Artificial sequence
  synthetic polynucleotide sequence
ctgagtccacccaggcca

SEQ ID NO: 9135 - DNA, 18 bp, Artificial sequence
  synthetic polynucleotide sequence
gagcaagtggacgagcaa

SEQ ID NO: 9136 - DNA, 18 bp, Artificial sequence
  synthetic polynucleotide sequence
agcttgaagccggtcaga

SEQ ID NO: 9137 - DNA, 18 bp, Artificial sequence
  synthetic polynucleotide sequence
cgccaggcttatgcacga

SEQ ID NO: 9138 - DNA, 18 bp, Artificial sequence
  synthetic polynucleotide sequence
ctatgggcatcgccagca

SEQ ID NO: 9139 - DNA, 18 bp, Artificial sequence
  synthetic polynucleotide sequence
ccagaccaaggcaggtga

SEQ ID NO: 9140 - DNA, 18 bp, Artificial sequence
  synthetic polynucleotide sequence
taccgtcacctcacacca

SEQ ID NO: 9141 - DNA, 18 bp, Artificial sequence
  synthetic polynucleotide sequence
acagcaggcatagccgca

SEQ ID NO: 9142 - DNA, 18 bp, Artificial sequence
  synthetic polynucleotide sequence
gccccaggcctttcacca

SEQ ID NO: 9143 - DNA, 18 bp, Artificial sequence
  synthetic polynucleotide sequence
gtcgagtgcggctcagca

SEQ ID NO: 9144 - DNA, 18 bp, Artificial sequence
  synthetic polynucleotide sequence
tgccacgcacaacggtga

SEQ ID NO: 9145 - DNA, 18 bp, Artificial sequence
  synthetic polynucleotide sequence
gcgatgtgaagagacgaa

SEQ ID NO: 9146 - DNA, 18 bp, Artificial sequence
  synthetic polynucleotide sequence
cgcttcacaccacgcgga

SEQ ID NO: 9147 - DNA, 18 bp, Artificial sequence
  synthetic polynucleotide sequence
gaaaggacaaagcccaca

SEQ ID NO: 9148 - DNA, 18 bp, Artificial sequence
  synthetic polynucleotide sequence
ctcaattcccagccccca

SEQ ID NO: 9149 - DNA, 18 bp, Artificial sequence
  synthetic polynucleotide sequence
cagcggactcggaagaca

SEQ ID NO: 9150 - DNA, 18 bp, Artificial sequence
  synthetic polynucleotide sequence
gatacccgtgtgggcgca

SEQ ID NO: 9151 - DNA, 18 bp, Artificial sequence
  synthetic polynucleotide sequence
gtatagccaggacaggca

SEQ ID NO: 9152 - DNA, 18 bp, Artificial sequence
  synthetic polynucleotide sequence
gcacgtgatacagctgga

SEQ ID NO: 9153 - DNA, 18 bp, Artificial sequence
  synthetic polynucleotide sequence
gttggagcggcactcgga

SEQ ID NO: 9154 - DNA, 18 bp, Artificial sequence
  synthetic polynucleotide sequence
agatccgtccaatgacca

SEQ ID NO: 9155 - DNA, 18 bp, Artificial sequence
  synthetic polynucleotide sequence
acctgaacctgcgctgga

SEQ ID NO: 9156 - DNA, 18 bp, Artificial sequence
  synthetic polynucleotide sequence
agggttgacaccagctga

SEQ ID NO: 9157 - DNA, 18 bp, Artificial sequence
  synthetic polynucleotide sequence
gtggacaaaagaggggaa

SEQ ID NO: 9158 - DNA, 18 bp, Artificial sequence
  synthetic polynucleotide sequence
cacaagtcaccagctcca

SEQ ID NO: 9159 - DNA, 18 bp, Artificial sequence
  synthetic polynucleotide sequence
ccaccaagaagaaaggca

SEQ ID NO: 9160 - DNA, 18 bp, Artificial sequence
  synthetic polynucleotide sequence
acaggaagaggtactgca

SEQ ID NO: 9161 - DNA, 18 bp, Artificial sequence
  synthetic polynucleotide sequence
caccaaccgcacaaagga

SEQ ID NO: 9162 - DNA, 18 bp, Artificial sequence
  synthetic polynucleotide sequence
gctccatggagtggggga

SEQ ID NO: 9163 - DNA, 18 bp, Artificial sequence
  synthetic polynucleotide sequence
agccaatgaaaggcccta

SEQ ID NO: 9164 - DNA, 18 bp, Artificial sequence
  synthetic polynucleotide sequence
cagagagggtaccacaca

SEQ ID NO: 9165 - DNA, 18 bp, Artificial sequence
  synthetic polynucleotide sequence
cccaggacagaagggcaa

SEQ ID NO: 9166 - DNA, 18 bp, Artificial sequence
  synthetic polynucleotide sequence
agtgctccccagaatgga

SEQ ID NO: 9167 - DNA, 18 bp, Artificial sequence
  synthetic polynucleotide sequence
ctcatccccaccactgca

SEQ ID NO: 9168 - DNA, 18 bp, Artificial sequence
  synthetic polynucleotide sequence
gagcagacaactgttcca

SEQ ID NO: 9169 - DNA, 18 bp, Artificial sequence
  synthetic polynucleotide sequence
gtcaccggacctatgcaa

SEQ ID NO: 9170 - DNA, 18 bp, Artificial sequence
  synthetic polynucleotide sequence
gcaaggtgagaatcagca

SEQ ID NO: 9171 - DNA, 18 bp, Artificial sequence
  synthetic polynucleotide sequence
atggaacaggccatgcca

SEQ ID NO: 9172 - DNA, 18 bp, Artificial sequence
  synthetic polynucleotide sequence
ctaaggctcatcagggca

SEQ ID NO: 9173 - DNA, 18 bp, Artificial sequence
  synthetic polynucleotide sequence
gctatacagccaaagcca

SEQ ID NO: 9174 - DNA, 18 bp, Artificial sequence
  synthetic polynucleotide sequence
gccagcacactcacccca

SEQ ID NO: 9175 - DNA, 18 bp, Artificial sequence
  synthetic polynucleotide sequence
caagcagtcgcagcggaa

SEQ ID NO: 9176 - DNA, 18 bp, Artificial sequence
  synthetic polynucleotide sequence
aactggaagccagccgga

SEQ ID NO: 9177 - DNA, 18 bp, Artificial sequence
  synthetic polynucleotide sequence
tggggaaactgagacaga

SEQ ID NO: 9178 - DNA, 18 bp, Artificial sequence
  synthetic polynucleotide sequence
gattaccgcagacagtga

SEQ ID NO: 9179 - DNA, 18 bp, Artificial sequence
  synthetic polynucleotide sequence
gaatcagctccgggagca

SEQ ID NO: 9180 - DNA, 18 bp, Artificial sequence
  synthetic polynucleotide sequence
agcgaccttggccaggga

SEQ ID NO: 9181 - DNA, 18 bp, Artificial sequence
  synthetic polynucleotide sequence
cctcaaccaggtggcgaa

SEQ ID NO: 9182 - DNA, 18 bp, Artificial sequence
  synthetic polynucleotide sequence
ccagccagtgtcggagca

SEQ ID NO: 9183 - DNA, 18 bp, Artificial sequence
  synthetic polynucleotide sequence
aaggactgcatgcggcga

SEQ ID NO: 9184 - DNA, 18 bp, Artificial sequence
  synthetic polynucleotide sequence
gggcgacacataggacca

SEQ ID NO: 9185 - DNA, 18 bp, Artificial sequence
  synthetic polynucleotide sequence
cataagccgctgctggga

SEQ ID NO: 9186 - DNA, 18 bp, Artificial sequence
  synthetic polynucleotide sequence
ggggactgccttacacca

SEQ ID NO: 9187 - DNA, 18 bp, Artificial sequence
  synthetic polynucleotide sequence
ctaggagcagtgccagga

SEQ ID NO: 9188 - DNA, 18 bp, Artificial sequence
  synthetic polynucleotide sequence
gatcctacggcagcggca

SEQ ID NO: 9189 - DNA, 22 bp, Artificial sequence
  synthetic polynucleotide sequence
gactattagaggccagaggaga

SEQ ID NO: 9190 - DNA, 19 bp, Artificial sequence
  synthetic polynucleotide sequence
ggtggagaagaaggaccca

SEQ ID NO: 9191 - DNA, 17 bp, Artificial sequence
  synthetic polynucleotide sequence
cagcatagcacgctcca

SEQ ID NO: 9192 - DNA, 17 bp, Artificial sequence
  synthetic polynucleotide sequence
cagcatagcacgctcca

SEQ ID NO: 9193 - DNA, 18 bp, Artificial sequence
  synthetic polynucleotide sequence
cgtgcacaaggcagctca

SEQ ID NO: 9194 - DNA, 18 bp, Artificial sequence
  synthetic polynucleotide sequence
gtgcaagtgactccagca

SEQ ID NO: 9195 - DNA, 18 bp, Artificial sequence
  synthetic polynucleotide sequence
acatccgggagggacaga

SEQ ID NO: 9196 - DNA, 18 bp, Artificial sequence
  synthetic polynucleotide sequence
gacacgccggtgccccca

SEQ ID NO: 9197 - DNA, 18 bp, Artificial sequence
  synthetic polynucleotide sequence
cacacagggatcctgaga

SEQ ID NO: 9198 - DNA, 18 bp, Artificial sequence
  synthetic polynucleotide sequence
ggcccaggtccatcagga

SEQ ID NO: 9199 - DNA, 18 bp, Artificial sequence
  synthetic polynucleotide sequence
aacacccctgcagtacca

SEQ ID NO: 9200 - DNA, 18 bp, Artificial sequence
  synthetic polynucleotide sequence
gaatgaaggccaacctga

SEQ ID NO: 9201 - DNA, 18 bp, Artificial sequence
  synthetic polynucleotide sequence
ccacagcatggagagcca

SEQ ID NO: 9202 - DNA, 18 bp, Artificial sequence
  synthetic polynucleotide sequence
attcagggggcaggcaga

SEQ ID NO: 9203 - DNA, 18 bp, Artificial sequence
  synthetic polynucleotide sequence
ccagtgcagccacaagca

SEQ ID NO: 9204 - DNA, 18 bp, Artificial sequence
  synthetic polynucleotide sequence
tgagagctgccagcacga

SEQ ID NO: 9205 - DNA, 18 bp, Artificial sequence
  synthetic polynucleotide sequence
cctgggaaggttacagca

SEQ ID NO: 9206 - DNA, 18 bp, Artificial sequence
  synthetic polynucleotide sequence
ttgacatgaacccaggca

SEQ ID NO: 9207 - DNA, 18 bp, Artificial sequence
  synthetic polynucleotide sequence
gggccgtgtagagtccca

SEQ ID NO: 9208 - DNA, 18 bp, Artificial sequence
  synthetic polynucleotide sequence
cgcgccaaggcaaagaga

SEQ ID NO: 9209 - DNA, 18 bp, Artificial sequence
  synthetic polynucleotide sequence
ccctgggcacacttggca

SEQ ID NO: 9210 - DNA, 18 bp, Artificial sequence
  synthetic polynucleotide sequence
ccctgggcacacttggca

SEQ ID NO: 9211 - DNA, 18 bp, Artificial sequence
  synthetic polynucleotide sequence
gcaagtgcgagggatgca

SEQ ID NO: 9212 - DNA, 18 bp, Artificial sequence
  synthetic polynucleotide sequence
ctcacactccgcagggca

SEQ ID NO: 9213 - DNA, 18 bp, Artificial sequence
  synthetic polynucleotide sequence
gtgtggagacaactgcaa

SEQ ID NO: 9214 - DNA, 18 bp, Artificial sequence
  synthetic polynucleotide sequence
ggggcagcagggacagca

SEQ ID NO: 9215 - DNA, 18 bp, Artificial sequence
  synthetic polynucleotide sequence
gagagaggccaggaccaa

SEQ ID NO: 9216 - DNA, 18 bp, Artificial sequence
  synthetic polynucleotide sequence
gcgcaggatctcacggca

SEQ ID NO: 9217 - DNA, 18 bp, Artificial sequence
  synthetic polynucleotide sequence
ctcacagccagcagccaa

SEQ ID NO: 9218 - DNA, 18 bp, Artificial sequence
  synthetic polynucleotide sequence
ggcaagttgggtcggcga

SEQ ID NO: 9219 - DNA, 18 bp, Artificial sequence
  synthetic polynucleotide sequence
gccatgcagggaatgcca

SEQ ID NO: 9220 - DNA, 18 bp, Artificial sequence
  synthetic polynucleotide sequence
ttgcagacctgacgagca

SEQ ID NO: 9221 - DNA, 18 bp, Artificial sequence
  synthetic polynucleotide sequence
gcccagcaactgttcaga

SEQ ID NO: 9222 - DNA, 18 bp, Artificial sequence
  synthetic polynucleotide sequence
ggaatggccagaaaggca

SEQ ID NO: 9223 - DNA, 18 bp, Artificial sequence
  synthetic polynucleotide sequence
ggtcgccaactagcagga

SEQ ID NO: 9224 - DNA, 18 bp, Artificial sequence
  synthetic polynucleotide sequence
ggatgacagcttcagcca

SEQ ID NO: 9225 - DNA, 18 bp, Artificial sequence
  synthetic polynucleotide sequence
gaggaacaagacccgcga

SEQ ID NO: 9226 - DNA, 18 bp, Artificial sequence
  synthetic polynucleotide sequence
aagggtgaggagttagga

SEQ ID NO: 9227 - DNA, 18 bp, Artificial sequence
  synthetic polynucleotide sequence
tatctgccacaagcgaga

SEQ ID NO: 9228 - DNA, 18 bp, Artificial sequence
  synthetic polynucleotide sequence
tatctgccacaagcgaga

SEQ ID NO: 9229 - DNA, 18 bp, Artificial sequence
  synthetic polynucleotide sequence
cttcccaagtgccgccaa

SEQ ID NO: 9230 - DNA, 18 bp, Artificial sequence
  synthetic polynucleotide sequence
gtctgtgaaggaggcaca

SEQ ID NO: 9231 - DNA, 18 bp, Artificial sequence
  synthetic polynucleotide sequence
aactgagggaactgcaca

SEQ ID NO: 9232 - DNA, 18 bp, Artificial sequence
  synthetic polynucleotide sequence
ggtattgcagcaggccaa

SEQ ID NO: 9233 - DNA, 18 bp, Artificial sequence
  synthetic polynucleotide sequence
aaaggtggcgctgcagga

SEQ ID NO: 9234 - DNA, 18 bp, Artificial sequence
  synthetic polynucleotide sequence
cgagcatcaatggccgca

SEQ ID NO: 9235 - DNA, 18 bp, Artificial sequence
  synthetic polynucleotide sequence
atcaaggaaggagcagca

SEQ ID NO: 9236 - DNA, 18 bp, Artificial sequence
  synthetic polynucleotide sequence
atggggccaacacctcca

SEQ ID NO: 9237 - DNA, 18 bp, Artificial sequence
  synthetic polynucleotide sequence
gaccacgttgatgagcga

SEQ ID NO: 9238 - DNA, 18 bp, Artificial sequence
  synthetic polynucleotide sequence
atcttccagccacaacca

SEQ ID NO: 9239 - DNA, 18 bp, Artificial sequence
  synthetic polynucleotide sequence
cacgatggggtcggagga

SEQ ID NO: 9240 - DNA, 18 bp, Artificial sequence
  synthetic polynucleotide sequence
cagcctgctgaaggagga

SEQ ID NO: 9241 - DNA, 18 bp, Artificial sequence
  synthetic polynucleotide sequence
ctggagagaccagtccca

SEQ ID NO: 9242 - DNA, 18 bp, Artificial sequence
  synthetic polynucleotide sequence
tcaccagcgagtgaagca

SEQ ID NO: 9243 - DNA, 18 bp, Artificial sequence
  synthetic polynucleotide sequence
ggtagcagcgtctccaga

SEQ ID NO: 9244 - DNA, 18 bp, Artificial sequence
  synthetic polynucleotide sequence
agcctggctgaccaggaa

SEQ ID NO: 9245 - DNA, 18 bp, Artificial sequence
  synthetic polynucleotide sequence
ccgatggcaccggaagga

SEQ ID NO: 9246 - DNA, 18 bp, Artificial sequence
  synthetic polynucleotide sequence
ccgatggcaccggaagga

SEQ ID NO: 9247 - DNA, 18 bp, Artificial sequence
  synthetic polynucleotide sequence
ggcaccctatccagggaa

SEQ ID NO: 9248 - DNA, 18 bp, Artificial sequence
  synthetic polynucleotide sequence
tgccagtggcctcagaga

SEQ ID NO: 9249 - DNA, 18 bp, Artificial sequence
  synthetic polynucleotide sequence
gggtgaaacctgaccgca

SEQ ID NO: 9250 - DNA, 18 bp, Artificial sequence
  synthetic polynucleotide sequence
gttcagaggagcccagca

SEQ ID NO: 9251 - DNA, 18 bp, Artificial sequence
  synthetic polynucleotide sequence
aagccaagccagagagca

SEQ ID NO: 9252 - DNA, 18 bp, Artificial sequence
  synthetic polynucleotide sequence
ggttgatggccacagcga

SEQ ID NO: 9253 - DNA, 18 bp, Artificial sequence
  synthetic polynucleotide sequence
tgcgagagcacaaggaca

SEQ ID NO: 9254 - DNA, 18 bp, Artificial sequence
  synthetic polynucleotide sequence
ctggccagcagagtagga

SEQ ID NO: 9255 - DNA, 18 bp, Artificial sequence
  synthetic polynucleotide sequence
ctgcagagcccatagcca

SEQ ID NO: 9256 - DNA, 18 bp, Artificial sequence
  synthetic polynucleotide sequence
ggcccaggtagtcacgga

SEQ ID NO: 9257 - DNA, 18 bp, Artificial sequence
  synthetic polynucleotide sequence
catctggctgaggaagga

SEQ ID NO: 9258 - DNA, 18 bp, Artificial sequence
  synthetic polynucleotide sequence
agttcagcgcatccccga

SEQ ID NO: 9259 - DNA, 18 bp, Artificial sequence
  synthetic polynucleotide sequence
cagatcacgctgaaggca

SEQ ID NO: 9260 - DNA, 18 bp, Artificial sequence
  synthetic polynucleotide sequence
ggccaggaggaaagccaa

SEQ ID NO: 9261 - DNA, 18 bp, Artificial sequence
  synthetic polynucleotide sequence
gtggtggggaggccagca

SEQ ID NO: 9262 - DNA, 17 bp, Artificial sequence
  synthetic polynucleotide sequence
ggtgaccaggaggcaga

SEQ ID NO: 9263 - DNA, 18 bp, Artificial sequence
  synthetic polynucleotide sequence
ctatccggctgaggggca

SEQ ID NO: 9264 - DNA, 18 bp, Artificial sequence
  synthetic polynucleotide sequence
ctatccggctgaggggca

SEQ ID NO: 9265 - DNA, 18 bp, Artificial sequence
  synthetic polynucleotide sequence
aaactggggacccgacca

SEQ ID NO: 9266 - DNA, 18 bp, Artificial sequence
  synthetic polynucleotide sequence
gctgactctggccggaga

SEQ ID NO: 9267 - DNA, 18 bp, Artificial sequence
  synthetic polynucleotide sequence
ccacgacgtggagacaca

SEQ ID NO: 9268 - DNA, 18 bp, Artificial sequence
  synthetic polynucleotide sequence
ggcactgacagacagcca

SEQ ID NO: 9269 - DNA, 18 bp, Artificial sequence
  synthetic polynucleotide sequence
gacagtgagtcaaccaca

SEQ ID NO: 9270 - DNA, 18 bp, Artificial sequence
  synthetic polynucleotide sequence
gccagtgggaggccctga

SEQ ID NO: 9271 - DNA, 18 bp, Artificial sequence
  synthetic polynucleotide sequence
ctgctgaaggtaccggca

SEQ ID NO: 9272 - DNA, 18 bp, Artificial sequence
  synthetic polynucleotide sequence
gtggtgctgacaggcaca

SEQ ID NO: 9273 - DNA, 18 bp, Artificial sequence
  synthetic polynucleotide sequence
tgaagcccccaacagcca

SEQ ID NO: 9274 - DNA, 18 bp, Artificial sequence
  synthetic polynucleotide sequence
tcagccgcaggaggagga

SEQ ID NO: 9275 - DNA, 18 bp, Artificial sequence
  synthetic polynucleotide sequence
agagcgcgatcaccgaga

SEQ ID NO: 9276 - DNA, 18 bp, Artificial sequence
  synthetic polynucleotide sequence
cttgagcctcacgacgca

SEQ ID NO: 9277 - DNA, 18 bp, Artificial sequence
  synthetic polynucleotide sequence
gcttgcactgcaccgaca

SEQ ID NO: 9278 - DNA, 18 bp, Artificial sequence
  synthetic polynucleotide sequence
tctgccctgaggaccaga

SEQ ID NO: 9279 - DNA, 18 bp, Artificial sequence
  synthetic polynucleotide sequence
cgcagtagatggggcaga

SEQ ID NO: 9280 - DNA, 18 bp, Artificial sequence
  synthetic polynucleotide sequence
tgccacctgccacagcaa

SEQ ID NO: 9281 - DNA, 18 bp, Artificial sequence
  synthetic polynucleotide sequence
cagaaggtgtgggtggga

SEQ ID NO: 9282 - DNA, 18 bp, Artificial sequence
  synthetic polynucleotide sequence
cagaaggtgtgggtggga

SEQ ID NO: 9283 - DNA, 18 bp, Artificial sequence
  synthetic polynucleotide sequence
ccagctgacacgtatcca

SEQ ID NO: 9284 - DNA, 18 bp, Artificial sequence
  synthetic polynucleotide sequence
gcagtggtaggagcagca

SEQ ID NO: 9285 - DNA, 18 bp, Artificial sequence
  synthetic polynucleotide sequence
cagaaaggccagccgcaa

SEQ ID NO: 9286 - DNA, 18 bp, Artificial sequence
  synthetic polynucleotide sequence
cggacgggaactcccaca

SEQ ID NO: 9287 - DNA, 18 bp, Artificial sequence
  synthetic polynucleotide sequence
cccaggctcgaatggaga

SEQ ID NO: 9288 - DNA, 18 bp, Artificial sequence
  synthetic polynucleotide sequence
cgcaggggtcatccagga

SEQ ID NO: 9289 - DNA, 18 bp, Artificial sequence
  synthetic polynucleotide sequence
cgaagcaggccctgacca

SEQ ID NO: 9290 - DNA, 18 bp, Artificial sequence
  synthetic polynucleotide sequence
gactcggctgtccaggga

SEQ ID NO: 9291 - DNA, 18 bp, Artificial sequence
  synthetic polynucleotide sequence
gctgaacaaggggcagga

SEQ ID NO: 9292 - DNA, 18 bp, Artificial sequence
  synthetic polynucleotide sequence
gcccagctgagagggaca

SEQ ID NO: 9293 - DNA, 18 bp, Artificial sequence
  synthetic polynucleotide sequence
acacgaggttccgcacca

SEQ ID NO: 9294 - DNA, 18 bp, Artificial sequence
  synthetic polynucleotide sequence
ccacagaggctctcagca

SEQ ID NO: 9295 - DNA, 18 bp, Artificial sequence
  synthetic polynucleotide sequence
ctcttgaagcagccagga

SEQ ID NO: 9296 - DNA, 18 bp, Artificial sequence
  synthetic polynucleotide sequence
ccagcaaacgtctcgcca

SEQ ID NO: 9297 - DNA, 18 bp, Artificial sequence
  synthetic polynucleotide sequence
ccaagacacgccttgtga

SEQ ID NO: 9298 - DNA, 18 bp, Artificial sequence
  synthetic polynucleotide sequence
cagcagcagtgtgagcga

SEQ ID NO: 9299 - DNA, 18 bp, Artificial sequence
  synthetic polynucleotide sequence
ctcagaggagaggcctga

SEQ ID NO: 9300 - DNA, 18 bp, Artificial sequence
  synthetic polynucleotide sequence
ctcagaggagaggcctga

SEQ ID NO: 9301 - DNA, 18 bp, Artificial sequence
  synthetic polynucleotide sequence
gcagctgcagcaggagca

SEQ ID NO: 9302 - DNA, 18 bp, Artificial sequence
  synthetic polynucleotide sequence
acagcagagcccgtgcta

SEQ ID NO: 9303 - DNA, 18 bp, Artificial sequence
  synthetic polynucleotide sequence
gcgactggaacagctgca

SEQ ID NO: 9304 - DNA, 18 bp, Artificial sequence
  synthetic polynucleotide sequence
cgctctgaatcagaacga

SEQ ID NO: 9305 - DNA, 18 bp, Artificial sequence
  synthetic polynucleotide sequence
ggtgggactgaagccaga

SEQ ID NO: 9306 - DNA, 18 bp, Artificial sequence
  synthetic polynucleotide sequence
aacaccgaggcctcacga

SEQ ID NO: 9307 - DNA, 18 bp, Artificial sequence
  synthetic polynucleotide sequence
ctggaggaggagcagaga

SEQ ID NO: 9308 - DNA, 18 bp, Artificial sequence
  synthetic polynucleotide sequence
ctgcacgtcgccgtcgga

SEQ ID NO: 9309 - DNA, 18 bp, Artificial sequence
  synthetic polynucleotide sequence
cctgcaaggcacagcaca

SEQ ID NO: 9310 - DNA, 18 bp, Artificial sequence
  synthetic polynucleotide sequence
acaggggaacgcttggga

SEQ ID NO: 9311 - DNA, 18 bp, Artificial sequence
  synthetic polynucleotide sequence
ggtctgcgaactgcacca

SEQ ID NO: 9312 - DNA, 18 bp, Artificial sequence
  synthetic polynucleotide sequence
ggaaaaccaggcccgaga

SEQ ID NO: 9313 - DNA, 18 bp, Artificial sequence
  synthetic polynucleotide sequence
tgcctggggaatgaccca

SEQ ID NO: 9314 - DNA, 18 bp, Artificial sequence
  synthetic polynucleotide sequence
ggagccatggaatgccaa

SEQ ID NO: 9315 - DNA, 18 bp, Artificial sequence
  synthetic polynucleotide sequence
tctcagtgacaggggaca

SEQ ID NO: 9316 - DNA, 18 bp, Artificial sequence
  synthetic polynucleotide sequence
tctcagacctgagccgga

SEQ ID NO: 9317 - DNA, 18 bp, Artificial sequence
  synthetic polynucleotide sequence
cgaggtgctgagtccaca

SEQ ID NO: 9318 - DNA, 18 bp, Artificial sequence
  synthetic polynucleotide sequence
cgaggtgctgagtccaca

SEQ ID NO: 9319 - DNA, 18 bp, Artificial sequence
  synthetic polynucleotide sequence
cagcgactctgaggagga

SEQ ID NO: 9320 - DNA, 18 bp, Artificial sequence
  synthetic polynucleotide sequence
accctcttggcagcagga

SEQ ID NO: 9321 - DNA, 18 bp, Artificial sequence
  synthetic polynucleotide sequence
gctgaatccccaggacca

SEQ ID NO: 9322 - DNA, 18 bp, Artificial sequence
  synthetic polynucleotide sequence
tgaggaggagcgtggaga

SEQ ID NO: 9323 - DNA, 18 bp, Artificial sequence
  synthetic polynucleotide sequence
ggagcgcaagaggcggaa

SEQ ID NO: 9324 - DNA, 17 bp, Artificial sequence
  synthetic polynucleotide sequence
ccccaccagggcttgca

SEQ ID NO: 9325 - DNA, 18 bp, Artificial sequence
  synthetic polynucleotide sequence
cttggcgctgagggacca

SEQ ID NO: 9326 - DNA, 18 bp, Artificial sequence
  synthetic polynucleotide sequence
gctgctgccggcatcgga

SEQ ID NO: 9327 - DNA, 18 bp, Artificial sequence
  synthetic polynucleotide sequence
tctcacgctcagggacca

SEQ ID NO: 9328 - DNA, 18 bp, Artificial sequence
  synthetic polynucleotide sequence
cggcctggagggagtgga

SEQ ID NO: 9329 - DNA, 18 bp, Artificial sequence
  synthetic polynucleotide sequence
cttggcaaggcgagtcca

SEQ ID NO: 9330 - DNA, 18 bp, Artificial sequence
  synthetic polynucleotide sequence
agaagcgactgatcccca

SEQ ID NO: 9331 - DNA, 18 bp, Artificial sequence
  synthetic polynucleotide sequence
caccacttcctccacgca

SEQ ID NO: 9332 - DNA, 18 bp, Artificial sequence
  synthetic polynucleotide sequence
gctaaggaaggaggagca

SEQ ID NO: 9333 - DNA, 18 bp, Artificial sequence
  synthetic polynucleotide sequence
cagggccagtgcttcaca

SEQ ID NO: 9334 - DNA, 18 bp, Artificial sequence
  synthetic polynucleotide sequence
ttacccgaacccaggcca

SEQ ID NO: 9335 - DNA, 18 bp, Artificial sequence
  synthetic polynucleotide sequence
cggcatagcgagcagaga

SEQ ID NO: 9336 - DNA, 18 bp, Artificial sequence
  synthetic polynucleotide sequence
cggcatagcgagcagaga

SEQ ID NO: 9337 - DNA, 18 bp, Artificial sequence
  synthetic polynucleotide sequence
acgcaacaccacgcccaa

SEQ ID NO: 9338 - DNA, 18 bp, Artificial sequence
  synthetic polynucleotide sequence
tccagcaccaggaacgca

SEQ ID NO: 9339 - DNA, 18 bp, Artificial sequence
  synthetic polynucleotide sequence
ggaaagacgtggagggca

SEQ ID NO: 9340 - DNA, 18 bp, Artificial sequence
  synthetic polynucleotide sequence
gggacaatgcagcggaca

SEQ ID NO: 9341 - DNA, 18 bp, Artificial sequence
  synthetic polynucleotide sequence
ggaagcccgcaatgcaga

SEQ ID NO: 9342 - DNA, 18 bp, Artificial sequence
  synthetic polynucleotide sequence
tcccacccttcagggcca

SEQ ID NO: 9343 - DNA, 18 bp, Artificial sequence
  synthetic polynucleotide sequence
tgcagcgggtcaagcaga

SEQ ID NO: 9344 - DNA, 18 bp, Artificial sequence
  synthetic polynucleotide sequence
cctccagggttcggcaga

SEQ ID NO: 9345 - DNA, 18 bp, Artificial sequence
  synthetic polynucleotide sequence
ctcagctatcccgaggca

SEQ ID NO: 9346 - DNA, 18 bp, Artificial sequence
  synthetic polynucleotide sequence
cgcagcaggtcacagtca

SEQ ID NO: 9347 - DNA, 18 bp, Artificial sequence
  synthetic polynucleotide sequence
tctgcagcgagtccacca

SEQ ID NO: 9348 - DNA, 18 bp, Artificial sequence
  synthetic polynucleotide sequence
ggcagagatcgagcggaa

SEQ ID NO: 9349 - DNA, 18 bp, Artificial sequence
  synthetic polynucleotide sequence
cttccaaggtccggcaca

SEQ ID NO: 9350 - DNA, 18 bp, Artificial sequence
  synthetic polynucleotide sequence
tgcagcgggtgaagcaga

SEQ ID NO: 9351 - DNA, 18 bp, Artificial sequence
  synthetic polynucleotide sequence
cggcattgaaggcacgga

SEQ ID NO: 9352 - DNA, 18 bp, Artificial sequence
  synthetic polynucleotide sequence
gcaggaaggccacagaga

SEQ ID NO: 9353 - DNA, 18 bp, Artificial sequence
  synthetic polynucleotide sequence
tggacacgctcactggca

SEQ ID NO: 9354 - DNA, 18 bp, Artificial sequence
  synthetic polynucleotide sequence
tggacacgctcactggca

SEQ ID NO: 9355 - DNA, 18 bp, Artificial sequence
  synthetic polynucleotide sequence
gcccaagcagctgaagga

SEQ ID NO: 9356 - DNA, 18 bp, Artificial sequence
  synthetic polynucleotide sequence
ccttccacagctccgaga

SEQ ID NO: 9357 - DNA, 18 bp, Artificial sequence
  synthetic polynucleotide sequence
atgaggctccaggcccca

SEQ ID NO: 9358 - DNA, 18 bp, Artificial sequence
  synthetic polynucleotide sequence
ctgtaaaccgatccccca

SEQ ID NO: 9359 - DNA, 18 bp, Artificial sequence
  synthetic polynucleotide sequence
tcagcgtgcaacatccaa

SEQ ID NO: 9360 - DNA, 18 bp, Artificial sequence
  synthetic polynucleotide sequence
tccctagagaagcaagca

SEQ ID NO: 9361 - DNA, 18 bp, Artificial sequence
  synthetic polynucleotide sequence
cggaccctgaggaaacca

SEQ ID NO: 9362 - DNA, 18 bp, Artificial sequence
  synthetic polynucleotide sequence
ccgcctgcgtggtcagca

SEQ ID NO: 9363 - DNA, 18 bp, Artificial sequence
  synthetic polynucleotide sequence
cacaggcacctatgagga

SEQ ID NO: 9364 - DNA, 18 bp, Artificial sequence
  synthetic polynucleotide sequence
gtggccagcacgtggcga

SEQ ID NO: 9365 - DNA, 18 bp, Artificial sequence
  synthetic polynucleotide sequence
ctcccagggtggcaagga

SEQ ID NO: 9366 - DNA, 18 bp, Artificial sequence
  synthetic polynucleotide sequence
caaggagcagggcaccta

SEQ ID NO: 9367 - DNA, 18 bp, Artificial sequence
  synthetic polynucleotide sequence
acatgcggaaggcactca

SEQ ID NO: 9368 - DNA, 18 bp, Artificial sequence
  synthetic polynucleotide sequence
gagtgtcccagaggagga

SEQ ID NO: 9369 - DNA, 18 bp, Artificial sequence
  synthetic polynucleotide sequence
tggtgagcagctcccgga

SEQ ID NO: 9370 - DNA, 18 bp, Artificial sequence
  synthetic polynucleotide sequence
gaagctgaacggcacgga

SEQ ID NO: 9371 - DNA, 18 bp, Artificial sequence
  synthetic polynucleotide sequence
acacctggcactggagca

SEQ ID NO: 9372 - DNA, 18 bp, Artificial sequence
  synthetic polynucleotide sequence
acacctggcactggagca

SEQ ID NO: 9373 - DNA, 18 bp, Artificial sequence
  synthetic polynucleotide sequence
ctcggaggaggccaagga

SEQ ID NO: 9374 - DNA, 18 bp, Artificial sequence
  synthetic polynucleotide sequence
tcctgggcatcagagcca

SEQ ID NO: 9375 - DNA, 18 bp, Artificial sequence
  synthetic polynucleotide sequence
gaggatgtgatcaccgga

SEQ ID NO: 9376 - DNA, 18 bp, Artificial sequence
  synthetic polynucleotide sequence
cacactgcgtggtcagca

SEQ ID NO: 9377 - DNA, 18 bp, Artificial sequence
  synthetic polynucleotide sequence
ggtcagcactgcacgaga

SEQ ID NO: 9378 - DNA, 18 bp, Artificial sequence
  synthetic polynucleotide sequence
tgatgcccacgtgggaca

SEQ ID NO: 9379 - DNA, 18 bp, Artificial sequence
  synthetic polynucleotide sequence
cacacagcgaggaagcca

SEQ ID NO: 9380 - DNA, 18 bp, Artificial sequence
  synthetic polynucleotide sequence
gcctcagccgagtcacca

SEQ ID NO: 9381 - DNA, 18 bp, Artificial sequence
  synthetic polynucleotide sequence
gaagcaacgcctggagga

SEQ ID NO: 9382 - DNA, 18 bp, Artificial sequence
  synthetic polynucleotide sequence
ctcctgtaccaggcggca

SEQ ID NO: 9383 - DNA, 18 bp, Artificial sequence
  synthetic polynucleotide sequence
agggctgatactccggca

SEQ ID NO: 9384 - DNA, 18 bp, Artificial sequence
  synthetic polynucleotide sequence
gctaaacctgaggcggca

SEQ ID NO: 9385 - DNA, 18 bp, Artificial sequence
  synthetic polynucleotide sequence
tagtcgacccgtccacca

SEQ ID NO: 9386 - DNA, 18 bp, Artificial sequence
  synthetic polynucleotide sequence
cgctcaggacacagacga

SEQ ID NO: 9387 - DNA, 18 bp, Artificial sequence
  synthetic polynucleotide sequence
cacacttgggcgtcagga

SEQ ID NO: 9388 - DNA, 18 bp, Artificial sequence
  synthetic polynucleotide sequence
gaggagatgcgggaggaa

SEQ ID NO: 9389 - DNA, 18 bp, Artificial sequence
  synthetic polynucleotide sequence
agcacagccccgaagcca

SEQ ID NO: 9390 - DNA, 18 bp, Artificial sequence
  synthetic polynucleotide sequence
agcacagccccgaagcca

SEQ ID NO: 9391 - DNA, 18 bp, Artificial sequence
  synthetic polynucleotide sequence
tacccggcaccgtcggaa

SEQ ID NO: 9392 - DNA, 18 bp, Artificial sequence
  synthetic polynucleotide sequence
aggtcagctagtggagga

SEQ ID NO: 9393 - DNA, 18 bp, Artificial sequence
  synthetic polynucleotide sequence
tgaggaggaggtggagca

SEQ ID NO: 9394 - DNA, 18 bp, Artificial sequence
  synthetic polynucleotide sequence
gcagtagcgtctggcaga

SEQ ID NO: 9395 - DNA, 18 bp, Artificial sequence
  synthetic polynucleotide sequence
gtcctcaggacccaagga

SEQ ID NO: 9396 - DNA, 18 bp, Artificial sequence
  synthetic polynucleotide sequence
gagagtctgcgtagcgca

SEQ ID NO: 9397 - DNA, 18 bp, Artificial sequence
  synthetic polynucleotide sequence
cctgacaccactgaccca

SEQ ID NO: 9398 - DNA, 18 bp, Artificial sequence
  synthetic polynucleotide sequence
gacacagaaggcaaccga

SEQ ID NO: 9399 - DNA, 18 bp, Artificial sequence
  synthetic polynucleotide sequence
gttcccagaagacgccca

SEQ ID NO: 9400 - DNA, 18 bp, Artificial sequence
  synthetic polynucleotide sequence
ccaggttgctgacgacga

SEQ ID NO: 9401 - DNA, 18 bp, Artificial sequence
  synthetic polynucleotide sequence
ggtgtacaaggtgccaca

SEQ ID NO: 9402 - DNA, 18 bp, Artificial sequence
  synthetic polynucleotide sequence
cagcaccgatgaggccaa

SEQ ID NO: 9403 - DNA, 18 bp, Artificial sequence
  synthetic polynucleotide sequence
agaaggtcacccaccgga

SEQ ID NO: 9404 - DNA, 18 bp, Artificial sequence
  synthetic polynucleotide sequence
gagcctcctcctgagaga

SEQ ID NO: 9405 - DNA, 18 bp, Artificial sequence
  synthetic polynucleotide sequence
cacgatggaggtgaggga

SEQ ID NO: 9406 - DNA, 18 bp, Artificial sequence
  synthetic polynucleotide sequence
gagttcagcgccaaccca

SEQ ID NO: 9407 - DNA, 18 bp, Artificial sequence
  synthetic polynucleotide sequence
ggacgggtctctgccaca

SEQ ID NO: 9408 - DNA, 18 bp, Artificial sequence
  synthetic polynucleotide sequence
ggacgggtctctgccaca

SEQ ID NO: 9409 - DNA, 18 bp, Artificial sequence
  synthetic polynucleotide sequence
ggaaaccctgaccccgaa

SEQ ID NO: 9410 - DNA, 18 bp, Artificial sequence
  synthetic polynucleotide sequence
gctccaccttcaccgaga

SEQ ID NO: 9411 - DNA, 18 bp, Artificial sequence
  synthetic polynucleotide sequence
gcccatcagggtcaagca

SEQ ID NO: 9412 - DNA, 18 bp, Artificial sequence
  synthetic polynucleotide sequence
ggtccaggaagtagccca

SEQ ID NO: 9413 - DNA, 18 bp, Artificial sequence
  synthetic polynucleotide sequence
ataaccagtccccagcca

SEQ ID NO: 9414 - DNA, 18 bp, Artificial sequence
  synthetic polynucleotide sequence
aggttggccagctgagga

SEQ ID NO: 9415 - DNA, 18 bp, Artificial sequence
  synthetic polynucleotide sequence
agaaggcctccaaacgca

SEQ ID NO: 9416 - DNA, 18 bp, Artificial sequence
  synthetic polynucleotide sequence
gtctacaggctccccaga

SEQ ID NO: 9417 - DNA, 18 bp, Artificial sequence
  synthetic polynucleotide sequence
gtactggaagggccagca

SEQ ID NO: 9418 - DNA, 18 bp, Artificial sequence
  synthetic polynucleotide sequence
tgaggcagacggagtcca

SEQ ID NO: 9419 - DNA, 18 bp, Artificial sequence
  synthetic polynucleotide sequence
acagcctggtgtaggaca

SEQ ID NO: 9420 - DNA, 18 bp, Artificial sequence
  synthetic polynucleotide sequence
tagacatctccagcccca

SEQ ID NO: 9421 - DNA, 18 bp, Artificial sequence
  synthetic polynucleotide sequence
ggagtcccagctaaggga

SEQ ID NO: 9422 - DNA, 18 bp, Artificial sequence
  synthetic polynucleotide sequence
gctgcagcagctgaccaa

SEQ ID NO: 9423 - DNA, 18 bp, Artificial sequence
  synthetic polynucleotide sequence
tcggaggcctctccacca

SEQ ID NO: 9424 - DNA, 18 bp, Artificial sequence
  synthetic polynucleotide sequence
gcaacctcacctccagca

SEQ ID NO: 9425 - DNA, 18 bp, Artificial sequence
  synthetic polynucleotide sequence
tgcaggcatcacagcgca

SEQ ID NO: 9426 - DNA, 18 bp, Artificial sequence
  synthetic polynucleotide sequence
tgcaggcatcacagcgca

SEQ ID NO: 9427 - DNA, 18 bp, Artificial sequence
  synthetic polynucleotide sequence
gcttgggaaatgaagcca

SEQ ID NO: 9428 - DNA, 18 bp, Artificial sequence
  synthetic polynucleotide sequence
cgatccaacatctgagca

SEQ ID NO: 9429 - DNA, 18 bp, Artificial sequence
  synthetic polynucleotide sequence
gaattggcaactgagcca

SEQ ID NO: 9430 - DNA, 18 bp, Artificial sequence
  synthetic polynucleotide sequence
gggcactcacacatgcga

SEQ ID NO: 9431 - DNA, 18 bp, Artificial sequence
  synthetic polynucleotide sequence
ggccaaaatggaggagga

SEQ ID NO: 9432 - DNA, 18 bp, Artificial sequence
  synthetic polynucleotide sequence
gcttctgggccaggccga

SEQ ID NO: 9433 - DNA, 18 bp, Artificial sequence
  synthetic polynucleotide sequence
ggacggagagcgcgagga

SEQ ID NO: 9434 - DNA, 17 bp, Artificial sequence
  synthetic polynucleotide sequence
gcagaggaagcagccga

SEQ ID NO: 9435 - DNA, 18 bp, Artificial sequence
  synthetic polynucleotide sequence
aagactccagaggccaca

SEQ ID NO: 9436 - DNA, 18 bp, Artificial sequence
  synthetic polynucleotide sequence
atcagccagctgacggga

SEQ ID NO: 9437 - DNA, 18 bp, Artificial sequence
  synthetic polynucleotide sequence
cagtcaccagaggcccca

SEQ ID NO: 9438 - DNA, 18 bp, Artificial sequence
  synthetic polynucleotide sequence
cagccaggatctacccca

SEQ ID NO: 9439 - DNA, 18 bp, Artificial sequence
  synthetic polynucleotide sequence
tcctgcgaccctccacca

SEQ ID NO: 9440 - DNA, 18 bp, Artificial sequence
  synthetic polynucleotide sequence
gaagccacctctcgcaga

SEQ ID NO: 9441 - DNA, 18 bp, Artificial sequence
  synthetic polynucleotide sequence
ccgaagacccagtttgga

SEQ ID NO: 9442 - DNA, 18 bp, Artificial sequence
  synthetic polynucleotide sequence
caagcccagctggcggca

SEQ ID NO: 9443 - DNA, 18 bp, Artificial sequence
  synthetic polynucleotide sequence
gatgtccgcactggagca

SEQ ID NO: 9444 - DNA, 18 bp, Artificial sequence
  synthetic polynucleotide sequence
gatgtccgcactggagca

SEQ ID NO: 9445 - DNA, 18 bp, Artificial sequence
  synthetic polynucleotide sequence
gcatccagggacgcagga

SEQ ID NO: 9446 - DNA, 18 bp, Artificial sequence
  synthetic polynucleotide sequence
agggaggagtggtagcga

SEQ ID NO: 9447 - DNA, 18 bp, Artificial sequence
  synthetic polynucleotide sequence
aggtgctcagcagggaga

SEQ ID NO: 9448 - DNA, 18 bp, Artificial sequence
  synthetic polynucleotide sequence
tcttccacacagagccca

SEQ ID NO: 9449 - DNA, 18 bp, Artificial sequence
  synthetic polynucleotide sequence
gacctcactcggcaggca

SEQ ID NO: 9450 - DNA, 18 bp, Artificial sequence
  synthetic polynucleotide sequence
gcagcagctcataggcca

SEQ ID NO: 9451 - DNA, 18 bp, Artificial sequence
  synthetic polynucleotide sequence
cccctctaactgcagcca

SEQ ID NO: 9452 - DNA, 18 bp, Artificial sequence
  synthetic polynucleotide sequence
atgccagccaaggggaca

SEQ ID NO: 9453 - DNA, 18 bp, Artificial sequence
  synthetic polynucleotide sequence
cctggtgtgcaacgccga

SEQ ID NO: 9454 - DNA, 18 bp, Artificial sequence
  synthetic polynucleotide sequence
ggtgatgacggccgagga

SEQ ID NO: 9455 - DNA, 18 bp, Artificial sequence
  synthetic polynucleotide sequence
cggtcaccatgctcagga

SEQ ID NO: 9456 - DNA, 18 bp, Artificial sequence
  synthetic polynucleotide sequence
ctcaacagccaccaccca

SEQ ID NO: 9457 - DNA, 18 bp, Artificial sequence
  synthetic polynucleotide sequence
aacctccaccagaaccga

SEQ ID NO: 9458 - DNA, 18 bp, Artificial sequence
  synthetic polynucleotide sequence
agaagtacacaggcacca

SEQ ID NO: 9459 - DNA, 20 bp, Artificial sequence
  synthetic polynucleotide sequence
acacacagctgggtggaaga

SEQ ID NO: 9460 - DNA, 18 bp, Artificial sequence
  synthetic polynucleotide sequence
ccaccagtcccaaaggca

SEQ ID NO: 9461 - DNA, 18 bp, Artificial sequence
  synthetic polynucleotide sequence
tagcggcgcagcacggga

SEQ ID NO: 9462 - DNA, 18 bp, Artificial sequence
  synthetic polynucleotide sequence
tagcggcgcagcacggga

SEQ ID NO: 9463 - DNA, 19 bp, Artificial sequence
  synthetic polynucleotide sequence
ccaagagattgaggagcca

SEQ ID NO: 9464 - DNA, 19 bp, Artificial sequence
  synthetic polynucleotide sequence
cacacgtagtgcctcagga

SEQ ID NO: 9465 - DNA, 18 bp, Artificial sequence
  synthetic polynucleotide sequence
ggaggcctcaatgcagga

SEQ ID NO: 9466 - DNA, 18 bp, Artificial sequence
  synthetic polynucleotide sequence
gcaggtaactctagcaca

SEQ ID NO: 9467 - DNA, 18 bp, Artificial sequence
  synthetic polynucleotide sequence
gtgcacagatagaagcca

SEQ ID NO: 9468 - DNA, 18 bp, Artificial sequence
  synthetic polynucleotide sequence
ggctgatagagaacagca

SEQ ID NO: 9469 - DNA, 18 bp, Artificial sequence
  synthetic polynucleotide sequence
aggaggaggaggacgaca

SEQ ID NO: 9470 - DNA, 18 bp, Artificial sequence
  synthetic polynucleotide sequence
ctgaggggctcgccagga

SEQ ID NO: 9471 - DNA, 18 bp, Artificial sequence
  synthetic polynucleotide sequence
cgaacaggtggggaccaa

SEQ ID NO: 9472 - DNA, 18 bp, Artificial sequence
  synthetic polynucleotide sequence
gcattcccgggaatcaga

SEQ ID NO: 9473 - DNA, 18 bp, Artificial sequence
  synthetic polynucleotide sequence
ctcctcccaccagtccaa

SEQ ID NO: 9474 - DNA, 18 bp, Artificial sequence
  synthetic polynucleotide sequence
tacatgggtccaaagcga

SEQ ID NO: 9475 - DNA, 18 bp, Artificial sequence
  synthetic polynucleotide sequence
ctcaggcccagcttagca

SEQ ID NO: 9476 - DNA, 18 bp, Artificial sequence
  synthetic polynucleotide sequence
aaagatgtgtccgggaga

SEQ ID NO: 9477 - DNA, 18 bp, Artificial sequence
  synthetic polynucleotide sequence
cggacaagcagaggcgga

SEQ ID NO: 9478 - DNA, 18 bp, Artificial sequence
  synthetic polynucleotide sequence
ccctcatcacaggaccca

SEQ ID NO: 9479 - DNA, 18 bp, Artificial sequence
  synthetic polynucleotide sequence
atcctccagcacaggcga

SEQ ID NO: 9480 - DNA, 18 bp, Artificial sequence
  synthetic polynucleotide sequence
atcctccagcacaggcga

SEQ ID NO: 9481 - DNA, 18 bp, Artificial sequence
  synthetic polynucleotide sequence
gtgaaggaggctgaagga

SEQ ID NO: 9482 - DNA, 18 bp, Artificial sequence
  synthetic polynucleotide sequence
ggcaatcatggagactga

SEQ ID NO: 9483 - DNA, 18 bp, Artificial sequence
  synthetic polynucleotide sequence
gaccattgatggcaggaa

SEQ ID NO: 9484 - DNA, 18 bp, Artificial sequence
  synthetic polynucleotide sequence
aacggaagacacaaggca

SEQ ID NO: 9485 - DNA, 18 bp, Artificial sequence
  synthetic polynucleotide sequence
catggggaagccagccca

SEQ ID NO: 9486 - DNA, 18 bp, Artificial sequence
  synthetic polynucleotide sequence
ccccaagagaagagccga

SEQ ID NO: 9487 - DNA, 18 bp, Artificial sequence
  synthetic polynucleotide sequence
gcacagacatgtctgaca

SEQ ID NO: 9488 - DNA, 18 bp, Artificial sequence
  synthetic polynucleotide sequence
caggcagagctcctacca

SEQ ID NO: 9489 - DNA, 18 bp, Artificial sequence
  synthetic polynucleotide sequence
gcagttacggcctgagga

SEQ ID NO: 9490 - DNA, 18 bp, Artificial sequence
  synthetic polynucleotide sequence
agcgggtcaccttcagca

SEQ ID NO: 9491 - DNA, 18 bp, Artificial sequence
  synthetic polynucleotide sequence
catgatggctgaggggga

SEQ ID NO: 9492 - DNA, 18 bp, Artificial sequence
  synthetic polynucleotide sequence
ctctgcaggcagcaagga

SEQ ID NO: 9493 - DNA, 18 bp, Artificial sequence
  synthetic polynucleotide sequence
cctgaacgcatctcagca

SEQ ID NO: 9494 - DNA, 18 bp, Artificial sequence
  synthetic polynucleotide sequence
gcatcaacccattagcca

SEQ ID NO: 9495 - DNA, 18 bp, Artificial sequence
  synthetic polynucleotide sequence
gggcactccagcgtcaca

SEQ ID NO: 9496 - DNA, 18 bp, Artificial sequence
  synthetic polynucleotide sequence
ccccaacaccttcccaca

SEQ ID NO: 9497 - DNA, 18 bp, Artificial sequence
  synthetic polynucleotide sequence
agacaactgcggaactca

SEQ ID NO: 9498 - DNA, 18 bp, Artificial sequence
  synthetic polynucleotide sequence
agacaactgcggaactca

SEQ ID NO: 9499 - DNA, 18 bp, Artificial sequence
  synthetic polynucleotide sequence
gcagtgagtcagaggcca

SEQ ID NO: 9500 - DNA, 18 bp, Artificial sequence
  synthetic polynucleotide sequence
tcacacacaatcacggca

SEQ ID NO: 9501 - DNA, 18 bp, Artificial sequence
  synthetic polynucleotide sequence
gctctccagaacccgcca

SEQ ID NO: 9502 - DNA, 18 bp, Artificial sequence
  synthetic polynucleotide sequence
gccctgcagacataagga

SEQ ID NO: 9503 - DNA, 18 bp, Artificial sequence
  synthetic polynucleotide sequence
ggggtcttcgacacagca

SEQ ID NO: 9504 - DNA, 18 bp, Artificial sequence
  synthetic polynucleotide sequence
gctgtacactgagggcca

SEQ ID NO: 9505 - DNA, 18 bp, Artificial sequence
  synthetic polynucleotide sequence
gaccaccatggaggagga

SEQ ID NO: 9506 - DNA, 18 bp, Artificial sequence
  synthetic polynucleotide sequence
tctcgcagatgccacgga

SEQ ID NO: 9507 - DNA, 18 bp, Artificial sequence
  synthetic polynucleotide sequence
tgacactccagaagccca

SEQ ID NO: 9508 - DNA, 18 bp, Artificial sequence
  synthetic polynucleotide sequence
cggagagcgctgtcagca

SEQ ID NO: 9509 - DNA, 18 bp, Artificial sequence
  synthetic polynucleotide sequence
gaggccagcatggaacga

SEQ ID NO: 9510 - DNA, 18 bp, Artificial sequence
  synthetic polynucleotide sequence
ggagacagagctgagcca

SEQ ID NO: 9511 - DNA, 18 bp, Artificial sequence
  synthetic polynucleotide sequence
actgctggaacacggcca

SEQ ID NO: 9512 - DNA, 18 bp, Artificial sequence
  synthetic polynucleotide sequence
tagagaggctgcagcaga

SEQ ID NO: 9513 - DNA, 18 bp, Artificial sequence
  synthetic polynucleotide sequence
cggagcgggcatccagca

SEQ ID NO: 9514 - DNA, 18 bp, Artificial sequence
  synthetic polynucleotide sequence
gcccgtctaaactggaca

SEQ ID NO: 9515 - DNA, 18 bp, Artificial sequence
  synthetic polynucleotide sequence
acaccacagagtcaggca

SEQ ID NO: 9516 - DNA, 18 bp, Artificial sequence
  synthetic polynucleotide sequence
acaccacagagtcaggca

SEQ ID NO: 9517 - DNA, 18 bp, Artificial sequence
  synthetic polynucleotide sequence
ggagctcacaaggcggga

SEQ ID NO: 9518 - DNA, 18 bp, Artificial sequence
  synthetic polynucleotide sequence
tcatccgacagcagccga

SEQ ID NO: 9519 - DNA, 18 bp, Artificial sequence
  synthetic polynucleotide sequence
gcagctacaacgggcaga

SEQ ID NO: 9520 - DNA, 18 bp, Artificial sequence
  synthetic polynucleotide sequence
cacatgcagcacgcggga

SEQ ID NO: 9521 - DNA, 18 bp, Artificial sequence
  synthetic polynucleotide sequence
ccctgctatagaagggca

SEQ ID NO: 9522 - DNA, 18 bp, Artificial sequence
  synthetic polynucleotide sequence
tggaggatgcaagcgcca

SEQ ID NO: 9523 - DNA, 18 bp, Artificial sequence
  synthetic polynucleotide sequence
tgcagctgggccaggaga

SEQ ID NO: 9524 - DNA, 18 bp, Artificial sequence
  synthetic polynucleotide sequence
taggtggaaggcccgaga

SEQ ID NO: 9525 - DNA, 18 bp, Artificial sequence
  synthetic polynucleotide sequence
gcgagggacatgcagaca

SEQ ID NO: 9526 - DNA, 18 bp, Artificial sequence
  synthetic polynucleotide sequence
gtgtccaagggcagccca

SEQ ID NO: 9527 - DNA, 18 bp, Artificial sequence
  synthetic polynucleotide sequence
cggcctcctctaccacca

SEQ ID NO: 9528 - DNA, 18 bp, Artificial sequence
  synthetic polynucleotide sequence
aagctgccaaggaggcca

SEQ ID NO: 9529 - DNA, 18 bp, Artificial sequence
  synthetic polynucleotide sequence
gtacactggacgtcagca

SEQ ID NO: 9530 - DNA, 18 bp, Artificial sequence
  synthetic polynucleotide sequence
cccgcactgagacacaca

SEQ ID NO: 9531 - DNA, 18 bp, Artificial sequence
  synthetic polynucleotide sequence
ggccaagtccacagggga

SEQ ID NO: 9532 - DNA, 18 bp, Artificial sequence
  synthetic polynucleotide sequence
gcagctgctgaccaccaa

SEQ ID NO: 9533 - DNA, 18 bp, Artificial sequence
  synthetic polynucleotide sequence
gattctgggagggaccca

SEQ ID NO: 9534 - DNA, 18 bp, Artificial sequence
  synthetic polynucleotide sequence
gattctgggagggaccca

SEQ ID NO: 9535 - DNA, 18 bp, Artificial sequence
  synthetic polynucleotide sequence
gatgcctgtggaacccaa

SEQ ID NO: 9536 - DNA, 18 bp, Artificial sequence
  synthetic polynucleotide sequence
cctgataagccactccga

SEQ ID NO: 9537 - DNA, 18 bp, Artificial sequence
  synthetic polynucleotide sequence
gccaagggctagacacca

SEQ ID NO: 9538 - DNA, 18 bp, Artificial sequence
  synthetic polynucleotide sequence
agcgtacactggtgggga

SEQ ID NO: 9539 - DNA, 18 bp, Artificial sequence
  synthetic polynucleotide sequence
caaagcgcaggaagagca

SEQ ID NO: 9540 - DNA, 18 bp, Artificial sequence
  synthetic polynucleotide sequence
caggaaggcgtcgggcca

SEQ ID NO: 9541 - DNA, 18 bp, Artificial sequence
  synthetic polynucleotide sequence
tgtccagaggctcaccca

SEQ ID NO: 9542 - DNA, 18 bp, Artificial sequence
  synthetic polynucleotide sequence
acgacagggtccacccca

SEQ ID NO: 9543 - DNA, 18 bp, Artificial sequence
  synthetic polynucleotide sequence
acaaccagccctccgaca

SEQ ID NO: 9544 - DNA, 18 bp, Artificial sequence
  synthetic polynucleotide sequence
ggtcatagcgctggcaga

SEQ ID NO: 9545 - DNA, 18 bp, Artificial sequence
  synthetic polynucleotide sequence
gccagtcttcaaccagga

SEQ ID NO: 9546 - DNA, 18 bp, Artificial sequence
  synthetic polynucleotide sequence
gggatcacactgcccaga

SEQ ID NO: 9547 - DNA, 18 bp, Artificial sequence
  synthetic polynucleotide sequence
cccacggccacagagaga

SEQ ID NO: 9548 - DNA, 18 bp, Artificial sequence
  synthetic polynucleotide sequence
tcgggacagggaatggga

SEQ ID NO: 9549 - DNA, 18 bp, Artificial sequence
  synthetic polynucleotide sequence
ctggaggaggttcccaga

SEQ ID NO: 9550 - DNA, 18 bp, Artificial sequence
  synthetic polynucleotide sequence
gccttgcgagacaaccca

SEQ ID NO: 9551 - DNA, 18 bp, Artificial sequence
  synthetic polynucleotide sequence
gtagagcttgaaggccca

SEQ ID NO: 9552 - DNA, 18 bp, Artificial sequence
  synthetic polynucleotide sequence
gtagagcttgaaggccca

SEQ ID NO: 9553 - DNA, 18 bp, Artificial sequence
  synthetic polynucleotide sequence
ccgagagcagtgccagga

SEQ ID NO: 9554 - DNA, 18 bp, Artificial sequence
  synthetic polynucleotide sequence
cgtgcagtagaacgcaca

SEQ ID NO: 9555 - DNA, 18 bp, Artificial sequence
  synthetic polynucleotide sequence
ccagaggcaaagaagcga

SEQ ID NO: 9556 - DNA, 18 bp, Artificial sequence
  synthetic polynucleotide sequence
acaaggcagttggcacca

SEQ ID NO: 9557 - DNA, 18 bp, Artificial sequence
  synthetic polynucleotide sequence
agcactgtcctcaagcaa

SEQ ID NO: 9558 - DNA, 18 bp, Artificial sequence
  synthetic polynucleotide sequence
accggtaggtggcagtga

SEQ ID NO: 9559 - DNA, 18 bp, Artificial sequence
  synthetic polynucleotide sequence
ctggagattgagcgacca

SEQ ID NO: 9560 - DNA, 18 bp, Artificial sequence
  synthetic polynucleotide sequence
gaagtgacgctggaacca

SEQ ID NO: 9561 - DNA, 18 bp, Artificial sequence
  synthetic polynucleotide sequence
aactggaccccacccaga

SEQ ID NO: 9562 - DNA, 18 bp, Artificial sequence
  synthetic polynucleotide sequence
cagagaggctgtacgaga

SEQ ID NO: 9563 - DNA, 18 bp, Artificial sequence
  synthetic polynucleotide sequence
aggagtgcaggaagcgca

SEQ ID NO: 9564 - DNA, 18 bp, Artificial sequence
  synthetic polynucleotide sequence
gcggcctcttcacacaca

SEQ ID NO: 9565 - DNA, 18 bp, Artificial sequence
  synthetic polynucleotide sequence
ctccggcctagacagcga

SEQ ID NO: 9566 - DNA, 18 bp, Artificial sequence
  synthetic polynucleotide sequence
ctgcgtaccaacccagca

SEQ ID NO: 9567 - DNA, 18 bp, Artificial sequence
  synthetic polynucleotide sequence
caaggctctgagctccga

SEQ ID NO: 9568 - DNA, 18 bp, Artificial sequence
  synthetic polynucleotide sequence
gacccttcagaccgagca

SEQ ID NO: 9569 - DNA, 18 bp, Artificial sequence
  synthetic polynucleotide sequence
agcaggggtagatggcca

SEQ ID NO: 9570 - DNA, 18 bp, Artificial sequence
  synthetic polynucleotide sequence
agcaggggtagatggcca

SEQ ID NO: 9571 - DNA, 18 bp, Artificial sequence
  synthetic polynucleotide sequence
gaagcccctcgccaccga

SEQ ID NO: 9572 - DNA, 18 bp, Artificial sequence
  synthetic polynucleotide sequence
ggtcagcaagtgctccaa

SEQ ID NO: 9573 - DNA, 18 bp, Artificial sequence
  synthetic polynucleotide sequence
cagccagggcgtcaggga

SEQ ID NO: 9574 - DNA, 18 bp, Artificial sequence
  synthetic polynucleotide sequence
catcggagcattcgcgga

SEQ ID NO: 9575 - DNA, 18 bp, Artificial sequence
  synthetic polynucleotide sequence
gcccccattgagccccta

SEQ ID NO: 9576 - DNA, 18 bp, Artificial sequence
  synthetic polynucleotide sequence
ggctgggcacgtcgggca

SEQ ID NO: 9577 - DNA, 18 bp, Artificial sequence
  synthetic polynucleotide sequence
caggcaagccagcagaga

SEQ ID NO: 9578 - DNA, 18 bp, Artificial sequence
  synthetic polynucleotide sequence
gtccgaggacagctccca

SEQ ID NO: 9579 - DNA, 18 bp, Artificial sequence
  synthetic polynucleotide sequence
ctgtccaaggaagctgga

SEQ ID NO: 9580 - DNA, 18 bp, Artificial sequence
  synthetic polynucleotide sequence
ttccagcccaaggaacca

SEQ ID NO: 9581 - DNA, 18 bp, Artificial sequence
  synthetic polynucleotide sequence
acctgcaaggaagacaca

SEQ ID NO: 9582 - DNA, 18 bp, Artificial sequence
  synthetic polynucleotide sequence
gcctcctgcgagagcaga

SEQ ID NO: 9583 - DNA, 18 bp, Artificial sequence
  synthetic polynucleotide sequence
gaacccagtggtcccgca

SEQ ID NO: 9584 - DNA, 18 bp, Artificial sequence
  synthetic polynucleotide sequence
ccgaggtcgcagcttcca

SEQ ID NO: 9585 - DNA, 18 bp, Artificial sequence
  synthetic polynucleotide sequence
accacatgagtccgctga

SEQ ID NO: 9586 - DNA, 18 bp, Artificial sequence
  synthetic polynucleotide sequence
cgcacggactgctggaga

SEQ ID NO: 9587 - DNA, 18 bp, Artificial sequence
  synthetic polynucleotide sequence
gctcctacagctaccaca

SEQ ID NO: 9588 - DNA, 18 bp, Artificial sequence
  synthetic polynucleotide sequence
gctcctacagctaccaca

SEQ ID NO: 9589 - DNA, 18 bp, Artificial sequence
  synthetic polynucleotide sequence
agcccagctgaaacgaga

SEQ ID NO: 9590 - DNA, 18 bp, Artificial sequence
  synthetic polynucleotide sequence
cttgcataggcccaacga

SEQ ID NO: 9591 - DNA, 18 bp, Artificial sequence
  synthetic polynucleotide sequence
gaaactgcggctgcagca

SEQ ID NO: 9592 - DNA, 18 bp, Artificial sequence
  synthetic polynucleotide sequence
ccggctcccgagggctca

SEQ ID NO: 9593 - DNA, 18 bp, Artificial sequence
  synthetic polynucleotide sequence
cttccccgaacgcaagga

SEQ ID NO: 9594 - DNA, 18 bp, Artificial sequence
  synthetic polynucleotide sequence
gggcgcagtagtcccgca

SEQ ID NO: 9595 - DNA, 18 bp, Artificial sequence
  synthetic polynucleotide sequence
tgcactggcacctagaca

SEQ ID NO: 9596 - DNA, 18 bp, Artificial sequence
  synthetic polynucleotide sequence
aggctggtagacagggta

SEQ ID NO: 9597 - DNA, 18 bp, Artificial sequence
  synthetic polynucleotide sequence
ctgcaggaggaaacgcca

SEQ ID NO: 9598 - DNA, 18 bp, Artificial sequence
  synthetic polynucleotide sequence
accaccacagtgggggca

SEQ ID NO: 9599 - DNA, 18 bp, Artificial sequence
  synthetic polynucleotide sequence
gggaaaggggacgcagca

SEQ ID NO: 9600 - DNA, 17 bp, Artificial sequence
  synthetic polynucleotide sequence
gttgacgcccccacgga

SEQ ID NO: 9601 - DNA, 18 bp, Artificial sequence
  synthetic polynucleotide sequence
gcctcttccacaccagca

SEQ ID NO: 9602 - DNA, 18 bp, Artificial sequence
  synthetic polynucleotide sequence
ggcaaagatgtggcagca

SEQ ID NO: 9603 - DNA, 18 bp, Artificial sequence
  synthetic polynucleotide sequence
catctcctccacccggca

SEQ ID NO: 9604 - DNA, 18 bp, Artificial sequence
  synthetic polynucleotide sequence
ggacctgcggaagaccca

SEQ ID NO: 9605 - DNA, 18 bp, Artificial sequence
  synthetic polynucleotide sequence
cgtgagttgaagcgcaga

SEQ ID NO: 9606 - DNA, 18 bp, Artificial sequence
  synthetic polynucleotide sequence
cgtgagttgaagcgcaga

SEQ ID NO: 9607 - DNA, 18 bp, Artificial sequence
  synthetic polynucleotide sequence
cagtggtactgaggcaga

SEQ ID NO: 9608 - DNA, 18 bp, Artificial sequence
  synthetic polynucleotide sequence
cctggtcggaaccctgga

SEQ ID NO: 9609 - DNA, 18 bp, Artificial sequence
  synthetic polynucleotide sequence
gggagaaggtcacgcaca

SEQ ID NO: 9610 - DNA, 18 bp, Artificial sequence
  synthetic polynucleotide sequence
tcgcacgctatcacccga

SEQ ID NO: 9611 - DNA, 18 bp, Artificial sequence
  synthetic polynucleotide sequence
agctgcgccaacggagga

SEQ ID NO: 9612 - DNA, 18 bp, Artificial sequence
  synthetic polynucleotide sequence
ctcggccgtaggtgggca

SEQ ID NO: 9613 - DNA, 18 bp, Artificial sequence
  synthetic polynucleotide sequence
ggaccacccgctatgaca

SEQ ID NO: 9614 - DNA, 18 bp, Artificial sequence
  synthetic polynucleotide sequence
acgatggcatccacggga

SEQ ID NO: 9615 - DNA, 18 bp, Artificial sequence
  synthetic polynucleotide sequence
ccctgtgggagatcagca

SEQ ID NO: 9616 - DNA, 18 bp, Artificial sequence
  synthetic polynucleotide sequence
cggatcagaccctgcaca

SEQ ID NO: 9617 - DNA, 18 bp, Artificial sequence
  synthetic polynucleotide sequence
cggcctgaggagggctga

SEQ ID NO: 9618 - DNA, 18 bp, Artificial sequence
  synthetic polynucleotide sequence
acacaggagccagcccca

SEQ ID NO: 9619 - DNA, 18 bp, Artificial sequence
  synthetic polynucleotide sequence
cttgccaactcggaggca

SEQ ID NO: 9620 - DNA, 18 bp, Artificial sequence
  synthetic polynucleotide sequence
gtccctgacacacgccaa

SEQ ID NO: 9621 - DNA, 18 bp, Artificial sequence
  synthetic polynucleotide sequence
caggccattgaatcgaca

SEQ ID NO: 9622 - DNA, 18 bp, Artificial sequence
  synthetic polynucleotide sequence
ctaccaagaagcctccaa

SEQ ID NO: 9623 - DNA, 18 bp, Artificial sequence
  synthetic polynucleotide sequence
tacagggtgaaggaggca

SEQ ID NO: 9624 - DNA, 18 bp, Artificial sequence
  synthetic polynucleotide sequence
tacagggtgaaggaggca

SEQ ID NO: 9625 - DNA, 18 bp, Artificial sequence
  synthetic polynucleotide sequence
agtgccctactccaggga

SEQ ID NO: 9626 - DNA, 18 bp, Artificial sequence
  synthetic polynucleotide sequence
acagtcgagccttcagga

SEQ ID NO: 9627 - DNA, 18 bp, Artificial sequence
  synthetic polynucleotide sequence
gtcacagggacatcgcga

SEQ ID NO: 9628 - DNA, 18 bp, Artificial sequence
  synthetic polynucleotide sequence
ggaggtaagtcaaggcga

SEQ ID NO: 9629 - DNA, 18 bp, Artificial sequence
  synthetic polynucleotide sequence
aggcattgtcccaggcaa

SEQ ID NO: 9630 - DNA, 18 bp, Artificial sequence
  synthetic polynucleotide sequence
tgcatcagtccagaggca

SEQ ID NO: 9631 - DNA, 18 bp, Artificial sequence
  synthetic polynucleotide sequence
tatgcgctcagcgcagga

SEQ ID NO: 9632 - DNA, 18 bp, Artificial sequence
  synthetic polynucleotide sequence
gaggcaatgtcggcctga

SEQ ID NO: 9633 - DNA, 18 bp, Artificial sequence
  synthetic polynucleotide sequence
caacgtgacacaggagca

SEQ ID NO: 9634 - DNA, 18 bp, Artificial sequence
  synthetic polynucleotide sequence
ttaagaggcaggctcgca

SEQ ID NO: 9635 - DNA, 18 bp, Artificial sequence
  synthetic polynucleotide sequence
acagggcttgagcccgca

SEQ ID NO: 9636 - DNA, 18 bp, Artificial sequence
  synthetic polynucleotide sequence
gcttgctaaaggaacgga

SEQ ID NO: 9637 - DNA, 18 bp, Artificial sequence
  synthetic polynucleotide sequence
tagacagccaagagacca

SEQ ID NO: 9638 - DNA, 18 bp, Artificial sequence
  synthetic polynucleotide sequence
gcagtgcattggaacaca

SEQ ID NO: 9639 - DNA, 18 bp, Artificial sequence
  synthetic polynucleotide sequence
tccaactgcactggccga

SEQ ID NO: 9640 - DNA, 18 bp, Artificial sequence
  synthetic polynucleotide sequence
tccaaggccttgagggca

SEQ ID NO: 9641 - DNA, 18 bp, Artificial sequence
  synthetic polynucleotide sequence
gagatgggctgtcaggca

SEQ ID NO: 9642 - DNA, 18 bp, Artificial sequence
  synthetic polynucleotide sequence
gagatgggctgtcaggca

SEQ ID NO: 9643 - DNA, 18 bp, Artificial sequence
  synthetic polynucleotide sequence
gccactcacttgccccaa

SEQ ID NO: 9644 - DNA, 18 bp, Artificial sequence
  synthetic polynucleotide sequence
tgcagggagatccagcca

SEQ ID NO: 9645 - DNA, 18 bp, Artificial sequence
  synthetic polynucleotide sequence
gccctgaatgtgacccaa

SEQ ID NO: 9646 - DNA, 18 bp, Artificial sequence
  synthetic polynucleotide sequence
ccacatctgggcaaggca

SEQ ID NO: 9647 - DNA, 18 bp, Artificial sequence
  synthetic polynucleotide sequence
gtaaccagctggcagcca

SEQ ID NO: 9648 - DNA, 18 bp, Artificial sequence
  synthetic polynucleotide sequence
ctaggcgacttcgaggga

SEQ ID NO: 9649 - DNA, 18 bp, Artificial sequence
  synthetic polynucleotide sequence
tgcactctcagagggaca

SEQ ID NO: 9650 - DNA, 18 bp, Artificial sequence
  synthetic polynucleotide sequence
ggacagctgtgatccaca

SEQ ID NO: 9651 - DNA, 18 bp, Artificial sequence
  synthetic polynucleotide sequence
gcgtcaaacaaagcagga

SEQ ID NO: 9652 - DNA, 18 bp, Artificial sequence
  synthetic polynucleotide sequence
cagggcctgctcagggca

SEQ ID NO: 9653 - DNA, 18 bp, Artificial sequence
  synthetic polynucleotide sequence
atggggatctcgcagcga

SEQ ID NO: 9654 - DNA, 18 bp, Artificial sequence
  synthetic polynucleotide sequence
acacgaaccgtccgccga

SEQ ID NO: 9655 - DNA, 18 bp, Artificial sequence
  synthetic polynucleotide sequence
ggtgcaactccacgtgga

SEQ ID NO: 9656 - DNA, 18 bp, Artificial sequence
  synthetic polynucleotide sequence
gttccccgaggacgccaa

SEQ ID NO: 9657 - DNA, 18 bp, Artificial sequence
  synthetic polynucleotide sequence
gcgggactcaggctgcca

SEQ ID NO: 9658 - DNA, 18 bp, Artificial sequence
  synthetic polynucleotide sequence
cgacgcgaagctcaccaa

SEQ ID NO: 9659 - DNA, 18 bp, Artificial sequence
  synthetic polynucleotide sequence
agccagtttcccaggaca

SEQ ID NO: 9660 - DNA, 18 bp, Artificial sequence
  synthetic polynucleotide sequence
agccagtttcccaggaca

SEQ ID NO: 9661 - DNA, 18 bp, Artificial sequence
  synthetic polynucleotide sequence
ggagcgaagagccaagca

SEQ ID NO: 9662 - DNA, 20 bp, Artificial sequence
  synthetic polynucleotide sequence
cgaaagacaggctgtcacca

SEQ ID NO: 9663 - DNA, 18 bp, Artificial sequence
  synthetic polynucleotide sequence
tgggcacagagaaccaga

SEQ ID NO: 9664 - DNA, 18 bp, Artificial sequence
  synthetic polynucleotide sequence
cactcaggacactcagga

SEQ ID NO: 9665 - DNA, 18 bp, Artificial sequence
  synthetic polynucleotide sequence
gggacacccagatcagca

SEQ ID NO: 9666 - DNA, 18 bp, Artificial sequence
  synthetic polynucleotide sequence
accatcgcagtgtgggga

SEQ ID NO: 9667 - DNA, 18 bp, Artificial sequence
  synthetic polynucleotide sequence
gcagcagattcagcccaa

SEQ ID NO: 9668 - DNA, 18 bp, Artificial sequence
  synthetic polynucleotide sequence
ggcagctgactagaagca

SEQ ID NO: 9669 - DNA, 18 bp, Artificial sequence
  synthetic polynucleotide sequence
cgtggagaaagccccaga

SEQ ID NO: 9670 - DNA, 18 bp, Artificial sequence
  synthetic polynucleotide sequence
atggcgggatctcaacca

SEQ ID NO: 9671 - DNA, 18 bp, Artificial sequence
  synthetic polynucleotide sequence
atgagagccccgtgcgga

SEQ ID NO: 9672 - DNA, 18 bp, Artificial sequence
  synthetic polynucleotide sequence
ccatcaagacggagccca

SEQ ID NO: 9673 - DNA, 18 bp, Artificial sequence
  synthetic polynucleotide sequence
ggagacggtgatgaggca

SEQ ID NO: 9674 - DNA, 18 bp, Artificial sequence
  synthetic polynucleotide sequence
acaacagcttccccagca

SEQ ID NO: 9675 - DNA, 18 bp, Artificial sequence
  synthetic polynucleotide sequence
ctccgcccattggagaca

SEQ ID NO: 9676 - DNA, 18 bp, Artificial sequence
  synthetic polynucleotide sequence
ctgtccccgagtacagca

SEQ ID NO: 9677 - DNA, 18 bp, Artificial sequence
  synthetic polynucleotide sequence
ttcatggccaaggcccga

SEQ ID NO: 9678 - DNA, 18 bp, Artificial sequence
  synthetic polynucleotide sequence
ttcatggccaaggcccga

SEQ ID NO: 9679 - DNA, 18 bp, Artificial sequence
  synthetic polynucleotide sequence
ccgcatgagctaccagga

SEQ ID NO: 9680 - DNA, 18 bp, Artificial sequence
  synthetic polynucleotide sequence
tcggctgagtccagggca

SEQ ID NO: 9681 - DNA, 18 bp, Artificial sequence
  synthetic polynucleotide sequence
tgccacagtcaacacaga

SEQ ID NO: 9682 - DNA, 18 bp, Artificial sequence
  synthetic polynucleotide sequence
aagtagcaggtgagggca

SEQ ID NO: 9683 - DNA, 18 bp, Artificial sequence
  synthetic polynucleotide sequence
gctactacccagaaccca

SEQ ID NO: 9684 - DNA, 18 bp, Artificial sequence
  synthetic polynucleotide sequence
gacttcccaggccacgga

SEQ ID NO: 9685 - DNA, 18 bp, Artificial sequence
  synthetic polynucleotide sequence
gagtatccagaacgccca

SEQ ID NO: 9686 - DNA, 18 bp, Artificial sequence
  synthetic polynucleotide sequence
ctgaagattgacccccga

SEQ ID NO: 9687 - DNA, 18 bp, Artificial sequence
  synthetic polynucleotide sequence
acgagcacgaaccctcga

SEQ ID NO: 9688 - DNA, 18 bp, Artificial sequence
  synthetic polynucleotide sequence
gcagcttccctgcacaga

SEQ ID NO: 9689 - DNA, 19 bp, Artificial sequence
  synthetic polynucleotide sequence
gagagttagcagtgaggca

SEQ ID NO: 9690 - DNA, 19 bp, Artificial sequence
  synthetic polynucleotide sequence
atagacgagctccgagaca

SEQ ID NO: 9691 - DNA, 18 bp, Artificial sequence
  synthetic polynucleotide sequence
gcctccacttcagcccca

SEQ ID NO: 9692 - DNA, 18 bp, Artificial sequence
  synthetic polynucleotide sequence
ggcatggagactcagcca

SEQ ID NO: 9693 - DNA, 18 bp, Artificial sequence
  synthetic polynucleotide sequence
cacagtcatcatagggca

SEQ ID NO: 9694 - DNA, 18 bp, Artificial sequence
  synthetic polynucleotide sequence
gctgccagagagtgagga

SEQ ID NO: 9695 - DNA, 18 bp, Artificial sequence
  synthetic polynucleotide sequence
ccctcaggagaagctcca

SEQ ID NO: 9696 - DNA, 18 bp, Artificial sequence
  synthetic polynucleotide sequence
ccctcaggagaagctcca

SEQ ID NO: 9697 - DNA, 18 bp, Artificial sequence
  synthetic polynucleotide sequence
aggttgacctggaagcca

SEQ ID NO: 9698 - DNA, 18 bp, Artificial sequence
  synthetic polynucleotide sequence
caacgttaagggccagga

SEQ ID NO: 9699 - DNA, 18 bp, Artificial sequence
  synthetic polynucleotide sequence
cccaggtagatgcccgca

SEQ ID NO: 9700 - DNA, 18 bp, Artificial sequence
  synthetic polynucleotide sequence
cgcagcagggagtcagca

SEQ ID NO: 9701 - DNA, 18 bp, Artificial sequence
  synthetic polynucleotide sequence
gcccaagggagaagggca

SEQ ID NO: 9702 - DNA, 18 bp, Artificial sequence
  synthetic polynucleotide sequence
gccccgatgttcaccaga

SEQ ID NO: 9703 - DNA, 18 bp, Artificial sequence
  synthetic polynucleotide sequence
cagagcggctgatacaga

SEQ ID NO: 9704 - DNA, 18 bp, Artificial sequence
  synthetic polynucleotide sequence
gggctccagggatgcaga

SEQ ID NO: 9705 - DNA, 18 bp, Artificial sequence
  synthetic polynucleotide sequence
agtgccagccttgccaga

SEQ ID NO: 9706 - DNA, 18 bp, Artificial sequence
  synthetic polynucleotide sequence
agtttggccacaggggca

SEQ ID NO: 9707 - DNA, 18 bp, Artificial sequence
  synthetic polynucleotide sequence
ggcacagagccagcccca

SEQ ID NO: 9708 - DNA, 18 bp, Artificial sequence
  synthetic polynucleotide sequence
ccagcagtgggcaaggga

SEQ ID NO: 9709 - DNA, 18 bp, Artificial sequence
  synthetic polynucleotide sequence
cattcagctgcaccggga

SEQ ID NO: 9710 - DNA, 18 bp, Artificial sequence
  synthetic polynucleotide sequence
aagcccaacaggcccaga

SEQ ID NO: 9711 - DNA, 18 bp, Artificial sequence
  synthetic polynucleotide sequence
tccagcatgtagagcaga

SEQ ID NO: 9712 - DNA, 18 bp, Artificial sequence
  synthetic polynucleotide sequence
cagcctgggcaggaagca

SEQ ID NO: 9713 - DNA, 18 bp, Artificial sequence
  synthetic polynucleotide sequence
cgttctccagcagccgca

SEQ ID NO: 9714 - DNA, 18 bp, Artificial sequence
  synthetic polynucleotide sequence
cgttctccagcagccgca

SEQ ID NO: 9715 - DNA, 18 bp, Artificial sequence
  synthetic polynucleotide sequence
agaccaccgccacagaca

SEQ ID NO: 9716 - DNA, 18 bp, Artificial sequence
  synthetic polynucleotide sequence
cacccgctgtcaacggga

SEQ ID NO: 9717 - DNA, 18 bp, Artificial sequence
  synthetic polynucleotide sequence
gctaccagcccgagcaca

SEQ ID NO: 9718 - DNA, 18 bp, Artificial sequence
  synthetic polynucleotide sequence
tgcacagactctccacga

SEQ ID NO: 9719 - DNA, 18 bp, Artificial sequence
  synthetic polynucleotide sequence
gtgtggcgagtgggccaa

SEQ ID NO: 9720 - DNA, 18 bp, Artificial sequence
  synthetic polynucleotide sequence
tgcatcacagtgcagcca

SEQ ID NO: 9721 - DNA, 18 bp, Artificial sequence
  synthetic polynucleotide sequence
tacccacattggagcaga

SEQ ID NO: 9722 - DNA, 18 bp, Artificial sequence
  synthetic polynucleotide sequence
tgctgcagcgagtgggca

SEQ ID NO: 9723 - DNA, 18 bp, Artificial sequence
  synthetic polynucleotide sequence
ctacccgcacccgcagca

SEQ ID NO: 9724 - DNA, 18 bp, Artificial sequence
  synthetic polynucleotide sequence
tgaaggcttccacgcgga

SEQ ID NO: 9725 - DNA, 18 bp, Artificial sequence
  synthetic polynucleotide sequence
agcctgcggctgcaccca

SEQ ID NO: 9726 - DNA, 18 bp, Artificial sequence
  synthetic polynucleotide sequence
cggtgaagcagaagcaga

SEQ ID NO: 9727 - DNA, 19 bp, Artificial sequence
  synthetic polynucleotide sequence
gacagaacaggcgatgaca

SEQ ID NO: 9728 - DNA, 17 bp, Artificial sequence
  synthetic polynucleotide sequence
cgccgagccactggaga

SEQ ID NO: 9729 - DNA, 18 bp, Artificial sequence
  synthetic polynucleotide sequence
ctgcatccacccagcaga

SEQ ID NO: 9730 - DNA, 18 bp, Artificial sequence
  synthetic polynucleotide sequence
cctacatggacggcacga

SEQ ID NO: 9731 - DNA, 18 bp, Artificial sequence
  synthetic polynucleotide sequence
tggcacggggattcacca

SEQ ID NO: 9732 - DNA, 18 bp, Artificial sequence
  synthetic polynucleotide sequence
tggcacggggattcacca

SEQ ID NO: 9733 - DNA, 18 bp, Artificial sequence
  synthetic polynucleotide sequence
cggtgactgcagtgagca

SEQ ID NO: 9734 - DNA, 18 bp, Artificial sequence
  synthetic polynucleotide sequence
ccagtcttggggagggga

SEQ ID NO: 9735 - DNA, 18 bp, Artificial sequence
  synthetic polynucleotide sequence
gatggccaacgcgtccca

SEQ ID NO: 9736 - DNA, 18 bp, Artificial sequence
  synthetic polynucleotide sequence
caaggaagatgagcagca

SEQ ID NO: 9737 - DNA, 18 bp, Artificial sequence
  synthetic polynucleotide sequence
aaagcctggtgcagagca

SEQ ID NO: 9738 - DNA, 18 bp, Artificial sequence
  synthetic polynucleotide sequence
ctgccatggagtacacca

SEQ ID NO: 9739 - DNA, 18 bp, Artificial sequence
  synthetic polynucleotide sequence
cacaagctaggtgatcca

SEQ ID NO: 9740 - DNA, 18 bp, Artificial sequence
  synthetic polynucleotide sequence
gcagcagaatccaagcca

SEQ ID NO: 9741 - DNA, 18 bp, Artificial sequence
  synthetic polynucleotide sequence
cggagttggcagcacaga

SEQ ID NO: 9742 - DNA, 18 bp, Artificial sequence
  synthetic polynucleotide sequence
tgtctacccaaggcacca

SEQ ID NO: 9743 - DNA, 18 bp, Artificial sequence
  synthetic polynucleotide sequence
tttcccgaacagccgcca

SEQ ID NO: 9744 - DNA, 18 bp, Artificial sequence
  synthetic polynucleotide sequence
gtggaatgagagtgcaga

SEQ ID NO: 9745 - DNA, 18 bp, Artificial sequence
  synthetic polynucleotide sequence
gccgtaccttgagcacca

SEQ ID NO: 9746 - DNA, 18 bp, Artificial sequence
  synthetic polynucleotide sequence
tgctggagcacatccgca

SEQ ID NO: 9747 - DNA, 18 bp, Artificial sequence
  synthetic polynucleotide sequence
gtggccacatacacctga

SEQ ID NO: 9748 - DNA, 18 bp, Artificial sequence
  synthetic polynucleotide sequence
aatctgaccactggacca

SEQ ID NO: 9749 - DNA, 18 bp, Artificial sequence
  synthetic polynucleotide sequence
gagcgagatcgagtggga

SEQ ID NO: 9750 - DNA, 18 bp, Artificial sequence
  synthetic polynucleotide sequence
gagcgagatcgagtggga

SEQ ID NO: 9751 - DNA, 18 bp, Artificial sequence
  synthetic polynucleotide sequence
gtgggaccagcctccaca

SEQ ID NO: 9752 - DNA, 18 bp, Artificial sequence
  synthetic polynucleotide sequence
aggacggggaccgccaca

SEQ ID NO: 9753 - DNA, 18 bp, Artificial sequence
  synthetic polynucleotide sequence
acaaggccacgcgcagca

SEQ ID NO: 9754 - DNA, 18 bp, Artificial sequence
  synthetic polynucleotide sequence
ggtccgaccgtatagcaa

SEQ ID NO: 9755 - DNA, 18 bp, Artificial sequence
  synthetic polynucleotide sequence
catgcagtacaacgccca

SEQ ID NO: 9756 - DNA, 18 bp, Artificial sequence
  synthetic polynucleotide sequence
actgctgggcctggacca

SEQ ID NO: 9757 - DNA, 18 bp, Artificial sequence
  synthetic polynucleotide sequence
ggaggacgaggaagacga

SEQ ID NO: 9758 - DNA, 17 bp, Artificial sequence
  synthetic polynucleotide sequence
gcacgagtctcgcagga

SEQ ID NO: 9759 - DNA, 18 bp, Artificial sequence
  synthetic polynucleotide sequence
gaaactcacgtccacgca

SEQ ID NO: 9760 - DNA, 18 bp, Artificial sequence
  synthetic polynucleotide sequence
attgaggcccacgccgta

SEQ ID NO: 9761 - DNA, 18 bp, Artificial sequence
  synthetic polynucleotide sequence
gaagaggccaagcgccga

SEQ ID NO: 9762 - DNA, 18 bp, Artificial sequence
  synthetic polynucleotide sequence
gcggtggcgaggtgggaa

SEQ ID NO: 9763 - DNA, 18 bp, Artificial sequence
  synthetic polynucleotide sequence
gcccacgcagtacaggta

SEQ ID NO: 9764 - DNA, 18 bp, Artificial sequence
  synthetic polynucleotide sequence
gggagacttggagaagca

SEQ ID NO: 9765 - DNA, 18 bp, Artificial sequence
  synthetic polynucleotide sequence
ggagggcgacgaggagga

SEQ ID NO: 9766 - DNA, 18 bp, Artificial sequence
  synthetic polynucleotide sequence
tgcacagcatggccgaga

SEQ ID NO: 9767 - DNA, 18 bp, Artificial sequence
  synthetic polynucleotide sequence
tgacggtcagcccagtca

SEQ ID NO: 9768 - DNA, 18 bp, Artificial sequence
  synthetic polynucleotide sequence
tgacggtcagcccagtca

SEQ ID NO: 9769 - DNA, 18 bp, Artificial sequence
  synthetic polynucleotide sequence
caccaatgggtggcacca

SEQ ID NO: 9770 - DNA, 18 bp, Artificial sequence
  synthetic polynucleotide sequence
tgaccacggcactgagca

SEQ ID NO: 9771 - DNA, 18 bp, Artificial sequence
  synthetic polynucleotide sequence
tggagcaccaagcggcca

SEQ ID NO: 9772 - DNA, 18 bp, Artificial sequence
  synthetic polynucleotide sequence
cacgagggttctccacca

SEQ ID NO: 9773 - DNA, 18 bp, Artificial sequence
  synthetic polynucleotide sequence
ccaccaaacgcccagcaa

SEQ ID NO: 9774 - DNA, 18 bp, Artificial sequence
  synthetic polynucleotide sequence
gttgaggaagaggagcga

SEQ ID NO: 9775 - DNA, 18 bp, Artificial sequence
  synthetic polynucleotide sequence
ggaagccggatgatggca

SEQ ID NO: 9776 - DNA, 18 bp, Artificial sequence
  synthetic polynucleotide sequence
tgtctcaggagagaggga

SEQ ID NO: 9777 - DNA, 17 bp, Artificial sequence
  synthetic polynucleotide sequence
gaccttggagcccacca

SEQ ID NO: 9778 - DNA, 18 bp, Artificial sequence
  synthetic polynucleotide sequence
agcagcagggaactggca

SEQ ID NO: 9779 - DNA, 18 bp, Artificial sequence
  synthetic polynucleotide sequence
caggagaaggcacgcaca

SEQ ID NO: 9780 - DNA, 18 bp, Artificial sequence
  synthetic polynucleotide sequence
gcctggatacgggagaga

SEQ ID NO: 9781 - DNA, 18 bp, Artificial sequence
  synthetic polynucleotide sequence
aggtagtacatggcggca

SEQ ID NO: 9782 - DNA, 18 bp, Artificial sequence
  synthetic polynucleotide sequence
tggactgcagaaggcgga

SEQ ID NO: 9783 - DNA, 18 bp, Artificial sequence
  synthetic polynucleotide sequence
cagatgccggttgcagga

SEQ ID NO: 9784 - DNA, 18 bp, Artificial sequence
  synthetic polynucleotide sequence
gtgcgagggactgaagca

SEQ ID NO: 9785 - DNA, 18 bp, Artificial sequence
  synthetic polynucleotide sequence
ctgcggccaagtgacaca

SEQ ID NO: 9786 - DNA, 18 bp, Artificial sequence
  synthetic polynucleotide sequence
ctgcggccaagtgacaca

SEQ ID NO: 9787 - DNA, 18 bp, Artificial sequence
  synthetic polynucleotide sequence
tggggacagctccccaca

SEQ ID NO: 9788 - DNA, 18 bp, Artificial sequence
  synthetic polynucleotide sequence
gcaggaggattccgagca

SEQ ID NO: 9789 - DNA, 18 bp, Artificial sequence
  synthetic polynucleotide sequence
ggacctgtgtgaaggcca

SEQ ID NO: 9790 - DNA, 18 bp, Artificial sequence
  synthetic polynucleotide sequence
agctactgatgcgagcca

SEQ ID NO: 9791 - DNA, 18 bp, Artificial sequence
  synthetic polynucleotide sequence
actccaagcctgggacca

SEQ ID NO: 9792 - DNA, 18 bp, Artificial sequence
  synthetic polynucleotide sequence
tccacagaatcactgcca

SEQ ID NO: 9793 - DNA, 18 bp, Artificial sequence
  synthetic polynucleotide sequence
gtggtgaagacaggccga

SEQ ID NO: 9794 - DNA, 18 bp, Artificial sequence
  synthetic polynucleotide sequence
cctgccaacctgaatgca

SEQ ID NO: 9795 - DNA, 18 bp, Artificial sequence
  synthetic polynucleotide sequence
gacctgaaagaccgacca

SEQ ID NO: 9796 - DNA, 18 bp, Artificial sequence
  synthetic polynucleotide sequence
cacgttcagcccctccca

SEQ ID NO: 9797 - DNA, 18 bp, Artificial sequence
  synthetic polynucleotide sequence
gcgggcactctccaccga

SEQ ID NO: 9798 - DNA, 18 bp, Artificial sequence
  synthetic polynucleotide sequence
gctcatcggagccacgaa

SEQ ID NO: 9799 - DNA, 18 bp, Artificial sequence
  synthetic polynucleotide sequence
tggggcagcctcagccga

SEQ ID NO: 9800 - DNA, 18 bp, Artificial sequence
  synthetic polynucleotide sequence
ccaggacctgcggaggaa

SEQ ID NO: 9801 - DNA, 18 bp, Artificial sequence
  synthetic polynucleotide sequence
cggggaagaaagcatcca

SEQ ID NO: 9802 - DNA, 18 bp, Artificial sequence
  synthetic polynucleotide sequence
acctgaggtcgaagccca

SEQ ID NO: 9803 - DNA, 18 bp, Artificial sequence
  synthetic polynucleotide sequence
catagtccacgcggtcca

SEQ ID NO: 9804 - DNA, 18 bp, Artificial sequence
  synthetic polynucleotide sequence
catagtccacgcggtcca

SEQ ID NO: 9805 - DNA, 18 bp, Artificial sequence
  synthetic polynucleotide sequence
aatgcacctggctgccaa

SEQ ID NO: 9806 - DNA, 18 bp, Artificial sequence
  synthetic polynucleotide sequence
gtgaagtccactgcagca

SEQ ID NO: 9807 - DNA, 18 bp, Artificial sequence
  synthetic polynucleotide sequence
ccaggaggaggtggagca

SEQ ID NO: 9808 - DNA, 18 bp, Artificial sequence
  synthetic polynucleotide sequence
atggtggagggcagcgta

SEQ ID NO: 9809 - DNA, 18 bp, Artificial sequence
  synthetic polynucleotide sequence
cagaagttgggcaagtca

SEQ ID NO: 9810 - DNA, 18 bp, Artificial sequence
  synthetic polynucleotide sequence
catgcaggtgaggaacga

SEQ ID NO: 9811 - DNA, 18 bp, Artificial sequence
  synthetic polynucleotide sequence
gcacctggccttccagca

SEQ ID NO: 9812 - DNA, 18 bp, Artificial sequence
  synthetic polynucleotide sequence
tctgaggcgatggcagca

SEQ ID NO: 9813 - DNA, 18 bp, Artificial sequence
  synthetic polynucleotide sequence
cgctcaggaacctcggca

SEQ ID NO: 9814 - DNA, 18 bp, Artificial sequence
  synthetic polynucleotide sequence
ccagggggaggctggaga

SEQ ID NO: 9815 - DNA, 18 bp, Artificial sequence
  synthetic polynucleotide sequence
cagtaggagaggggcaga

SEQ ID NO: 9816 - DNA, 18 bp, Artificial sequence
  synthetic polynucleotide sequence
gctacggatgcagcagca

SEQ ID NO: 9817 - DNA, 18 bp, Artificial sequence
  synthetic polynucleotide sequence
tagctgagcggctggaga

SEQ ID NO: 9818 - DNA, 18 bp, Artificial sequence
  synthetic polynucleotide sequence
cagctgcgactctcccaa

SEQ ID NO: 9819 - DNA, 18 bp, Artificial sequence
  synthetic polynucleotide sequence
gcaggctcacggcagaca

SEQ ID NO: 9820 - DNA, 18 bp, Artificial sequence
  synthetic polynucleotide sequence
acacccgctaccacacca

SEQ ID NO: 9821 - DNA, 18 bp, Artificial sequence
  synthetic polynucleotide sequence
ggtcagggtggtcaagga

SEQ ID NO: 9822 - DNA, 18 bp, Artificial sequence
  synthetic polynucleotide sequence
ggtcagggtggtcaagga

SEQ ID NO: 9823 - DNA, 18 bp, Artificial sequence
  synthetic polynucleotide sequence
ggagtggggcaagaggca

SEQ ID NO: 9824 - DNA, 18 bp, Artificial sequence
  synthetic polynucleotide sequence
aactcctccccaacagga

SEQ ID NO: 9825 - DNA, 18 bp, Artificial sequence
  synthetic polynucleotide sequence
caagaagctgcggaggaa

SEQ ID NO: 9826 - DNA, 18 bp, Artificial sequence
  synthetic polynucleotide sequence
ctcgggcacggagcacga

SEQ ID NO: 9827 - DNA, 18 bp, Artificial sequence
  synthetic polynucleotide sequence
gggccagagtacgaggca

SEQ ID NO: 9828 - DNA, 18 bp, Artificial sequence
  synthetic polynucleotide sequence
gggtgcctccggcgtcca

SEQ ID NO: 9829 - DNA, 18 bp, Artificial sequence
  synthetic polynucleotide sequence
tgagtacaaggcccagga

SEQ ID NO: 9830 - DNA, 18 bp, Artificial sequence
  synthetic polynucleotide sequence
ggcagtttccaagccaga

SEQ ID NO: 9831 - DNA, 18 bp, Artificial sequence
  synthetic polynucleotide sequence
ctgccaaggaggcagaga

SEQ ID NO: 9832 - DNA, 18 bp, Artificial sequence
  synthetic polynucleotide sequence
ccgcaactcgtgaatcca

SEQ ID NO: 9833 - DNA, 18 bp, Artificial sequence
  synthetic polynucleotide sequence
cagggactggccaaggga

SEQ ID NO: 9834 - DNA, 18 bp, Artificial sequence
  synthetic polynucleotide sequence
cagaaggcaacgaccaca

SEQ ID NO: 9835 - DNA, 18 bp, Artificial sequence
  synthetic polynucleotide sequence
gggccaacactgtaggca

SEQ ID NO: 9836 - DNA, 18 bp, Artificial sequence
  synthetic polynucleotide sequence
gagatccacgggaaggca

SEQ ID NO: 9837 - DNA, 18 bp, Artificial sequence
  synthetic polynucleotide sequence
gccatctgacccatccga

SEQ ID NO: 9838 - DNA, 18 bp, Artificial sequence
  synthetic polynucleotide sequence
gatggaagctgcacgcca

SEQ ID NO: 9839 - DNA, 18 bp, Artificial sequence
  synthetic polynucleotide sequence
gcagcagtcagctcagca

SEQ ID NO: 9840 - DNA, 18 bp, Artificial sequence
  synthetic polynucleotide sequence
gcagcagtcagctcagca

SEQ ID NO: 9841 - DNA, 18 bp, Artificial sequence
  synthetic polynucleotide sequence
atgctcccacatccgaca

SEQ ID NO: 9842 - DNA, 18 bp, Artificial sequence
  synthetic polynucleotide sequence
ggtccacagccaacccca

SEQ ID NO: 9843 - DNA, 18 bp, Artificial sequence
  synthetic polynucleotide sequence
gcagcagttgccagagca

SEQ ID NO: 9844 - DNA, 18 bp, Artificial sequence
  synthetic polynucleotide sequence
gctggaacggatgggaga

SEQ ID NO: 9845 - DNA, 18 bp, Artificial sequence
  synthetic polynucleotide sequence
gctggagaagctggagga

SEQ ID NO: 9846 - DNA, 18 bp, Artificial sequence
  synthetic polynucleotide sequence
gtccatgcccatggagga

SEQ ID NO: 9847 - DNA, 16 bp, Artificial sequence
  synthetic polynucleotide sequence
tgtggggacgtcacca

SEQ ID NO: 9848 - DNA, 17 bp, Artificial sequence
  synthetic polynucleotide sequence
tcgcagggtgactccaa

SEQ ID NO: 9849 - DNA, 18 bp, Artificial sequence
  synthetic polynucleotide sequence
gacccctaagccagagga

SEQ ID NO: 9850 - DNA, 18 bp, Artificial sequence
  synthetic polynucleotide sequence
actcgtactccgaggcga

SEQ ID NO: 9851 - DNA, 18 bp, Artificial sequence
  synthetic polynucleotide sequence
gcaggaagccagcagaca

SEQ ID NO: 9852 - DNA, 18 bp, Artificial sequence
  synthetic polynucleotide sequence
gacatcaccacaccccca

SEQ ID NO: 9853 - DNA, 18 bp, Artificial sequence
  synthetic polynucleotide sequence
ctgacgctcctgcaagga

SEQ ID NO: 9854 - DNA, 18 bp, Artificial sequence
  synthetic polynucleotide sequence
gtgctgcgggatcagcaa

SEQ ID NO: 9855 - DNA, 18 bp, Artificial sequence
  synthetic polynucleotide sequence
caggcacactcgtagcca

SEQ ID NO: 9856 - DNA, 18 bp, Artificial sequence
  synthetic polynucleotide sequence
caggacccaactgcgaga

SEQ ID NO: 9857 - DNA, 18 bp, Artificial sequence
  synthetic polynucleotide sequence
ctcctcggagagaagcca

SEQ ID NO: 9858 - DNA, 18 bp, Artificial sequence
  synthetic polynucleotide sequence
ctcctcggagagaagcca

SEQ ID NO: 9859 - DNA, 18 bp, Artificial sequence
  synthetic polynucleotide sequence
gcaacccggtgtacgaga

SEQ ID NO: 9860 - DNA, 18 bp, Artificial sequence
  synthetic polynucleotide sequence
ctggcacaatccagccca

SEQ ID NO: 9861 - DNA, 18 bp, Artificial sequence
  synthetic polynucleotide sequence
gctaactcctccccagga

SEQ ID NO: 9862 - DNA, 18 bp, Artificial sequence
  synthetic polynucleotide sequence
ttcccagggctcaggaca

SEQ ID NO: 9863 - DNA, 18 bp, Artificial sequence
  synthetic polynucleotide sequence
cagactgcgtcgacacga

SEQ ID NO: 9864 - DNA, 18 bp, Artificial sequence
  synthetic polynucleotide sequence
caccacgaacacagggca

SEQ ID NO: 9865 - DNA, 18 bp, Artificial sequence
  synthetic polynucleotide sequence
gccagagcagccaacaga

SEQ ID NO: 9866 - DNA, 18 bp, Artificial sequence
  synthetic polynucleotide sequence
ccatcactgcagacccca

SEQ ID NO: 9867 - DNA, 18 bp, Artificial sequence
  synthetic polynucleotide sequence
tcagccagtggcagcaca

SEQ ID NO: 9868 - DNA, 18 bp, Artificial sequence
  synthetic polynucleotide sequence
cctagaatggcactggca

SEQ ID NO: 9869 - DNA, 18 bp, Artificial sequence
  synthetic polynucleotide sequence
agaagagcagcgaaggga

SEQ ID NO: 9870 - DNA, 18 bp, Artificial sequence
  synthetic polynucleotide sequence
tggaactgccctgacaga

SEQ ID NO: 9871 - DNA, 21 bp, Artificial sequence
  synthetic polynucleotide sequence
ggtccacaacagaaaacacca

SEQ ID NO: 9872 - DNA, 20 bp, Artificial sequence
  synthetic polynucleotide sequence
cctcagtcaaacagatggga

SEQ ID NO: 9873 - DNA, 18 bp, Artificial sequence
  synthetic polynucleotide sequence
ggcgacgtcctggacgca

SEQ ID NO: 9874 - DNA, 18 bp, Artificial sequence
  synthetic polynucleotide sequence
cgctcccagccctacaga

SEQ ID NO: 9875 - DNA, 18 bp, Artificial sequence
  synthetic polynucleotide sequence
tggtgccatggccaagga

SEQ ID NO: 9876 - DNA, 18 bp, Artificial sequence
  synthetic polynucleotide sequence
tggtgccatggccaagga

SEQ ID NO: 9877 - DNA, 18 bp, Artificial sequence
  synthetic polynucleotide sequence
ccatcagcaccaagccca

SEQ ID NO: 9878 - DNA, 18 bp, Artificial sequence
  synthetic polynucleotide sequence
tcaggaggttgaggcgga

SEQ ID NO: 9879 - DNA, 18 bp, Artificial sequence
  synthetic polynucleotide sequence
agcccatgccccacccaa

SEQ ID NO: 9880 - DNA, 18 bp, Artificial sequence
  synthetic polynucleotide sequence
agggaactgggacgccca

SEQ ID NO: 9881 - DNA, 18 bp, Artificial sequence
  synthetic polynucleotide sequence
ggaccccaaacctggaga

SEQ ID NO: 9882 - DNA, 19 bp, Artificial sequence
  synthetic polynucleotide sequence
cctcagatcagcggagaga

SEQ ID NO: 9883 - DNA, 18 bp, Artificial sequence
  synthetic polynucleotide sequence
agacctggccggagccaa

SEQ ID NO: 9884 - DNA, 18 bp, Artificial sequence
  synthetic polynucleotide sequence
caggctccagaactggga

SEQ ID NO: 9885 - DNA, 18 bp, Artificial sequence
  synthetic polynucleotide sequence
ggtgtccaggaagaagca

SEQ ID NO: 9886 - DNA, 18 bp, Artificial sequence
  synthetic polynucleotide sequence
gttgccgaatgccagcca

SEQ ID NO: 9887 - DNA, 18 bp, Artificial sequence
  synthetic polynucleotide sequence
aggccagttgtgaaggca

SEQ ID NO: 9888 - DNA, 18 bp, Artificial sequence
  synthetic polynucleotide sequence
gcttctggaggaagggaa

SEQ ID NO: 9889 - DNA, 18 bp, Artificial sequence
  synthetic polynucleotide sequence
catctggacggcagcaga

SEQ ID NO: 9890 - DNA, 18 bp, Artificial sequence
  synthetic polynucleotide sequence
cgtgcctgtgagcagaga

SEQ ID NO: 9891 - DNA, 18 bp, Artificial sequence
  synthetic polynucleotide sequence
gccaccccattgtccaca

SEQ ID NO: 9892 - DNA, 18 bp, Artificial sequence
  synthetic polynucleotide sequence
ctgggagagactgggaga

SEQ ID NO: 9893 - DNA, 18 bp, Artificial sequence
  synthetic polynucleotide sequence
gcccttggaaggtgggga

SEQ ID NO: 9894 - DNA, 18 bp, Artificial sequence
  synthetic polynucleotide sequence
gcccttggaaggtgggga

SEQ ID NO: 9895 - DNA, 18 bp, Artificial sequence
  synthetic polynucleotide sequence
acgagatactccagccaa

SEQ ID NO: 9896 - DNA, 18 bp, Artificial sequence
  synthetic polynucleotide sequence
tcagtcatccggaagcaa

SEQ ID NO: 9897 - DNA, 18 bp, Artificial sequence
  synthetic polynucleotide sequence
tcggcagccaaagcccca

SEQ ID NO: 9898 - DNA, 18 bp, Artificial sequence
  synthetic polynucleotide sequence
ggagtgtgccagagtgca

SEQ ID NO: 9899 - DNA, 18 bp, Artificial sequence
  synthetic polynucleotide sequence
cctggaccggggaagtca

SEQ ID NO: 9900 - DNA, 18 bp, Artificial sequence
  synthetic polynucleotide sequence
cgcaggctccgaggggca

SEQ ID NO: 9901 - DNA, 18 bp, Artificial sequence
  synthetic polynucleotide sequence
aggtagccaccgagggca

SEQ ID NO: 9902 - DNA, 18 bp, Artificial sequence
  synthetic polynucleotide sequence
agcagccagacccttgca

SEQ ID NO: 9903 - DNA, 18 bp, Artificial sequence
  synthetic polynucleotide sequence
cctgcgcgtggacaccaa

SEQ ID NO: 9904 - DNA, 18 bp, Artificial sequence
  synthetic polynucleotide sequence
gccgaagcagcccttgga

SEQ ID NO: 9905 - DNA, 18 bp, Artificial sequence
  synthetic polynucleotide sequence
tccacgtggaagacccca

SEQ ID NO: 9906 - DNA, 18 bp, Artificial sequence
  synthetic polynucleotide sequence
ggacccagagcaaggaca

SEQ ID NO: 9907 - DNA, 18 bp, Artificial sequence
  synthetic polynucleotide sequence
aggccaacaaccccagca

SEQ ID NO: 9908 - DNA, 18 bp, Artificial sequence
  synthetic polynucleotide sequence
ggtcaacgccatgcacca

SEQ ID NO: 9909 - DNA, 18 bp, Artificial sequence
  synthetic polynucleotide sequence
gactgtctggagggacga

SEQ ID NO: 9910 - DNA, 18 bp, Artificial sequence
  synthetic polynucleotide sequence
tggcatgaccagtggaga

SEQ ID NO: 9911 - DNA, 18 bp, Artificial sequence
  synthetic polynucleotide sequence
ccccgagtcctttgcaca

SEQ ID NO: 9912 - DNA, 18 bp, Artificial sequence
  synthetic polynucleotide sequence
ccccgagtcctttgcaca

SEQ ID NO: 9913 - DNA, 18 bp, Artificial sequence
  synthetic polynucleotide sequence
atgggaaactgtgcagca

SEQ ID NO: 9914 - DNA, 18 bp, Artificial sequence
  synthetic polynucleotide sequence
ggagctgctgaagacaca

SEQ ID NO: 9915 - DNA, 18 bp, Artificial sequence
  synthetic polynucleotide sequence
gtcagcgctcctaaagca

SEQ ID NO: 9916 - DNA, 18 bp, Artificial sequence
  synthetic polynucleotide sequence
gtgggggtagccaactga

SEQ ID NO: 9917 - DNA, 18 bp, Artificial sequence
  synthetic polynucleotide sequence
ctaccaggatggcacgca

SEQ ID NO: 9918 - DNA, 18 bp, Artificial sequence
  synthetic polynucleotide sequence
agtgggccagctcaccca

SEQ ID NO: 9919 - DNA, 18 bp, Artificial sequence
  synthetic polynucleotide sequence
agtggggcaacaacccca

SEQ ID NO: 9920 - DNA, 18 bp, Artificial sequence
  synthetic polynucleotide sequence
cctggaatgcctcccaca

SEQ ID NO: 9921 - DNA, 18 bp, Artificial sequence
  synthetic polynucleotide sequence
cgcctggaccacaaggga

SEQ ID NO: 9922 - DNA, 18 bp, Artificial sequence
  synthetic polynucleotide sequence
agccaggttctcaccgga

SEQ ID NO: 9923 - DNA, 18 bp, Artificial sequence
  synthetic polynucleotide sequence
tcacgaggctcacctcca

SEQ ID NO: 9924 - DNA, 18 bp, Artificial sequence
  synthetic polynucleotide sequence
gccacactccttcgccaa

SEQ ID NO: 9925 - DNA, 18 bp, Artificial sequence
  synthetic polynucleotide sequence
cagctccgctgaagtcca

SEQ ID NO: 9926 - DNA, 18 bp, Artificial sequence
  synthetic polynucleotide sequence
ggagctcccaggcaggga

SEQ ID NO: 9927 - DNA, 18 bp, Artificial sequence
  synthetic polynucleotide sequence
gcagggtcttcaagccga

SEQ ID NO: 9928 - DNA, 18 bp, Artificial sequence
  synthetic polynucleotide sequence
ccagcccagagacactga

SEQ ID NO: 9929 - DNA, 18 bp, Artificial sequence
  synthetic polynucleotide sequence
ctgtgaggtggcagagca

SEQ ID NO: 9930 - DNA, 18 bp, Artificial sequence
  synthetic polynucleotide sequence
ctgtgaggtggcagagca

SEQ ID NO: 9931 - DNA, 18 bp, Artificial sequence
  synthetic polynucleotide sequence
gaccactaccatcagcga

SEQ ID NO: 9932 - DNA, 18 bp, Artificial sequence
  synthetic polynucleotide sequence
aagtggagcacatggcga

SEQ ID NO: 9933 - DNA, 18 bp, Artificial sequence
  synthetic polynucleotide sequence
ctggcagccataaatgga

SEQ ID NO: 9934 - DNA, 18 bp, Artificial sequence
  synthetic polynucleotide sequence
aagtggggacccctggta

SEQ ID NO: 9935 - DNA, 18 bp, Artificial sequence
  synthetic polynucleotide sequence
gaagctggaagccgcaga

SEQ ID NO: 9936 - DNA, 18 bp, Artificial sequence
  synthetic polynucleotide sequence
tacatggagccactgcca

SEQ ID NO: 9937 - DNA, 18 bp, Artificial sequence
  synthetic polynucleotide sequence
ccacgaagcctacaagca

SEQ ID NO: 9938 - DNA, 18 bp, Artificial sequence
  synthetic polynucleotide sequence
ccatccagcccttcagga

SEQ ID NO: 9939 - DNA, 18 bp, Artificial sequence
  synthetic polynucleotide sequence
tgggcacctgcagcagga

SEQ ID NO: 9940 - DNA, 18 bp, Artificial sequence
  synthetic polynucleotide sequence
tggaggccgtgaggagga

SEQ ID NO: 9941 - DNA, 18 bp, Artificial sequence
  synthetic polynucleotide sequence
tctgcagataccaggaca

SEQ ID NO: 9942 - DNA, 18 bp, Artificial sequence
  synthetic polynucleotide sequence
ctcaatgggagcagggga

SEQ ID NO: 9943 - DNA, 18 bp, Artificial sequence
  synthetic polynucleotide sequence
ggggatggtggatggaga

SEQ ID NO: 9944 - DNA, 18 bp, Artificial sequence
  synthetic polynucleotide sequence
gcccaacgtgcaggacca

SEQ ID NO: 9945 - DNA, 18 bp, Artificial sequence
  synthetic polynucleotide sequence
taggtcagaatgcccaga

SEQ ID NO: 9946 - DNA, 18 bp, Artificial sequence
  synthetic polynucleotide sequence
tggaccatgaagaccaga

SEQ ID NO: 9947 - DNA, 18 bp, Artificial sequence
  synthetic polynucleotide sequence
tgcggagctcggtgagca

SEQ ID NO: 9948 - DNA, 18 bp, Artificial sequence
  synthetic polynucleotide sequence
tgcggagctcggtgagca

SEQ ID NO: 9949 - DNA, 18 bp, Artificial sequence
  synthetic polynucleotide sequence
agtaccccaaccagccca

SEQ ID NO: 9950 - DNA, 18 bp, Artificial sequence
  synthetic polynucleotide sequence
gagctgctcgatgacgga

SEQ ID NO: 9951 - DNA, 18 bp, Artificial sequence
  synthetic polynucleotide sequence
cctgcagatcacggacca

SEQ ID NO: 9952 - DNA, 18 bp, Artificial sequence
  synthetic polynucleotide sequence
tcagagagaccacaggca

SEQ ID NO: 9953 - DNA, 18 bp, Artificial sequence
  synthetic polynucleotide sequence
cagcaggccactacagga

SEQ ID NO: 9954 - DNA, 18 bp, Artificial sequence
  synthetic polynucleotide sequence
cctccaacagtgacacca

SEQ ID NO: 9955 - DNA, 18 bp, Artificial sequence
  synthetic polynucleotide sequence
ccctcggtcaacacagca

SEQ ID NO: 9956 - DNA, 18 bp, Artificial sequence
  synthetic polynucleotide sequence
agcggttgagcgtggaga

SEQ ID NO: 9957 - DNA, 18 bp, Artificial sequence
  synthetic polynucleotide sequence
gtcaccggctgaccagga

SEQ ID NO: 9958 - DNA, 18 bp, Artificial sequence
  synthetic polynucleotide sequence
gggaccttgagaaggcca

SEQ ID NO: 9959 - DNA, 18 bp, Artificial sequence
  synthetic polynucleotide sequence
gtgaccatagccagggca

SEQ ID NO: 9960 - DNA, 18 bp, Artificial sequence
  synthetic polynucleotide sequence
ctgcccaaagccgaccaa

SEQ ID NO: 9961 - DNA, 18 bp, Artificial sequence
  synthetic polynucleotide sequence
gttctaccagggcaccca

SEQ ID NO: 9962 - DNA, 18 bp, Artificial sequence
  synthetic polynucleotide sequence
gcctgtcagcactgagca

SEQ ID NO: 9963 - DNA, 18 bp, Artificial sequence
  synthetic polynucleotide sequence
cctgccacgtagagctca

SEQ ID NO: 9964 - DNA, 18 bp, Artificial sequence
  synthetic polynucleotide sequence
tcgcagcctggatcccca

SEQ ID NO: 9965 - DNA, 18 bp, Artificial sequence
  synthetic polynucleotide sequence
tcagcttggccagcagga

SEQ ID NO: 9966 - DNA, 18 bp, Artificial sequence
  synthetic polynucleotide sequence
tcagcttggccagcagga

SEQ ID NO: 9967 - DNA, 18 bp, Artificial sequence
  synthetic polynucleotide sequence
ctcagccaagaccagaca

SEQ ID NO: 9968 - DNA, 18 bp, Artificial sequence
  synthetic polynucleotide sequence
atacaaccctgagtccca

SEQ ID NO: 9969 - DNA, 18 bp, Artificial sequence
  synthetic polynucleotide sequence
ggctcaaggaggacagca

SEQ ID NO: 9970 - DNA, 18 bp, Artificial sequence
  synthetic polynucleotide sequence
aggcgcaccgcttgcaca

SEQ ID NO: 9971 - DNA, 18 bp, Artificial sequence
  synthetic polynucleotide sequence
ccgaggagctgtaccaga

SEQ ID NO: 9972 - DNA, 18 bp, Artificial sequence
  synthetic polynucleotide sequence
ttgcagtaggccaccaca

SEQ ID NO: 9973 - DNA, 18 bp, Artificial sequence
  synthetic polynucleotide sequence
tgtggaaccggcagcaga

SEQ ID NO: 9974 - DNA, 18 bp, Artificial sequence
  synthetic polynucleotide sequence
ccactaggtcggtgggca

SEQ ID NO: 9975 - DNA, 18 bp, Artificial sequence
  synthetic polynucleotide sequence
tctcacaggtcacagcca

SEQ ID NO: 9976 - DNA, 18 bp, Artificial sequence
  synthetic polynucleotide sequence
ctgtgtgggcgagaagca

SEQ ID NO: 9977 - DNA, 18 bp, Artificial sequence
  synthetic polynucleotide sequence
gcagagtctgcaggccca

SEQ ID NO: 9978 - DNA, 18 bp, Artificial sequence
  synthetic polynucleotide sequence
ctgcaagtgccaggacca

SEQ ID NO: 9979 - DNA, 18 bp, Artificial sequence
  synthetic polynucleotide sequence
caggcgctgtagcccgca

SEQ ID NO: 9980 - DNA, 18 bp, Artificial sequence
  synthetic polynucleotide sequence
acagcaagaagctcgcca

SEQ ID NO: 9981 - DNA, 18 bp, Artificial sequence
  synthetic polynucleotide sequence
cgcgtggagagagctgga

SEQ ID NO: 9982 - DNA, 18 bp, Artificial sequence
  synthetic polynucleotide sequence
gtgggaagcaccgagaga

SEQ ID NO: 9983 - DNA, 18 bp, Artificial sequence
  synthetic polynucleotide sequence
cacagggctcctcgagga

SEQ ID NO: 9984 - DNA, 18 bp, Artificial sequence
  synthetic polynucleotide sequence
cacagggctcctcgagga

SEQ ID NO: 9985 - DNA, 18 bp, Artificial sequence
  synthetic polynucleotide sequence
gctgcgacgactgcgcca

SEQ ID NO: 9986 - DNA, 18 bp, Artificial sequence
  synthetic polynucleotide sequence
ggctgtgcgcgtccagga

SEQ ID NO: 9987 - DNA, 18 bp, Artificial sequence
  synthetic polynucleotide sequence
cgggaaagagcagggcca

SEQ ID NO: 9988 - DNA, 18 bp, Artificial sequence
  synthetic polynucleotide sequence
gaggaaggcacttcacca

SEQ ID NO: 9989 - DNA, 18 bp, Artificial sequence
  synthetic polynucleotide sequence
taacgtgggcacggacga

SEQ ID NO: 9990 - DNA, 18 bp, Artificial sequence
  synthetic polynucleotide sequence
cgcttcgagtgaagcgca

SEQ ID NO: 9991 - DNA, 18 bp, Artificial sequence
  synthetic polynucleotide sequence
cagccaatgacaggccca

SEQ ID NO: 9992 - DNA, 18 bp, Artificial sequence
  synthetic polynucleotide sequence
agctggaggaagtcacca

SEQ ID NO: 9993 - DNA, 18 bp, Artificial sequence
  synthetic polynucleotide sequence
caggaggctccacacaca

SEQ ID NO: 9994 - DNA, 18 bp, Artificial sequence
  synthetic polynucleotide sequence
gccaggtagggaagcaga

SEQ ID NO: 9995 - DNA, 18 bp, Artificial sequence
  synthetic polynucleotide sequence
ggctgcagctggatgaca

SEQ ID NO: 9996 - DNA, 18 bp, Artificial sequence
  synthetic polynucleotide sequence
catcctggcggcagagca

SEQ ID NO: 9997 - DNA, 18 bp, Artificial sequence
  synthetic polynucleotide sequence
ctgctccacccagcggta

SEQ ID NO: 9998 - DNA, 18 bp, Artificial sequence
  synthetic polynucleotide sequence
tgtgcgggagatgaacga

SEQ ID NO: 9999 - DNA, 18 bp, Artificial sequence
  synthetic polynucleotide sequence
agagctggtccatccaga

SEQ ID NO: 10000 - DNA, 18 bp, Artificial sequence
  synthetic polynucleotide sequence
atgcgcagttcggcagca

SEQ ID NO: 10001 - DNA, 18 bp, Artificial sequence
  synthetic polynucleotide sequence
gcaggagaggggttccga

SEQ ID NO: 10002 - DNA, 18 bp, Artificial sequence
  synthetic polynucleotide sequence
gcaggagaggggttccga

SEQ ID NO: 10003 - DNA, 18 bp, Artificial sequence
  synthetic polynucleotide sequence
cgtgcaccgctacggcca

SEQ ID NO: 10004 - DNA, 18 bp, Artificial sequence
  synthetic polynucleotide sequence
gagggtcataactgggca

SEQ ID NO: 10005 - DNA, 18 bp, Artificial sequence
  synthetic polynucleotide sequence
cgcgatgtaaggaagcca

SEQ ID NO: 10006 - DNA, 18 bp, Artificial sequence
  synthetic polynucleotide sequence
gtatccaccgccagccca

SEQ ID NO: 10007 - DNA, 18 bp, Artificial sequence
  synthetic polynucleotide sequence
gcgaaactgcaccagcga

SEQ ID NO: 10008 - DNA, 18 bp, Artificial sequence
  synthetic polynucleotide sequence
cgcccacgcaagtccaca

SEQ ID NO: 10009 - DNA, 18 bp, Artificial sequence
  synthetic polynucleotide sequence
ccaagtccccagaggaga

SEQ ID NO: 10010 - DNA, 18 bp, Artificial sequence
  synthetic polynucleotide sequence
tctgctggccgaagccca

SEQ ID NO: 10011 - DNA, 18 bp, Artificial sequence
  synthetic polynucleotide sequence
gcctcacctgcatagcaa

SEQ ID NO: 10012 - DNA, 18 bp, Artificial sequence
  synthetic polynucleotide sequence
gccacgtcattggaggca

SEQ ID NO: 10013 - DNA, 18 bp, Artificial sequence
  synthetic polynucleotide sequence
cctccgcgttgcccagca

SEQ ID NO: 10014 - DNA, 18 bp, Artificial sequence
  synthetic polynucleotide sequence
ccacatcctgaaggcgga

SEQ ID NO: 10015 - DNA, 18 bp, Artificial sequence
  synthetic polynucleotide sequence
gcaggctcacgaagacca

SEQ ID NO: 10016 - DNA, 18 bp, Artificial sequence
  synthetic polynucleotide sequence
cgacccgcgacgggcaca

SEQ ID NO: 10017 - DNA, 18 bp, Artificial sequence
  synthetic polynucleotide sequence
ctgagttggcaggaagga

SEQ ID NO: 10018 - DNA, 18 bp, Artificial sequence
  synthetic polynucleotide sequence
ggaggcagctgatggcaa

SEQ ID NO: 10019 - DNA, 18 bp, Artificial sequence
  synthetic polynucleotide sequence
tgctggtagccagggcca

SEQ ID NO: 10020 - DNA, 18 bp, Artificial sequence
  synthetic polynucleotide sequence
tgctggtagccagggcca

SEQ ID NO: 10021 - DNA, 18 bp, Artificial sequence
  synthetic polynucleotide sequence
actgccagaacggaggga

SEQ ID NO: 10022 - DNA, 18 bp, Artificial sequence
  synthetic polynucleotide sequence
gccagagtcggagccgca

SEQ ID NO: 10023 - DNA, 18 bp, Artificial sequence
  synthetic polynucleotide sequence
acgaccggtgcaacgaga

SEQ ID NO: 10024 - DNA, 18 bp, Artificial sequence
  synthetic polynucleotide sequence
gcacacgttggggtagca

SEQ ID NO: 10025 - DNA, 18 bp, Artificial sequence
  synthetic polynucleotide sequence
cccacgtcaacaacggca

SEQ ID NO: 10026 - DNA, 18 bp, Artificial sequence
  synthetic polynucleotide sequence
aagacggccaggcccaca

SEQ ID NO: 10027 - DNA, 18 bp, Artificial sequence
  synthetic polynucleotide sequence
gagagccccacatgagga

SEQ ID NO: 10028 - DNA, 18 bp, Artificial sequence
  synthetic polynucleotide sequence
gtccaggtagaccggaga

SEQ ID NO: 10029 - DNA, 18 bp, Artificial sequence
  synthetic polynucleotide sequence
agacctggccaccaggaa

SEQ ID NO: 10030 - DNA, 18 bp, Artificial sequence
  synthetic polynucleotide sequence
tcaggaggcatccagcga

SEQ ID NO: 10031 - DNA, 18 bp, Artificial sequence
  synthetic polynucleotide sequence
ggctgtagctccgggaga

SEQ ID NO: 10032 - DNA, 18 bp, Artificial sequence
  synthetic polynucleotide sequence
ccagggtaacctcccaca

SEQ ID NO: 10033 - DNA, 18 bp, Artificial sequence
  synthetic polynucleotide sequence
cttctggcgacagcggca

SEQ ID NO: 10034 - DNA, 18 bp, Artificial sequence
  synthetic polynucleotide sequence
gatgcactcgtggccgaa

SEQ ID NO: 10035 - DNA, 18 bp, Artificial sequence
  synthetic polynucleotide sequence
caaggccaaggacgggca

SEQ ID NO: 10036 - DNA, 18 bp, Artificial sequence
  synthetic polynucleotide sequence
tctccacgccccaggaca

SEQ ID NO: 10037 - DNA, 18 bp, Artificial sequence
  synthetic polynucleotide sequence
cggtgtaggcagggtgca

SEQ ID NO: 10038 - DNA, 18 bp, Artificial sequence
  synthetic polynucleotide sequence
cggtgtaggcagggtgca

SEQ ID NO: 10039 - DNA, 18 bp, Artificial sequence
  synthetic polynucleotide sequence
aagcccgtgcacgccgaa

SEQ ID NO: 10040 - DNA, 18 bp, Artificial sequence
  synthetic polynucleotide sequence
ctggcgaggatggggcca

SEQ ID NO: 10041 - DNA, 18 bp, Artificial sequence
  synthetic polynucleotide sequence
ccaacctgtggaaatgca

SEQ ID NO: 10042 - DNA, 18 bp, Artificial sequence
  synthetic polynucleotide sequence
acgccattgagactagga

SEQ ID NO: 10043 - DNA, 18 bp, Artificial sequence
  synthetic polynucleotide sequence
tggaggagggtgagctca

SEQ ID NO: 10044 - DNA, 18 bp, Artificial sequence
  synthetic polynucleotide sequence
cgccgagggtcttgggga

SEQ ID NO: 10045 - DNA, 18 bp, Artificial sequence
  synthetic polynucleotide sequence
ccaggagtcggagtcgga

SEQ ID NO: 10046 - DNA, 18 bp, Artificial sequence
  synthetic polynucleotide sequence
gacctccagggagttgga

SEQ ID NO: 10047 - DNA, 18 bp, Artificial sequence
  synthetic polynucleotide sequence
cccccacagttctacgaa

SEQ ID NO: 10048 - DNA, 18 bp, Artificial sequence
  synthetic polynucleotide sequence
tggaccatcccatcagca

SEQ ID NO: 10049 - DNA, 18 bp, Artificial sequence
  synthetic polynucleotide sequence
ctccatcctgacgaccca

SEQ ID NO: 10050 - DNA, 18 bp, Artificial sequence
  synthetic polynucleotide sequence
tgagcaccggctacccca

SEQ ID NO: 10051 - DNA, 18 bp, Artificial sequence
  synthetic polynucleotide sequence
acttccctcacggcagca

SEQ ID NO: 10052 - DNA, 18 bp, Artificial sequence
  synthetic polynucleotide sequence
ggtacccagaccagtgga

SEQ ID NO: 10053 - DNA, 18 bp, Artificial sequence
  synthetic polynucleotide sequence
taccacgatgtggaagca

SEQ ID NO: 10054 - DNA, 18 bp, Artificial sequence
  synthetic polynucleotide sequence
cccccttcgacgcccaga

SEQ ID NO: 10055 - DNA, 18 bp, Artificial sequence
  synthetic polynucleotide sequence
cgggtctcagcatcagca

SEQ ID NO: 10056 - DNA, 18 bp, Artificial sequence
  synthetic polynucleotide sequence
cgggtctcagcatcagca

SEQ ID NO: 10057 - DNA, 18 bp, Artificial sequence
  synthetic polynucleotide sequence
gtcccagccctgcaacca

SEQ ID NO: 10058 - DNA, 18 bp, Artificial sequence
  synthetic polynucleotide sequence
gccaccatctgggaggga

SEQ ID NO: 10059 - DNA, 18 bp, Artificial sequence
  synthetic polynucleotide sequence
ggaatgacagaagaggca

SEQ ID NO: 10060 - DNA, 18 bp, Artificial sequence
  synthetic polynucleotide sequence
cacccggaagtaggccca

SEQ ID NO: 10061 - DNA, 18 bp, Artificial sequence
  synthetic polynucleotide sequence
ctggagcatgaggagcaa

SEQ ID NO: 10062 - DNA, 18 bp, Artificial sequence
  synthetic polynucleotide sequence
gactagcagcctgcagca

SEQ ID NO: 10063 - DNA, 18 bp, Artificial sequence
  synthetic polynucleotide sequence
cccaccgcaacaagccca

SEQ ID NO: 10064 - DNA, 18 bp, Artificial sequence
  synthetic polynucleotide sequence
cactgccatgatgaccca

SEQ ID NO: 10065 - DNA, 18 bp, Artificial sequence
  synthetic polynucleotide sequence
gtcacagcgatccaagga

SEQ ID NO: 10066 - DNA, 18 bp, Artificial sequence
  synthetic polynucleotide sequence
ctggacagtacacgagca

SEQ ID NO: 10067 - DNA, 18 bp, Artificial sequence
  synthetic polynucleotide sequence
acctggcacagctggaga

SEQ ID NO: 10068 - DNA, 18 bp, Artificial sequence
  synthetic polynucleotide sequence
aaacggacccgcagagca

SEQ ID NO: 10069 - DNA, 18 bp, Artificial sequence
  synthetic polynucleotide sequence
tctgagggacgctgacca

SEQ ID NO: 10070 - DNA, 18 bp, Artificial sequence
  synthetic polynucleotide sequence
tcctccacatcgacccca

SEQ ID NO: 10071 - DNA, 18 bp, Artificial sequence
  synthetic polynucleotide sequence
ggcacggaactgaaccca

SEQ ID NO: 10072 - DNA, 18 bp, Artificial sequence
  synthetic polynucleotide sequence
ttgggcaagtggcagcca

SEQ ID NO: 10073 - DNA, 18 bp, Artificial sequence
  synthetic polynucleotide sequence
tatccaatcccgcacgga

SEQ ID NO: 10074 - DNA, 18 bp, Artificial sequence
  synthetic polynucleotide sequence
tatccaatcccgcacgga

SEQ ID NO: 10075 - DNA, 18 bp, Artificial sequence
  synthetic polynucleotide sequence
tgtggcccacctgacaga

SEQ ID NO: 10076 - DNA, 18 bp, Artificial sequence
  synthetic polynucleotide sequence
tgtgcagctccagggaga

SEQ ID NO: 10077 - DNA, 18 bp, Artificial sequence
  synthetic polynucleotide sequence
gcgcagtttgaagcagca

SEQ ID NO: 10078 - DNA, 18 bp, Artificial sequence
  synthetic polynucleotide sequence
aagcaaggagggtcacca

SEQ ID NO: 10079 - DNA, 18 bp, Artificial sequence
  synthetic polynucleotide sequence
acaccagaccctcagcga

SEQ ID NO: 10080 - DNA, 18 bp, Artificial sequence
  synthetic polynucleotide sequence
actgggtaaggctgcgca

SEQ ID NO: 10081 - DNA, 18 bp, Artificial sequence
  synthetic polynucleotide sequence
accacaggggcctccaca

SEQ ID NO: 10082 - DNA, 18 bp, Artificial sequence
  synthetic polynucleotide sequence
cagaggcaggattggaca

SEQ ID NO: 10083 - DNA, 18 bp, Artificial sequence
  synthetic polynucleotide sequence
ccttcccaccagcaacca

SEQ ID NO: 10084 - DNA, 18 bp, Artificial sequence
  synthetic polynucleotide sequence
cgaggtaggaatgggcca

SEQ ID NO: 10085 - DNA, 18 bp, Artificial sequence
  synthetic polynucleotide sequence
tgcccccagacacggtca

SEQ ID NO: 10086 - DNA, 18 bp, Artificial sequence
  synthetic polynucleotide sequence
agccaacgacgctcgcaa

SEQ ID NO: 10087 - DNA, 18 bp, Artificial sequence
  synthetic polynucleotide sequence
tagctcaggagacctgga

SEQ ID NO: 10088 - DNA, 18 bp, Artificial sequence
  synthetic polynucleotide sequence
cccaaggagatcccacca

SEQ ID NO: 10089 - DNA, 18 bp, Artificial sequence
  synthetic polynucleotide sequence
gaggggagacacaggcta

SEQ ID NO: 10090 - DNA, 18 bp, Artificial sequence
  synthetic polynucleotide sequence
ctgagcgggaattggaca

SEQ ID NO: 10091 - DNA, 18 bp, Artificial sequence
  synthetic polynucleotide sequence
tcctcagccagtcccaga

SEQ ID NO: 10092 - DNA, 18 bp, Artificial sequence
  synthetic polynucleotide sequence
tcctcagccagtcccaga

SEQ ID NO: 10093 - DNA, 18 bp, Artificial sequence
  synthetic polynucleotide sequence
acagtctccggtgcccaa

SEQ ID NO: 10094 - DNA, 18 bp, Artificial sequence
  synthetic polynucleotide sequence
gttggccagccaatccca

SEQ ID NO: 10095 - DNA, 18 bp, Artificial sequence
  synthetic polynucleotide sequence
acgctcagagctcagcca

SEQ ID NO: 10096 - DNA, 18 bp, Artificial sequence
  synthetic polynucleotide sequence
ggcacaccttctggacca

SEQ ID NO: 10097 - DNA, 18 bp, Artificial sequence
  synthetic polynucleotide sequence
cgagcacacgcagagcca

SEQ ID NO: 10098 - DNA, 18 bp, Artificial sequence
  synthetic polynucleotide sequence
ggcacaccttctgcacca

SEQ ID NO: 10099 - DNA, 18 bp, Artificial sequence
  synthetic polynucleotide sequence
ctgcagagctgctgagga

SEQ ID NO: 10100 - DNA, 18 bp, Artificial sequence
  synthetic polynucleotide sequence
ggcagtctaccacgctga

SEQ ID NO: 10101 - DNA, 18 bp, Artificial sequence
  synthetic polynucleotide sequence
cagaaccagcggccacca

SEQ ID NO: 10102 - DNA, 18 bp, Artificial sequence
  synthetic polynucleotide sequence
aggagaggctgtcggaca

SEQ ID NO: 10103 - DNA, 18 bp, Artificial sequence
  synthetic polynucleotide sequence
gcagctgcggatgccaca

SEQ ID NO: 10104 - DNA, 18 bp, Artificial sequence
  synthetic polynucleotide sequence
tggagcaaggtgtggaca

SEQ ID NO: 10105 - DNA, 18 bp, Artificial sequence
  synthetic polynucleotide sequence
ccccaagatgcactggca

SEQ ID NO: 10106 - DNA, 18 bp, Artificial sequence
  synthetic polynucleotide sequence
agcacactccaggcagca

SEQ ID NO: 10107 - DNA, 18 bp, Artificial sequence
  synthetic polynucleotide sequence
gcagggagaggataacca

SEQ ID NO: 10108 - DNA, 18 bp, Artificial sequence
  synthetic polynucleotide sequence
gatcttggacccagccga

SEQ ID NO: 10109 - DNA, 18 bp, Artificial sequence
  synthetic polynucleotide sequence
cccacagcatcgaaggca

SEQ ID NO: 10110 - DNA, 18 bp, Artificial sequence
  synthetic polynucleotide sequence
cccacagcatcgaaggca

SEQ ID NO: 10111 - DNA, 18 bp, Artificial sequence
  synthetic polynucleotide sequence
agaccatcccctccgaga

SEQ ID NO: 10112 - DNA, 18 bp, Artificial sequence
  synthetic polynucleotide sequence
ccaaccagtcctgcagga

SEQ ID NO: 10113 - DNA, 18 bp, Artificial sequence
  synthetic polynucleotide sequence
gttccacagacccaacca

SEQ ID NO: 10114 - DNA, 18 bp, Artificial sequence
  synthetic polynucleotide sequence
agagctctcgcactccca

SEQ ID NO: 10115 - DNA, 18 bp, Artificial sequence
  synthetic polynucleotide sequence
gacggccatgaagtgaga

SEQ ID NO: 10116 - DNA, 18 bp, Artificial sequence
  synthetic polynucleotide sequence
gatctcatcccacacgga

SEQ ID NO: 10117 - DNA, 18 bp, Artificial sequence
  synthetic polynucleotide sequence
cctggtacgtgaaggcca

SEQ ID NO: 10118 - DNA, 18 bp, Artificial sequence
  synthetic polynucleotide sequence
ccaacttcccaccgccca

SEQ ID NO: 10119 - DNA, 18 bp, Artificial sequence
  synthetic polynucleotide sequence
gcctcaagtccccaagca

SEQ ID NO: 10120 - DNA, 18 bp, Artificial sequence
  synthetic polynucleotide sequence
cctcagagctggagccca

SEQ ID NO: 10121 - DNA, 18 bp, Artificial sequence
  synthetic polynucleotide sequence
agctcagcagggcctcca

SEQ ID NO: 10122 - DNA, 18 bp, Artificial sequence
  synthetic polynucleotide sequence
cgcagtgttccaggacca

SEQ ID NO: 10123 - DNA, 18 bp, Artificial sequence
  synthetic polynucleotide sequence
attcatcagcagcagcca

SEQ ID NO: 10124 - DNA, 18 bp, Artificial sequence
  synthetic polynucleotide sequence
gacactggcctacaggaa

SEQ ID NO: 10125 - DNA, 18 bp, Artificial sequence
  synthetic polynucleotide sequence
tgtcggcagatccgggga

SEQ ID NO: 10126 - DNA, 18 bp, Artificial sequence
  synthetic polynucleotide sequence
gacccctggaatgcagga

SEQ ID NO: 10127 - DNA, 18 bp, Artificial sequence
  synthetic polynucleotide sequence
gttcccagggtaggacca

SEQ ID NO: 10128 - DNA, 18 bp, Artificial sequence
  synthetic polynucleotide sequence
gttcccagggtaggacca

SEQ ID NO: 10129 - DNA, 18 bp, Artificial sequence
  synthetic polynucleotide sequence
ccacgctcagaaccagca

SEQ ID NO: 10130 - DNA, 18 bp, Artificial sequence
  synthetic polynucleotide sequence
cacagcgggcatcagaga

SEQ ID NO: 10131 - DNA, 18 bp, Artificial sequence
  synthetic polynucleotide sequence
gagcttgccaaactgaga

SEQ ID NO: 10132 - DNA, 18 bp, Artificial sequence
  synthetic polynucleotide sequence
tctcccgctcagccgaca

SEQ ID NO: 10133 - DNA, 18 bp, Artificial sequence
  synthetic polynucleotide sequence
agccgagaagagcgagga

SEQ ID NO: 10134 - DNA, 18 bp, Artificial sequence
  synthetic polynucleotide sequence
gtagcggctcctccagga

SEQ ID NO: 10135 - DNA, 18 bp, Artificial sequence
  synthetic polynucleotide sequence
ctgcagggaacatgccaa

SEQ ID NO: 10136 - DNA, 18 bp, Artificial sequence
  synthetic polynucleotide sequence
gctgatatgagaggggca

SEQ ID NO: 10137 - DNA, 18 bp, Artificial sequence
  synthetic polynucleotide sequence
cccagatgtcctgccaga

SEQ ID NO: 10138 - DNA, 18 bp, Artificial sequence
  synthetic polynucleotide sequence
gcttccggaatggcagca

SEQ ID NO: 10139 - DNA, 18 bp, Artificial sequence
  synthetic polynucleotide sequence
agggccaaggtctgggca

SEQ ID NO: 10140 - DNA, 18 bp, Artificial sequence
  synthetic polynucleotide sequence
ggtgaggaagcggaggaa

SEQ ID NO: 10141 - DNA, 18 bp, Artificial sequence
  synthetic polynucleotide sequence
gaggagaggctggaggga

SEQ ID NO: 10142 - DNA, 18 bp, Artificial sequence
  synthetic polynucleotide sequence
ccaggatcacctccgaga

SEQ ID NO: 10143 - DNA, 18 bp, Artificial sequence
  synthetic polynucleotide sequence
ctcgtccaacactccaca

SEQ ID NO: 10144 - DNA, 18 bp, Artificial sequence
  synthetic polynucleotide sequence
gcagtacacatcccggga

SEQ ID NO: 10145 - DNA, 18 bp, Artificial sequence
  synthetic polynucleotide sequence
tggcgtacacggcccaca

SEQ ID NO: 10146 - DNA, 18 bp, Artificial sequence
  synthetic polynucleotide sequence
tggcgtacacggcccaca

SEQ ID NO: 10147 - DNA, 18 bp, Artificial sequence
  synthetic polynucleotide sequence
ccggggtcagtaacccca

SEQ ID NO: 10148 - DNA, 18 bp, Artificial sequence
  synthetic polynucleotide sequence
agtctcccagggtacgga

SEQ ID NO: 10149 - DNA, 18 bp, Artificial sequence
  synthetic polynucleotide sequence
tccaccaaaacctccaca

SEQ ID NO: 10150 - DNA, 18 bp, Artificial sequence
  synthetic polynucleotide sequence
gggtgacattgaacagca

SEQ ID NO: 10151 - DNA, 18 bp, Artificial sequence
  synthetic polynucleotide sequence
ctcctcccactccaggga

SEQ ID NO: 10152 - DNA, 18 bp, Artificial sequence
  synthetic polynucleotide sequence
attcaatggcgccaccca

SEQ ID NO: 10153 - DNA, 18 bp, Artificial sequence
  synthetic polynucleotide sequence
cccatgcagaagccagga

SEQ ID NO: 10154 - DNA, 18 bp, Artificial sequence
  synthetic polynucleotide sequence
ggaagaacaagttgggca

SEQ ID NO: 10155 - DNA, 18 bp, Artificial sequence
  synthetic polynucleotide sequence
caaccagcaggaaggcca

SEQ ID NO: 10156 - DNA, 18 bp, Artificial sequence
  synthetic polynucleotide sequence
gctcgttgaggaacggca

SEQ ID NO: 10157 - DNA, 18 bp, Artificial sequence
  synthetic polynucleotide sequence
cgaacagcagcctgggga

SEQ ID NO: 10158 - DNA, 18 bp, Artificial sequence
  synthetic polynucleotide sequence
cggacctgagcacacaga

SEQ ID NO: 10159 - DNA, 18 bp, Artificial sequence
  synthetic polynucleotide sequence
gacatagagggtcccaca

SEQ ID NO: 10160 - DNA, 18 bp, Artificial sequence
  synthetic polynucleotide sequence
cctggcagctgatgagga

SEQ ID NO: 10161 - DNA, 18 bp, Artificial sequence
  synthetic polynucleotide sequence
tggagccgaccgacggca

SEQ ID NO: 10162 - DNA, 18 bp, Artificial sequence
  synthetic polynucleotide sequence
ctggaggagatgaagcga

SEQ ID NO: 10163 - DNA, 18 bp, Artificial sequence
  synthetic polynucleotide sequence
gggagacagcgcctcgga

SEQ ID NO: 10164 - DNA, 18 bp, Artificial sequence
  synthetic polynucleotide sequence
gggagacagcgcctcgga

SEQ ID NO: 10165 - DNA, 22 bp, Artificial sequence
  synthetic polynucleotide sequence
gatgggctagtaaacttgacca

SEQ ID NO: 10166 - DNA, 19 bp, Artificial sequence
  synthetic polynucleotide sequence
gaaggcaaaccaggaggca

SEQ ID NO: 10167 - DNA, 18 bp, Artificial sequence
  synthetic polynucleotide sequence
aggccatcttcgcgcaga

SEQ ID NO: 10168 - DNA, 18 bp, Artificial sequence
  synthetic polynucleotide sequence
cctgcagccacttccaca

SEQ ID NO: 10169 - DNA, 18 bp, Artificial sequence
  synthetic polynucleotide sequence
ctgagccaggttacacca

SEQ ID NO: 10170 - DNA, 18 bp, Artificial sequence
  synthetic polynucleotide sequence
ctgcgcagctggaaggta

SEQ ID NO: 10171 - DNA, 18 bp, Artificial sequence
  synthetic polynucleotide sequence
ggaacaccaatgccagca

SEQ ID NO: 10172 - DNA, 18 bp, Artificial sequence
  synthetic polynucleotide sequence
gagggtccctgatagcca

SEQ ID NO: 10173 - DNA, 18 bp, Artificial sequence
  synthetic polynucleotide sequence
ccaaggagaaggaccgca

SEQ ID NO: 10174 - DNA, 18 bp, Artificial sequence
  synthetic polynucleotide sequence
atgcacaggtgcagcgca

SEQ ID NO: 10175 - DNA, 18 bp, Artificial sequence
  synthetic polynucleotide sequence
agcctaaggcgatgcaga

SEQ ID NO: 10176 - DNA, 18 bp, Artificial sequence
  synthetic polynucleotide sequence
acctgcgtaggatcacca

SEQ ID NO: 10177 - DNA, 18 bp, Artificial sequence
  synthetic polynucleotide sequence
tgggagtccagcagacga

SEQ ID NO: 10178 - DNA, 18 bp, Artificial sequence
  synthetic polynucleotide sequence
gcctcaagagtgtccgca

SEQ ID NO: 10179 - DNA, 18 bp, Artificial sequence
  synthetic polynucleotide sequence
ggttgccatccaggcgga

SEQ ID NO: 10180 - DNA, 18 bp, Artificial sequence
  synthetic polynucleotide sequence
ctgcagccttcagggcaa

SEQ ID NO: 10181 - DNA, 18 bp, Artificial sequence
  synthetic polynucleotide sequence
gggcaggaatgaatcgga

SEQ ID NO: 10182 - DNA, 18 bp, Artificial sequence
  synthetic polynucleotide sequence
gggcaggaatgaatcgga

SEQ ID NO: 10183 - DNA, 18 bp, Artificial sequence
  synthetic polynucleotide sequence
cccaagaatgctcatgga

SEQ ID NO: 10184 - DNA, 18 bp, Artificial sequence
  synthetic polynucleotide sequence
atagccacgtagcggtca

SEQ ID NO: 10185 - DNA, 18 bp, Artificial sequence
  synthetic polynucleotide sequence
ccctcctggccaccggca

SEQ ID NO: 10186 - DNA, 18 bp, Artificial sequence
  synthetic polynucleotide sequence
aggacagcactatcagga

SEQ ID NO: 10187 - DNA, 18 bp, Artificial sequence
  synthetic polynucleotide sequence
gccctactgtggacccaa

SEQ ID NO: 10188 - DNA, 18 bp, Artificial sequence
  synthetic polynucleotide sequence
cacaggccagtttcagga

SEQ ID NO: 10189 - DNA, 18 bp, Artificial sequence
  synthetic polynucleotide sequence
ctcaccatggtcaccgaa

SEQ ID NO: 10190 - DNA, 18 bp, Artificial sequence
  synthetic polynucleotide sequence
ccaggtggatgacactga

SEQ ID NO: 10191 - DNA, 18 bp, Artificial sequence
  synthetic polynucleotide sequence
cctcccgccactcatgca

SEQ ID NO: 10192 - DNA, 18 bp, Artificial sequence
  synthetic polynucleotide sequence
acagccaggtgggagcca

SEQ ID NO: 10193 - DNA, 18 bp, Artificial sequence
  synthetic polynucleotide sequence
gggagccacatgtggaca

SEQ ID NO: 10194 - DNA, 18 bp, Artificial sequence
  synthetic polynucleotide sequence
tgcgaacaccatccccca

SEQ ID NO: 10195 - DNA, 18 bp, Artificial sequence
  synthetic polynucleotide sequence
agcacagggctgaggtca

SEQ ID NO: 10196 - DNA, 18 bp, Artificial sequence
  synthetic polynucleotide sequence
caccatgagccaccacca

SEQ ID NO: 10197 - DNA, 18 bp, Artificial sequence
  synthetic polynucleotide sequence
ggacacagatagacgcca

SEQ ID NO: 10198 - DNA, 18 bp, Artificial sequence
  synthetic polynucleotide sequence
cagggatggtgatagcca

SEQ ID NO: 10199 - DNA, 18 bp, Artificial sequence
  synthetic polynucleotide sequence
agaggcccgactaagaca

SEQ ID NO: 10200 - DNA, 18 bp, Artificial sequence
  synthetic polynucleotide sequence
agaggcccgactaagaca

SEQ ID NO: 10201 - DNA, 18 bp, Artificial sequence
  synthetic polynucleotide sequence
aactccttggcacacaca

SEQ ID NO: 10202 - DNA, 18 bp, Artificial sequence
  synthetic polynucleotide sequence
taggactcggccacagga

SEQ ID NO: 10203 - DNA, 18 bp, Artificial sequence
  synthetic polynucleotide sequence
atcacagtcccacccaca

SEQ ID NO: 10204 - DNA, 18 bp, Artificial sequence
  synthetic polynucleotide sequence
gttccacaacctgccaga

SEQ ID NO: 10205 - DNA, 18 bp, Artificial sequence
  synthetic polynucleotide sequence
aactggcctgtgcagaca

SEQ ID NO: 10206 - DNA, 18 bp, Artificial sequence
  synthetic polynucleotide sequence
tgtggaaggactggggca

SEQ ID NO: 10207 - DNA, 18 bp, Artificial sequence
  synthetic polynucleotide sequence
cagtcttcgaaaacgcca

SEQ ID NO: 10208 - DNA, 18 bp, Artificial sequence
  synthetic polynucleotide sequence
gtagagcgcatgtgcaga

SEQ ID NO: 10209 - DNA, 18 bp, Artificial sequence
  synthetic polynucleotide sequence
ccagctcatacaccctca

SEQ ID NO: 10210 - DNA, 18 bp, Artificial sequence
  synthetic polynucleotide sequence
aggaagcaccgaagagca

SEQ ID NO: 10211 - DNA, 18 bp, Artificial sequence
  synthetic polynucleotide sequence
agtgcaagggcttgcaga

SEQ ID NO: 10212 - DNA, 18 bp, Artificial sequence
  synthetic polynucleotide sequence
catcactgagatccccca

SEQ ID NO: 10213 - DNA, 18 bp, Artificial sequence
  synthetic polynucleotide sequence
gagagcaagatgacagca

SEQ ID NO: 10214 - DNA, 18 bp, Artificial sequence
  synthetic polynucleotide sequence
atgggggtagcctggaca

SEQ ID NO: 10215 - DNA, 18 bp, Artificial sequence
  synthetic polynucleotide sequence
gccctctgcacctccgaa

SEQ ID NO: 10216 - DNA, 18 bp, Artificial sequence
  synthetic polynucleotide sequence
catcactggggtccccca

SEQ ID NO: 10217 - DNA, 18 bp, Artificial sequence
  synthetic polynucleotide sequence
cccaagcccctcctacca

SEQ ID NO: 10218 - DNA, 18 bp, Artificial sequence
  synthetic polynucleotide sequence
cccaagcccctcctacca

SEQ ID NO: 10219 - DNA, 18 bp, Artificial sequence
  synthetic polynucleotide sequence
cccaggtcctcaaactca

SEQ ID NO: 10220 - DNA, 18 bp, Artificial sequence
  synthetic polynucleotide sequence
cctgagacctcagcgtca

SEQ ID NO: 10221 - DNA, 18 bp, Artificial sequence
  synthetic polynucleotide sequence
agggttgcatggcccaga

SEQ ID NO: 10222 - DNA, 18 bp, Artificial sequence
  synthetic polynucleotide sequence
cacctcattgggaccaca

SEQ ID NO: 10223 - DNA, 18 bp, Artificial sequence
  synthetic polynucleotide sequence
gccccaatgaggtagaca

SEQ ID NO: 10224 - DNA, 18 bp, Artificial sequence
  synthetic polynucleotide sequence
gtgcagagcaagtggaga

SEQ ID NO: 10225 - DNA, 18 bp, Artificial sequence
  synthetic polynucleotide sequence
ggacaatcatgagccaca

SEQ ID NO: 10226 - DNA, 18 bp, Artificial sequence
  synthetic polynucleotide sequence
gagagcagcccgctgtca

SEQ ID NO: 10227 - DNA, 18 bp, Artificial sequence
  synthetic polynucleotide sequence
tcagaccctgggctcaca

SEQ ID NO: 10228 - DNA, 18 bp, Artificial sequence
  synthetic polynucleotide sequence
aggccatcacaacgagga

SEQ ID NO: 10229 - DNA, 18 bp, Artificial sequence
  synthetic polynucleotide sequence
agcagacaagagacagca

SEQ ID NO: 10230 - DNA, 18 bp, Artificial sequence
  synthetic polynucleotide sequence
gtcatgaacccccagcta

SEQ ID NO: 10231 - DNA, 18 bp, Artificial sequence
  synthetic polynucleotide sequence
gtgggagccacaggtgga

SEQ ID NO: 10232 - DNA, 18 bp, Artificial sequence
  synthetic polynucleotide sequence
cagccaacagtggtacca

SEQ ID NO: 10233 - DNA, 18 bp, Artificial sequence
  synthetic polynucleotide sequence
gtccaggccaatggcgga

SEQ ID NO: 10234 - DNA, 18 bp, Artificial sequence
  synthetic polynucleotide sequence
ctgtcacccactgcgcca

SEQ ID NO: 10235 - DNA, 18 bp, Artificial sequence
  synthetic polynucleotide sequence
tgcgggcattgaggcaga

SEQ ID NO: 10236 - DNA, 18 bp, Artificial sequence
  synthetic polynucleotide sequence
tgcgggcattgaggcaga

SEQ ID NO: 10237 - DNA, 18 bp, Artificial sequence
  synthetic polynucleotide sequence
tgacactcagggctgcca

SEQ ID NO: 10238 - DNA, 18 bp, Artificial sequence
  synthetic polynucleotide sequence
cagtagccagcttcacga

SEQ ID NO: 10239 - DNA, 18 bp, Artificial sequence
  synthetic polynucleotide sequence
catgatcctcaccagcaa

SEQ ID NO: 10240 - DNA, 18 bp, Artificial sequence
  synthetic polynucleotide sequence
tgatgctggcacaggcca

SEQ ID NO: 10241 - DNA, 18 bp, Artificial sequence
  synthetic polynucleotide sequence
cctgctctgagaaacaca

SEQ ID NO: 10242 - DNA, 18 bp, Artificial sequence
  synthetic polynucleotide sequence
gcaatgaggtgagaacca

SEQ ID NO: 10243 - DNA, 18 bp, Artificial sequence
  synthetic polynucleotide sequence
tgaggacatggaacagga

SEQ ID NO: 10244 - DNA, 18 bp, Artificial sequence
  synthetic polynucleotide sequence
tcagaccaaggttccaca

SEQ ID NO: 10245 - DNA, 18 bp, Artificial sequence
  synthetic polynucleotide sequence
ctcggctccacaccccca

SEQ ID NO: 10246 - DNA, 18 bp, Artificial sequence
  synthetic polynucleotide sequence
cacgcaccttccaagaca

SEQ ID NO: 10247 - DNA, 18 bp, Artificial sequence
  synthetic polynucleotide sequence
agggggttcagcatggga

SEQ ID NO: 10248 - DNA, 18 bp, Artificial sequence
  synthetic polynucleotide sequence
ttcaggcaacagtggaga

SEQ ID NO: 10249 - DNA, 18 bp, Artificial sequence
  synthetic polynucleotide sequence
cacactcagtgcagccca

SEQ ID NO: 10250 - DNA, 18 bp, Artificial sequence
  synthetic polynucleotide sequence
gtgctgactgagaacaca

SEQ ID NO: 10251 - DNA, 18 bp, Artificial sequence
  synthetic polynucleotide sequence
agcgaagagggttgcaga

SEQ ID NO: 10252 - DNA, 18 bp, Artificial sequence
  synthetic polynucleotide sequence
cccatctccacaacccca

SEQ ID NO: 10253 - DNA, 18 bp, Artificial sequence
  synthetic polynucleotide sequence
agtgtagaggactgcaga

SEQ ID NO: 10254 - DNA, 18 bp, Artificial sequence
  synthetic polynucleotide sequence
agtgtagaggactgcaga

SEQ ID NO: 10255 - DNA, 18 bp, Artificial sequence
  synthetic polynucleotide sequence
cctgggctgcaggctcca

SEQ ID NO: 10256 - DNA, 18 bp, Artificial sequence
  synthetic polynucleotide sequence
cggggcaatgacagtgga

SEQ ID NO: 10257 - DNA, 18 bp, Artificial sequence
  synthetic polynucleotide sequence
caggactggaggaagcca

SEQ ID NO: 10258 - DNA, 18 bp, Artificial sequence
  synthetic polynucleotide sequence
ggctgacgttgagccgca

SEQ ID NO: 10259 - DNA, 18 bp, Artificial sequence
  synthetic polynucleotide sequence
gggatcatgcaaagcaga

SEQ ID NO: 10260 - DNA, 18 bp, Artificial sequence
  synthetic polynucleotide sequence
taagggagctaagtggca

SEQ ID NO: 10261 - DNA, 18 bp, Artificial sequence
  synthetic polynucleotide sequence
cgaatatcgccccagaca

SEQ ID NO: 10262 - DNA, 18 bp, Artificial sequence
  synthetic polynucleotide sequence
aagcctctgaccagtcca

SEQ ID NO: 10263 - DNA, 20 bp, Artificial sequence
  synthetic polynucleotide sequence
ccctgattacagcataggca

SEQ ID NO: 10264 - DNA, 20 bp, Artificial sequence
  synthetic polynucleotide sequence
cctttaaccacgggttcaca

SEQ ID NO: 10265 - DNA, 18 bp, Artificial sequence
  synthetic polynucleotide sequence
caccggatgtggctacca

SEQ ID NO: 10266 - DNA, 18 bp, Artificial sequence
  synthetic polynucleotide sequence
cttccccagacacagcaa

SEQ ID NO: 10267 - DNA, 18 bp, Artificial sequence
  synthetic polynucleotide sequence
atagacagacagccccca

SEQ ID NO: 10268 - DNA, 18 bp, Artificial sequence
  synthetic polynucleotide sequence
cgtgggaggccaagagca

SEQ ID NO: 10269 - DNA, 18 bp, Artificial sequence
  synthetic polynucleotide sequence
tcgtccaggtaggaacca

SEQ ID NO: 10270 - DNA, 18 bp, Artificial sequence
  synthetic polynucleotide sequence
gtctccagatacgaggga

SEQ ID NO: 10271 - DNA, 18 bp, Artificial sequence
  synthetic polynucleotide sequence
agacacgaaccccatgga

SEQ ID NO: 10272 - DNA, 18 bp, Artificial sequence
  synthetic polynucleotide sequence
agacacgaaccccatgga

SEQ ID NO: 10273 - DNA, 18 bp, Artificial sequence
  synthetic polynucleotide sequence
gcttccgtcagaccgaga

SEQ ID NO: 10274 - DNA, 18 bp, Artificial sequence
  synthetic polynucleotide sequence
gagtggatgtgagagcca

SEQ ID NO: 10275 - DNA, 18 bp, Artificial sequence
  synthetic polynucleotide sequence
gctctgacgggaagcaga

SEQ ID NO: 10276 - DNA, 18 bp, Artificial sequence
  synthetic polynucleotide sequence
cgttgagggtcagggcca

SEQ ID NO: 10277 - DNA, 18 bp, Artificial sequence
  synthetic polynucleotide sequence
caaaagcgtggaggcgga

SEQ ID NO: 10278 - DNA, 18 bp, Artificial sequence
  synthetic polynucleotide sequence
gacgttgtggacgcagca

SEQ ID NO: 10279 - DNA, 18 bp, Artificial sequence
  synthetic polynucleotide sequence
cggcacctacagctgcta

SEQ ID NO: 10280 - DNA, 18 bp, Artificial sequence
  synthetic polynucleotide sequence
cccagctgatgaccagca

SEQ ID NO: 10281 - DNA, 18 bp, Artificial sequence
  synthetic polynucleotide sequence
ccagatgatgcgggagca

SEQ ID NO: 10282 - DNA, 18 bp, Artificial sequence
  synthetic polynucleotide sequence
tgccccaggcaggaagga

SEQ ID NO: 10283 - DNA, 18 bp, Artificial sequence
  synthetic polynucleotide sequence
cagcagctgggccatgca

SEQ ID NO: 10284 - DNA, 18 bp, Artificial sequence
  synthetic polynucleotide sequence
agagcagcgcctccccaa

SEQ ID NO: 10285 - DNA, 18 bp, Artificial sequence
  synthetic polynucleotide sequence
tctcggtcgggggaggca

SEQ ID NO: 10286 - DNA, 18 bp, Artificial sequence
  synthetic polynucleotide sequence
cccagtagaggcaccaca

SEQ ID NO: 10287 - DNA, 18 bp, Artificial sequence
  synthetic polynucleotide sequence
cgatccatggggatacca

SEQ ID NO: 10288 - DNA, 18 bp, Artificial sequence
  synthetic polynucleotide sequence
gggaagagaaatcagcca

SEQ ID NO: 10289 - DNA, 18 bp, Artificial sequence
  synthetic polynucleotide sequence
accagcaggggacaacca

SEQ ID NO: 10290 - DNA, 18 bp, Artificial sequence
  synthetic polynucleotide sequence
accagcaggggacaacca

SEQ ID NO: 10291 - DNA, 18 bp, Artificial sequence
  synthetic polynucleotide sequence
gcaggaggacaagcagga

SEQ ID NO: 10292 - DNA, 18 bp, Artificial sequence
  synthetic polynucleotide sequence
caggaagtcgtcagcgga

SEQ ID NO: 10293 - DNA, 18 bp, Artificial sequence
  synthetic polynucleotide sequence
gggacctactgggccgaa

SEQ ID NO: 10294 - DNA, 18 bp, Artificial sequence
  synthetic polynucleotide sequence
tgtcccaggaatagagca

SEQ ID NO: 10295 - DNA, 18 bp, Artificial sequence
  synthetic polynucleotide sequence
tgacagccatcagcacca

SEQ ID NO: 10296 - DNA, 18 bp, Artificial sequence
  synthetic polynucleotide sequence
ccgcagcccccataagca

SEQ ID NO: 10297 - DNA, 18 bp, Artificial sequence
  synthetic polynucleotide sequence
tgtgcaggaggaaggaga

SEQ ID NO: 10298 - DNA, 18 bp, Artificial sequence
  synthetic polynucleotide sequence
cccagggggaagtgggca

SEQ ID NO: 10299 - DNA, 18 bp, Artificial sequence
  synthetic polynucleotide sequence
aggagcgagaagaacgga

SEQ ID NO: 10300 - DNA, 18 bp, Artificial sequence
  synthetic polynucleotide sequence
catacagtggccatcaga

SEQ ID NO: 10301 - DNA, 18 bp, Artificial sequence
  synthetic polynucleotide sequence
cacagcagatgacagcca

SEQ ID NO: 10302 - DNA, 18 bp, Artificial sequence
  synthetic polynucleotide sequence
ggggccatggtgtggaca

SEQ ID NO: 10303 - DNA, 18 bp, Artificial sequence
  synthetic polynucleotide sequence
gctgctgcaccccatgga

SEQ ID NO: 10304 - DNA, 18 bp, Artificial sequence
  synthetic polynucleotide sequence
tccgcacacacacaggca

SEQ ID NO: 10305 - DNA, 18 bp, Artificial sequence
  synthetic polynucleotide sequence
gctcaagaacagcccaca

SEQ ID NO: 10306 - DNA, 18 bp, Artificial sequence
  synthetic polynucleotide sequence
ctgtgactcaggccccaa

SEQ ID NO: 10307 - DNA, 18 bp, Artificial sequence
  synthetic polynucleotide sequence
gcaatggcaacactgcca

SEQ ID NO: 10308 - DNA, 18 bp, Artificial sequence
  synthetic polynucleotide sequence
gcaatggcaacactgcca

SEQ ID NO: 10309 - DNA, 18 bp, Artificial sequence
  synthetic polynucleotide sequence
atacggcgacctggcgaa

SEQ ID NO: 10310 - DNA, 18 bp, Artificial sequence
  synthetic polynucleotide sequence
gctgcatggtgaccacca

SEQ ID NO: 10311 - DNA, 18 bp, Artificial sequence
  synthetic polynucleotide sequence
gccagtgagtcaccgtca

SEQ ID NO: 10312 - DNA, 18 bp, Artificial sequence
  synthetic polynucleotide sequence
cacccactctcacagcca

SEQ ID NO: 10313 - DNA, 18 bp, Artificial sequence
  synthetic polynucleotide sequence
cctggtcgacggaaggga

SEQ ID NO: 10314 - DNA, 18 bp, Artificial sequence
  synthetic polynucleotide sequence
tgagccttcgacaccaga

SEQ ID NO: 10315 - DNA, 18 bp, Artificial sequence
  synthetic polynucleotide sequence
cctgccgtcgccctgcca

SEQ ID NO: 10316 - DNA, 18 bp, Artificial sequence
  synthetic polynucleotide sequence
gcttccgcgtcgcaggca

SEQ ID NO: 10317 - DNA, 18 bp, Artificial sequence
  synthetic polynucleotide sequence
ccaagatccgcacggtca

SEQ ID NO: 10318 - DNA, 18 bp, Artificial sequence
  synthetic polynucleotide sequence
tggcggagcagcacagga

SEQ ID NO: 10319 - DNA, 18 bp, Artificial sequence
  synthetic polynucleotide sequence
ccacgtagccaagctgga

SEQ ID NO: 10320 - DNA, 18 bp, Artificial sequence
  synthetic polynucleotide sequence
caaggtcaacaggcgcaa

SEQ ID NO: 10321 - DNA, 18 bp, Artificial sequence
  synthetic polynucleotide sequence
ccatgcctagcagtgcca

SEQ ID NO: 10322 - DNA, 18 bp, Artificial sequence
  synthetic polynucleotide sequence
cctggctggcaacgagca

SEQ ID NO: 10323 - DNA, 18 bp, Artificial sequence
  synthetic polynucleotide sequence
tgagtaccaggtcgcaga

SEQ ID NO: 10324 - DNA, 18 bp, Artificial sequence
  synthetic polynucleotide sequence
cgggagcgacttccagga

SEQ ID NO: 10325 - DNA, 18 bp, Artificial sequence
  synthetic polynucleotide sequence
ggagtagtgaggccagca

SEQ ID NO: 10326 - DNA, 18 bp, Artificial sequence
  synthetic polynucleotide sequence
ggagtagtgaggccagca

SEQ ID NO: 10327 - DNA, 18 bp, Artificial sequence
  synthetic polynucleotide sequence
gcctgcatcaccacctca

SEQ ID NO: 10328 - DNA, 18 bp, Artificial sequence
  synthetic polynucleotide sequence
gcgtagcacctgtaggca

SEQ ID NO: 10329 - DNA, 18 bp, Artificial sequence
  synthetic polynucleotide sequence
cagacgagtacctgcgaa

SEQ ID NO: 10330 - DNA, 18 bp, Artificial sequence
  synthetic polynucleotide sequence
agcccagaatcagcacca

SEQ ID NO: 10331 - DNA, 19 bp, Artificial sequence
  synthetic polynucleotide sequence
gggatcagtgagaggcaga

SEQ ID NO: 10332 - DNA, 18 bp, Artificial sequence
  synthetic polynucleotide sequence
acttgcaaggcacaggca

SEQ ID NO: 10333 - DNA, 18 bp, Artificial sequence
  synthetic polynucleotide sequence
cagaagaccaccaggcca

SEQ ID NO: 10334 - DNA, 18 bp, Artificial sequence
  synthetic polynucleotide sequence
agaacatgaatgcccaga

SEQ ID NO: 10335 - DNA, 18 bp, Artificial sequence
  synthetic polynucleotide sequence
aggtgacactggaagcaa

SEQ ID NO: 10336 - DNA, 18 bp, Artificial sequence
  synthetic polynucleotide sequence
aggtggaggagctgggga

SEQ ID NO: 10337 - DNA, 18 bp, Artificial sequence
  synthetic polynucleotide sequence
acgtagaagagcacggca

SEQ ID NO: 10338 - DNA, 18 bp, Artificial sequence
  synthetic polynucleotide sequence
ctccacacagcctccaga

SEQ ID NO: 10339 - DNA, 18 bp, Artificial sequence
  synthetic polynucleotide sequence
gagcacggggtcaaggca

SEQ ID NO: 10340 - DNA, 18 bp, Artificial sequence
  synthetic polynucleotide sequence
gccacaccctcaacgcca

SEQ ID NO: 10341 - DNA, 18 bp, Artificial sequence
  synthetic polynucleotide sequence
gctatcctcaggcaggga

SEQ ID NO: 10342 - DNA, 18 bp, Artificial sequence
  synthetic polynucleotide sequence
tgccaacagctgcctgga

SEQ ID NO: 10343 - DNA, 18 bp, Artificial sequence
  synthetic polynucleotide sequence
agggcagcaggaagccga

SEQ ID NO: 10344 - DNA, 18 bp, Artificial sequence
  synthetic polynucleotide sequence
agggcagcaggaagccga

SEQ ID NO: 10345 - DNA, 18 bp, Artificial sequence
  synthetic polynucleotide sequence
gcacggaaagatgagcca

SEQ ID NO: 10346 - DNA, 18 bp, Artificial sequence
  synthetic polynucleotide sequence
gctcctcctgcagacaca

SEQ ID NO: 10347 - DNA, 18 bp, Artificial sequence
  synthetic polynucleotide sequence
aggaggacgagtgggaca

SEQ ID NO: 10348 - DNA, 18 bp, Artificial sequence
  synthetic polynucleotide sequence
agctggcgacagtgagga

SEQ ID NO: 10349 - DNA, 18 bp, Artificial sequence
  synthetic polynucleotide sequence
ggcatcaggggagaagca

SEQ ID NO: 10350 - DNA, 18 bp, Artificial sequence
  synthetic polynucleotide sequence
tcaaggcctgtgagggca

SEQ ID NO: 10351 - DNA, 18 bp, Artificial sequence
  synthetic polynucleotide sequence
acaccgacaaccagcgca

SEQ ID NO: 10352 - DNA, 18 bp, Artificial sequence
  synthetic polynucleotide sequence
ccagggtgatgaggcgca

SEQ ID NO: 10353 - DNA, 18 bp, Artificial sequence
  synthetic polynucleotide sequence
agagggcaaggccaagga

SEQ ID NO: 10354 - DNA, 18 bp, Artificial sequence
  synthetic polynucleotide sequence
tccaccacacccatccga

SEQ ID NO: 10355 - DNA, 18 bp, Artificial sequence
  synthetic polynucleotide sequence
gttggaacaccggtggca

SEQ ID NO: 10356 - DNA, 18 bp, Artificial sequence
  synthetic polynucleotide sequence
gcccctcctcaagagcaa

SEQ ID NO: 10357 - DNA, 18 bp, Artificial sequence
  synthetic polynucleotide sequence
gttggaacaccggtagca

SEQ ID NO: 10358 - DNA, 18 bp, Artificial sequence
  synthetic polynucleotide sequence
gcccctcctcaaaagcaa

SEQ ID NO: 10359 - DNA, 18 bp, Artificial sequence
  synthetic polynucleotide sequence
acaagcgttctcccagca

SEQ ID NO: 10360 - DNA, 18 bp, Artificial sequence
  synthetic polynucleotide sequence
ccatgtgcaggggcagga

SEQ ID NO: 10361 - DNA, 18 bp, Artificial sequence
  synthetic polynucleotide sequence
agatgttcaggacaggga

SEQ ID NO: 10362 - DNA, 18 bp, Artificial sequence
  synthetic polynucleotide sequence
agatgttcaggacaggga

SEQ ID NO: 10363 - DNA, 18 bp, Artificial sequence
  synthetic polynucleotide sequence
catgacccccaacaccca

SEQ ID NO: 10364 - DNA, 18 bp, Artificial sequence
  synthetic polynucleotide sequence
agtcgaagaccacgggca

SEQ ID NO: 10365 - DNA, 18 bp, Artificial sequence
  synthetic polynucleotide sequence
ctatacggtggcgaacga

SEQ ID NO: 10366 - DNA, 18 bp, Artificial sequence
  synthetic polynucleotide sequence
tggccaggtactggcaca

SEQ ID NO: 10367 - DNA, 18 bp, Artificial sequence
  synthetic polynucleotide sequence
tgggctccagaaagctca

SEQ ID NO: 10368 - DNA, 18 bp, Artificial sequence
  synthetic polynucleotide sequence
cagaactccacgtaccca

SEQ ID NO: 10369 - DNA, 18 bp, Artificial sequence
  synthetic polynucleotide sequence
gaggcaaaagaacgccaa

SEQ ID NO: 10370 - DNA, 18 bp, Artificial sequence
  synthetic polynucleotide sequence
aacccccgtcggtatcca

SEQ ID NO: 10371 - DNA, 18 bp, Artificial sequence
  synthetic polynucleotide sequence
agctggagaagacagcca

SEQ ID NO: 10372 - DNA, 18 bp, Artificial sequence
  synthetic polynucleotide sequence
cgaactgagaagggccga

SEQ ID NO: 10373 - DNA, 18 bp, Artificial sequence
  synthetic polynucleotide sequence
cgaagagaagaccacaca

SEQ ID NO: 10374 - DNA, 18 bp, Artificial sequence
  synthetic polynucleotide sequence
agctgagtatgaagggga

SEQ ID NO: 10375 - DNA, 18 bp, Artificial sequence
  synthetic polynucleotide sequence
tctcgaagaccaacctga

SEQ ID NO: 10376 - DNA, 18 bp, Artificial sequence
  synthetic polynucleotide sequence
tcaagctgcaaaagggga

SEQ ID NO: 10377 - DNA, 18 bp, Artificial sequence
  synthetic polynucleotide sequence
ctgcagacactcacggca

SEQ ID NO: 10378 - DNA, 18 bp, Artificial sequence
  synthetic polynucleotide sequence
ggaggtggccattaagca

SEQ ID NO: 10379 - DNA, 18 bp, Artificial sequence
  synthetic polynucleotide sequence
acatcagtcagagagcca

SEQ ID NO: 10380 - DNA, 18 bp, Artificial sequence
  synthetic polynucleotide sequence
acatcagtcagagagcca

SEQ ID NO: 10381 - DNA, 18 bp, Artificial sequence
  synthetic polynucleotide sequence
ccgggacatcaagagcga

SEQ ID NO: 10382 - DNA, 18 bp, Artificial sequence
  synthetic polynucleotide sequence
acctctggcccgtaggga

SEQ ID NO: 10383 - DNA, 18 bp, Artificial sequence
  synthetic polynucleotide sequence
ggcagcccagcaaaacca

SEQ ID NO: 10384 - DNA, 18 bp, Artificial sequence
  synthetic polynucleotide sequence
tggcgggacagagtcaca

SEQ ID NO: 10385 - DNA, 18 bp, Artificial sequence
  synthetic polynucleotide sequence
ccaaccgagcaggacaga

SEQ ID NO: 10386 - DNA, 18 bp, Artificial sequence
  synthetic polynucleotide sequence
tccctgaatgagcaggca

SEQ ID NO: 10387 - DNA, 18 bp, Artificial sequence
  synthetic polynucleotide sequence
gcaaccaggcagtgacca

SEQ ID NO: 10388 - DNA, 18 bp, Artificial sequence
  synthetic polynucleotide sequence
agagccaagctgtgagga

SEQ ID NO: 10389 - DNA, 18 bp, Artificial sequence
  synthetic polynucleotide sequence
gcgtgcaggtggtgggca

SEQ ID NO: 10390 - DNA, 18 bp, Artificial sequence
  synthetic polynucleotide sequence
gaggccggagaggttgga

SEQ ID NO: 10391 - DNA, 18 bp, Artificial sequence
  synthetic polynucleotide sequence
tgaccaccccagagcgca

SEQ ID NO: 10392 - DNA, 18 bp, Artificial sequence
  synthetic polynucleotide sequence
ccagtcgggatctcagca

SEQ ID NO: 10393 - DNA, 18 bp, Artificial sequence
  synthetic polynucleotide sequence
tggagggacacaccagca

SEQ ID NO: 10394 - DNA, 18 bp, Artificial sequence
  synthetic polynucleotide sequence
catccgccatctgccaga

SEQ ID NO: 10395 - DNA, 18 bp, Artificial sequence
  synthetic polynucleotide sequence
atgtcaaggtcacgcgca

SEQ ID NO: 10396 - DNA, 18 bp, Artificial sequence
  synthetic polynucleotide sequence
gaactcactgcagagcga

SEQ ID NO: 10397 - DNA, 18 bp, Artificial sequence
  synthetic polynucleotide sequence
agtccggcaatgaaccca

SEQ ID NO: 10398 - DNA, 18 bp, Artificial sequence
  synthetic polynucleotide sequence
agtccggcaatgaaccca

SEQ ID NO: 10399 - DNA, 18 bp, Artificial sequence
  synthetic polynucleotide sequence
gccaatgcccagtggcaa

SEQ ID NO: 10400 - DNA, 18 bp, Artificial sequence
  synthetic polynucleotide sequence
ttgggggacgctgaggga

SEQ ID NO: 10401 - DNA, 18 bp, Artificial sequence
  synthetic polynucleotide sequence
gcaaaggcctccaaggca

SEQ ID NO: 10402 - DNA, 18 bp, Artificial sequence
  synthetic polynucleotide sequence
cgagtgctcatgagccca

SEQ ID NO: 10403 - DNA, 18 bp, Artificial sequence
  synthetic polynucleotide sequence
gccatcgagtggcagaga

SEQ ID NO: 10404 - DNA, 18 bp, Artificial sequence
  synthetic polynucleotide sequence
caggtgtagaagccgcca

SEQ ID NO: 10405 - DNA, 18 bp, Artificial sequence
  synthetic polynucleotide sequence
ctggtgacggatgggaca

SEQ ID NO: 10406 - DNA, 18 bp, Artificial sequence
  synthetic polynucleotide sequence
ggctgaggtcatggacca

SEQ ID NO: 10407 - DNA, 18 bp, Artificial sequence
  synthetic polynucleotide sequence
ggaggtcacacctggaca

SEQ ID NO: 10408 - DNA, 18 bp, Artificial sequence
  synthetic polynucleotide sequence
cacaccttggagcagcca

SEQ ID NO: 10409 - DNA, 18 bp, Artificial sequence
  synthetic polynucleotide sequence
acctctgtggggccagca

SEQ ID NO: 10410 - DNA, 18 bp, Artificial sequence
  synthetic polynucleotide sequence
gcggctgtgctcgaggaa

SEQ ID NO: 10411 - DNA, 18 bp, Artificial sequence
  synthetic polynucleotide sequence
aagaggccaggagggtca

SEQ ID NO: 10412 - DNA, 18 bp, Artificial sequence
  synthetic polynucleotide sequence
cccaggggagagtgcaca

SEQ ID NO: 10413 - DNA, 18 bp, Artificial sequence
  synthetic polynucleotide sequence
cagcctccagctgagcca

SEQ ID NO: 10414 - DNA, 18 bp, Artificial sequence
  synthetic polynucleotide sequence
ctccgaccccaccacgga

SEQ ID NO: 10415 - DNA, 18 bp, Artificial sequence
  synthetic polynucleotide sequence
accctggcgttgaagcca

SEQ ID NO: 10416 - DNA, 18 bp, Artificial sequence
  synthetic polynucleotide sequence
accctggcgttgaagcca

SEQ ID NO: 10417 - DNA, 18 bp, Artificial sequence
  synthetic polynucleotide sequence
gcattgaagtagccggga

SEQ ID NO: 10418 - DNA, 18 bp, Artificial sequence
  synthetic polynucleotide sequence
tcaggctcagcaggccca

SEQ ID NO: 10419 - DNA, 18 bp, Artificial sequence
  synthetic polynucleotide sequence
cgggaagacgctggacca

SEQ ID NO: 10420 - DNA, 18 bp, Artificial sequence
  synthetic polynucleotide sequence
cgggcttgacggtgacga

SEQ ID NO: 10421 - DNA, 18 bp, Artificial sequence
  synthetic polynucleotide sequence
caggctcgttgggaagca

SEQ ID NO: 10422 - DNA, 18 bp, Artificial sequence
  synthetic polynucleotide sequence
cggttccactcgcagcca

SEQ ID NO: 10423 - DNA, 18 bp, Artificial sequence
  synthetic polynucleotide sequence
cgtctcagggagacccaa

SEQ ID NO: 10424 - DNA, 18 bp, Artificial sequence
  synthetic polynucleotide sequence
atcccggtcccaagagga

SEQ ID NO: 10425 - DNA, 18 bp, Artificial sequence
  synthetic polynucleotide sequence
cttcctacggcaagggga

SEQ ID NO: 10426 - DNA, 18 bp, Artificial sequence
  synthetic polynucleotide sequence
agatggaggggtcggaca

SEQ ID NO: 10427 - DNA, 18 bp, Artificial sequence
  synthetic polynucleotide sequence
acgcatcggcctaaggga

SEQ ID NO: 10428 - DNA, 18 bp, Artificial sequence
  synthetic polynucleotide sequence
gccaccatctccaaggca

SEQ ID NO: 10429 - DNA, 18 bp, Artificial sequence
  synthetic polynucleotide sequence
agggtgacgaagtgggca

SEQ ID NO: 10430 - DNA, 18 bp, Artificial sequence
  synthetic polynucleotide sequence
gccaatcctaaggccgaa

SEQ ID NO: 10431 - DNA, 17 bp, Artificial sequence
  synthetic polynucleotide sequence
cagggaaggtgccagca

SEQ ID NO: 10432 - DNA, 17 bp, Artificial sequence
  synthetic polynucleotide sequence
cccacaggacctcccca

SEQ ID NO: 10433 - DNA, 18 bp, Artificial sequence
  synthetic polynucleotide sequence
tgcagacatggtcggaca

SEQ ID NO: 10434 - DNA, 18 bp, Artificial sequence
  synthetic polynucleotide sequence
tgcagacatggtcggaca

SEQ ID NO: 10435 - DNA, 18 bp, Artificial sequence
  synthetic polynucleotide sequence
caggcaacctgtgagcca

SEQ ID NO: 10436 - DNA, 18 bp, Artificial sequence
  synthetic polynucleotide sequence
acggatgtccctggcaga

SEQ ID NO: 10437 - DNA, 18 bp, Artificial sequence
  synthetic polynucleotide sequence
cgggaggcatgaacgtga

SEQ ID NO: 10438 - DNA, 18 bp, Artificial sequence
  synthetic polynucleotide sequence
agccctccaggagcccca

SEQ ID NO: 10439 - DNA, 18 bp, Artificial sequence
  synthetic polynucleotide sequence
cagccacatctcggagga

SEQ ID NO: 10440 - DNA, 18 bp, Artificial sequence
  synthetic polynucleotide sequence
ccagaaggcccatgagca

SEQ ID NO: 10441 - DNA, 18 bp, Artificial sequence
  synthetic polynucleotide sequence
cttgcgatgagcagggca

SEQ ID NO: 10442 - DNA, 18 bp, Artificial sequence
  synthetic polynucleotide sequence
atgcagcagggccttgga

SEQ ID NO: 10443 - DNA, 18 bp, Artificial sequence
  synthetic polynucleotide sequence
ccatcagcagaggagcca

SEQ ID NO: 10444 - DNA, 18 bp, Artificial sequence
  synthetic polynucleotide sequence
tcaccagccagcagcaga

SEQ ID NO: 10445 - DNA, 18 bp, Artificial sequence
  synthetic polynucleotide sequence
agcacctgaagttcacca

SEQ ID NO: 10446 - DNA, 18 bp, Artificial sequence
  synthetic polynucleotide sequence
caacagaagaggcctgca

SEQ ID NO: 10447 - DNA, 21 bp, Artificial sequence
  synthetic polynucleotide sequence
tctgagcagtacagacaccaa

SEQ ID NO: 10448 - DNA, 18 bp, Artificial sequence
  synthetic polynucleotide sequence
gggatttccgggtcagga

SEQ ID NO: 10449 - DNA, 18 bp, Artificial sequence
  synthetic polynucleotide sequence
atgaggacagcccctgca

SEQ ID NO: 10450 - DNA, 18 bp, Artificial sequence
  synthetic polynucleotide sequence
taagtgccgggaagagga

SEQ ID NO: 10451 - DNA, 18 bp, Artificial sequence
  synthetic polynucleotide sequence
cctccagctgctgaacca

SEQ ID NO: 10452 - DNA, 18 bp, Artificial sequence
  synthetic polynucleotide sequence
cctccagctgctgaacca

SEQ ID NO: 10453 - DNA, 18 bp, Artificial sequence
  synthetic polynucleotide sequence
cgacatggcagtccccaa

SEQ ID NO: 10454 - DNA, 18 bp, Artificial sequence
  synthetic polynucleotide sequence
gcggaagaagctcccaca

SEQ ID NO: 10455 - DNA, 18 bp, Artificial sequence
  synthetic polynucleotide sequence
cccagagtggtgtggaca

SEQ ID NO: 10456 - DNA, 18 bp, Artificial sequence
  synthetic polynucleotide sequence
acgtcagggtaggaagga

SEQ ID NO: 10457 - DNA, 18 bp, Artificial sequence
  synthetic polynucleotide sequence
accccatgaaccccacca

SEQ ID NO: 10458 - DNA, 18 bp, Artificial sequence
  synthetic polynucleotide sequence
ccccggtgagaggggaga

SEQ ID NO: 10459 - DNA, 18 bp, Artificial sequence
  synthetic polynucleotide sequence
cttgcccccacagccgaa

SEQ ID NO: 10460 - DNA, 18 bp, Artificial sequence
  synthetic polynucleotide sequence
tagtgggcagccaggcca

SEQ ID NO: 10461 - DNA, 18 bp, Artificial sequence
  synthetic polynucleotide sequence
gaagcagatgcggggaga

SEQ ID NO: 10462 - DNA, 18 bp, Artificial sequence
  synthetic polynucleotide sequence
cagcccaccagccagcga

SEQ ID NO: 10463 - DNA, 18 bp, Artificial sequence
  synthetic polynucleotide sequence
ggcaccgaagtccccgga

SEQ ID NO: 10464 - DNA, 18 bp, Artificial sequence
  synthetic polynucleotide sequence
agatgggcgcagacggca

SEQ ID NO: 10465 - DNA, 18 bp, Artificial sequence
  synthetic polynucleotide sequence
tgagatggaggtggccga

SEQ ID NO: 10466 - DNA, 18 bp, Artificial sequence
  synthetic polynucleotide sequence
gcatcttgggcaacccca

SEQ ID NO: 10467 - DNA, 18 bp, Artificial sequence
  synthetic polynucleotide sequence
ctgaaggcatccgtgcga

SEQ ID NO: 10468 - DNA, 18 bp, Artificial sequence
  synthetic polynucleotide sequence
ctggcagcgacaagagga

SEQ ID NO: 10469 - DNA, 18 bp, Artificial sequence
  synthetic polynucleotide sequence
gacaatgaggtgccccca

SEQ ID NO: 10470 - DNA, 18 bp, Artificial sequence
  synthetic polynucleotide sequence
gacaatgaggtgccccca

SEQ ID NO: 10471 - DNA, 18 bp, Artificial sequence
  synthetic polynucleotide sequence
cacgagtcgatgcacgca

SEQ ID NO: 10472 - DNA, 18 bp, Artificial sequence
  synthetic polynucleotide sequence
tgggaaggccactgggaa

SEQ ID NO: 10473 - DNA, 18 bp, Artificial sequence
  synthetic polynucleotide sequence
gcgttgggaactaggcca

SEQ ID NO: 10474 - DNA, 18 bp, Artificial sequence
  synthetic polynucleotide sequence
atgtgtgcagcagaagga

SEQ ID NO: 10475 - DNA, 18 bp, Artificial sequence
  synthetic polynucleotide sequence
cagagacctggagggaga

SEQ ID NO: 10476 - DNA, 18 bp, Artificial sequence
  synthetic polynucleotide sequence
ttgggatccacagcagga

SEQ ID NO: 10477 - DNA, 18 bp, Artificial sequence
  synthetic polynucleotide sequence
ctcgccctcaactcccaa

SEQ ID NO: 10478 - DNA, 18 bp, Artificial sequence
  synthetic polynucleotide sequence
gcactgatgccctgcgga

SEQ ID NO: 10479 - DNA, 18 bp, Artificial sequence
  synthetic polynucleotide sequence
gagctcccaggaggagga

SEQ ID NO: 10480 - DNA, 18 bp, Artificial sequence
  synthetic polynucleotide sequence
gagttgtcaggggacaca

SEQ ID NO: 10481 - DNA, 18 bp, Artificial sequence
  synthetic polynucleotide sequence
gctgtacagaccccagca

SEQ ID NO: 10482 - DNA, 18 bp, Artificial sequence
  synthetic polynucleotide sequence
cacagggtgacaaggcca

SEQ ID NO: 10483 - DNA, 18 bp, Artificial sequence
  synthetic polynucleotide sequence
ccatgggtgaggtcacca

SEQ ID NO: 10484 - DNA, 18 bp, Artificial sequence
  synthetic polynucleotide sequence
tcaaggacacccaggcca

SEQ ID NO: 10485 - DNA, 18 bp, Artificial sequence
  synthetic polynucleotide sequence
tctcagcctgcagggcca

SEQ ID NO: 10486 - DNA, 18 bp, Artificial sequence
  synthetic polynucleotide sequence
tggaaggccgtgatgcca

SEQ ID NO: 10487 - DNA, 18 bp, Artificial sequence
  synthetic polynucleotide sequence
atactggcagcagagcca

SEQ ID NO: 10488 - DNA, 18 bp, Artificial sequence
  synthetic polynucleotide sequence
atactggcagcagagcca

SEQ ID NO: 10489 - DNA, 18 bp, Artificial sequence
  synthetic polynucleotide sequence
ggaagctgctcaggcaga

SEQ ID NO: 10490 - DNA, 18 bp, Artificial sequence
  synthetic polynucleotide sequence
gacatccaggtcacagca

SEQ ID NO: 10491 - DNA, 18 bp, Artificial sequence
  synthetic polynucleotide sequence
ctgcccctcaactaccca

SEQ ID NO: 10492 - DNA, 18 bp, Artificial sequence
  synthetic polynucleotide sequence
gcagctggatggaaggca

SEQ ID NO: 10493 - DNA, 18 bp, Artificial sequence
  synthetic polynucleotide sequence
gcccacgagtgacacaga

SEQ ID NO: 10494 - DNA, 18 bp, Artificial sequence
  synthetic polynucleotide sequence
ggaggactgtggtggaga

SEQ ID NO: 10495 - DNA, 18 bp, Artificial sequence
  synthetic polynucleotide sequence
gaccagggcagtgaggaa

SEQ ID NO: 10496 - DNA, 18 bp, Artificial sequence
  synthetic polynucleotide sequence
ttccgctcggcgaaggca

SEQ ID NO: 10497 - DNA, 18 bp, Artificial sequence
  synthetic polynucleotide sequence
atggggaaggaggacgca

SEQ ID NO: 10498 - DNA, 18 bp, Artificial sequence
  synthetic polynucleotide sequence
tgatgaaggccagagcca

SEQ ID NO: 10499 - DNA, 18 bp, Artificial sequence
  synthetic polynucleotide sequence
ggatcctgggcgagcaca

SEQ ID NO: 10500 - DNA, 18 bp, Artificial sequence
  synthetic polynucleotide sequence
ctcccctcaactccacca

SEQ ID NO: 10501 - DNA, 18 bp, Artificial sequence
  synthetic polynucleotide sequence
ccgatccacctcactgca

SEQ ID NO: 10502 - DNA, 18 bp, Artificial sequence
  synthetic polynucleotide sequence
ccagcagcagcatccaca

SEQ ID NO: 10503 - DNA, 18 bp, Artificial sequence
  synthetic polynucleotide sequence
ccaacactgtgagggcca

SEQ ID NO: 10504 - DNA, 18 bp, Artificial sequence
  synthetic polynucleotide sequence
agcgaggagagaggccaa

SEQ ID NO: 10505 - DNA, 18 bp, Artificial sequence
  synthetic polynucleotide sequence
atgccagcaaccacgcca

SEQ ID NO: 10506 - DNA, 18 bp, Artificial sequence
  synthetic polynucleotide sequence
atgccagcaaccacgcca

SEQ ID NO: 10507 - DNA, 18 bp, Artificial sequence
  synthetic polynucleotide sequence
cgggcgagatcagcacga

SEQ ID NO: 10508 - DNA, 18 bp, Artificial sequence
  synthetic polynucleotide sequence
gcagcagtgtgagcacca

SEQ ID NO: 10509 - DNA, 18 bp, Artificial sequence
  synthetic polynucleotide sequence
aggagggcctgatcagca

SEQ ID NO: 10510 - DNA, 18 bp, Artificial sequence
  synthetic polynucleotide sequence
caccgactggaggggaca

SEQ ID NO: 10511 - DNA, 18 bp, Artificial sequence
  synthetic polynucleotide sequence
ccagaaccagaggcagga

SEQ ID NO: 10512 - DNA, 18 bp, Artificial sequence
  synthetic polynucleotide sequence
caactcaccgggaccgga

SEQ ID NO: 10513 - DNA, 18 bp, Artificial sequence
  synthetic polynucleotide sequence
agggcacgtggtggcgaa

SEQ ID NO: 10514 - DNA, 18 bp, Artificial sequence
  synthetic polynucleotide sequence
taggcggtgtcgagggga

SEQ ID NO: 10515 - DNA, 18 bp, Artificial sequence
  synthetic polynucleotide sequence
ggtactggtgaaggacca

SEQ ID NO: 10516 - DNA, 18 bp, Artificial sequence
  synthetic polynucleotide sequence
gcagcgcggtgtacagca

SEQ ID NO: 10517 - DNA, 18 bp, Artificial sequence
  synthetic polynucleotide sequence
gaggtgggaccctgagga

SEQ ID NO: 10518 - DNA, 18 bp, Artificial sequence
  synthetic polynucleotide sequence
cgcagcagaggagacaga

SEQ ID NO: 10519 - DNA, 18 bp, Artificial sequence
  synthetic polynucleotide sequence
cctggccactctccacca

SEQ ID NO: 10520 - DNA, 18 bp, Artificial sequence
  synthetic polynucleotide sequence
cgggcgagatcagcacca

SEQ ID NO: 10521 - DNA, 18 bp, Artificial sequence
  synthetic polynucleotide sequence
acaccgcgcagatggcga

SEQ ID NO: 10522 - DNA, 18 bp, Artificial sequence
  synthetic polynucleotide sequence
ggctgtacacgggcgaga

SEQ ID NO: 10523 - DNA, 18 bp, Artificial sequence
  synthetic polynucleotide sequence
cctctgcagacctgggca

SEQ ID NO: 10524 - DNA, 18 bp, Artificial sequence
  synthetic polynucleotide sequence
cctctgcagacctgggca

SEQ ID NO: 10525 - DNA, 18 bp, Artificial sequence
  synthetic polynucleotide sequence
ggctgtgcaggaggagca

SEQ ID NO: 10526 - DNA, 18 bp, Artificial sequence
  synthetic polynucleotide sequence
tgccgctcacgtccacca

SEQ ID NO: 10527 - DNA, 18 bp, Artificial sequence
  synthetic polynucleotide sequence
caacgcggacaacggcca

SEQ ID NO: 10528 - DNA, 18 bp, Artificial sequence
  synthetic polynucleotide sequence
ccaccaccttggtcacca

SEQ ID NO: 10529 - DNA, 18 bp, Artificial sequence
  synthetic polynucleotide sequence
accagctgctcaaggcca

SEQ ID NO: 10530 - DNA, 18 bp, Artificial sequence
  synthetic polynucleotide sequence
gcaggtagggctgggaga

SEQ ID NO: 10531 - DNA, 18 bp, Artificial sequence
  synthetic polynucleotide sequence
cctgcttaaggccagcga

SEQ ID NO: 10532 - DNA, 18 bp, Artificial sequence
  synthetic polynucleotide sequence
gagactcgaggctgccga

SEQ ID NO: 10533 - DNA, 18 bp, Artificial sequence
  synthetic polynucleotide sequence
cacctggcccaacaacca

SEQ ID NO: 10534 - DNA, 18 bp, Artificial sequence
  synthetic polynucleotide sequence
aatcccatggtgccggca

SEQ ID NO: 10535 - DNA, 18 bp, Artificial sequence
  synthetic polynucleotide sequence
tcagggggaggctgagca

SEQ ID NO: 10536 - DNA, 18 bp, Artificial sequence
  synthetic polynucleotide sequence
ggagccctccctaaggca

SEQ ID NO: 10537 - DNA, 18 bp, Artificial sequence
  synthetic polynucleotide sequence
ctcgtagtccagggacca

SEQ ID NO: 10538 - DNA, 18 bp, Artificial sequence
  synthetic polynucleotide sequence
ccaaggtgtggcaaccaa

SEQ ID NO: 10539 - DNA, 18 bp, Artificial sequence
  synthetic polynucleotide sequence
accgtggacaggggagga

SEQ ID NO: 10540 - DNA, 18 bp, Artificial sequence
  synthetic polynucleotide sequence
ggacgtggacattgacga

SEQ ID NO: 10541 - DNA, 18 bp, Artificial sequence
  synthetic polynucleotide sequence
cgagttggggtgggcaca

SEQ ID NO: 10542 - DNA, 18 bp, Artificial sequence
  synthetic polynucleotide sequence
cgagttggggtgggcaca

SEQ ID NO: 10543 - DNA, 18 bp, Artificial sequence
  synthetic polynucleotide sequence
gtgccacatctccaccca

SEQ ID NO: 10544 - DNA, 18 bp, Artificial sequence
  synthetic polynucleotide sequence
tgggtggggaaggagcca

SEQ ID NO: 10545 - DNA, 18 bp, Artificial sequence
  synthetic polynucleotide sequence
gcgccagcaaaatcagca

SEQ ID NO: 10546 - DNA, 18 bp, Artificial sequence
  synthetic polynucleotide sequence
gaaggagggtgcgatgca

SEQ ID NO: 10547 - DNA, 18 bp, Artificial sequence
  synthetic polynucleotide sequence
ggtggaatatgccaagga

SEQ ID NO: 10548 - DNA, 18 bp, Artificial sequence
  synthetic polynucleotide sequence
ctgcactccagctccaca

SEQ ID NO: 10549 - DNA, 18 bp, Artificial sequence
  synthetic polynucleotide sequence
aggcactcaaggacctca

SEQ ID NO: 10550 - DNA, 18 bp, Artificial sequence
  synthetic polynucleotide sequence
cgaagccctcagaccgca

SEQ ID NO: 10551 - DNA, 18 bp, Artificial sequence
  synthetic polynucleotide sequence
gtcggagaccaggaagca

SEQ ID NO: 10552 - DNA, 18 bp, Artificial sequence
  synthetic polynucleotide sequence
acccgcgatgctgagaca

SEQ ID NO: 10553 - DNA, 18 bp, Artificial sequence
  synthetic polynucleotide sequence
caggtgtaagccgggaca

SEQ ID NO: 10554 - DNA, 18 bp, Artificial sequence
  synthetic polynucleotide sequence
tccctgtcccgaaggcaa

SEQ ID NO: 10555 - DNA, 18 bp, Artificial sequence
  synthetic polynucleotide sequence
ggcactgcttgcaaggca

SEQ ID NO: 10556 - DNA, 18 bp, Artificial sequence
  synthetic polynucleotide sequence
acccacctgcccaaagca

SEQ ID NO: 10557 - DNA, 18 bp, Artificial sequence
  synthetic polynucleotide sequence
gggctacaatgtgccaca

SEQ ID NO: 10558 - DNA, 18 bp, Artificial sequence
  synthetic polynucleotide sequence
ggaggactccttgacaga

SEQ ID NO: 10559 - DNA, 18 bp, Artificial sequence
  synthetic polynucleotide sequence
tgaatggccaccgctgca

SEQ ID NO: 10560 - DNA, 18 bp, Artificial sequence
  synthetic polynucleotide sequence
tgaatggccaccgctgca

SEQ ID NO: 10561 - DNA, 18 bp, Artificial sequence
  synthetic polynucleotide sequence
cggagacgcacacaggca

SEQ ID NO: 10562 - DNA, 18 bp, Artificial sequence
  synthetic polynucleotide sequence
cagaggtccagacaacca

SEQ ID NO: 10563 - DNA, 18 bp, Artificial sequence
  synthetic polynucleotide sequence
aggaggcaggcgacgaga

SEQ ID NO: 10564 - DNA, 18 bp, Artificial sequence
  synthetic polynucleotide sequence
ccgcaagaatccgtccca

SEQ ID NO: 10565 - DNA, 18 bp, Artificial sequence
  synthetic polynucleotide sequence
ctggcgggacatgcagca

SEQ ID NO: 10566 - DNA, 18 bp, Artificial sequence
  synthetic polynucleotide sequence
ctcagggtcctgcacgga

SEQ ID NO: 10567 - DNA, 18 bp, Artificial sequence
  synthetic polynucleotide sequence
cgcctacatcctgggaca

SEQ ID NO: 10568 - DNA, 18 bp, Artificial sequence
  synthetic polynucleotide sequence
cgtggaggatgggggaca

SEQ ID NO: 10569 - DNA, 18 bp, Artificial sequence
  synthetic polynucleotide sequence
gccgagttgaagacccca

SEQ ID NO: 10570 - DNA, 18 bp, Artificial sequence
  synthetic polynucleotide sequence
ggggcagctggagacaca

SEQ ID NO: 10571 - DNA, 18 bp, Artificial sequence
  synthetic polynucleotide sequence
tgcggacctgggatggca

SEQ ID NO: 10572 - DNA, 18 bp, Artificial sequence
  synthetic polynucleotide sequence
atctcacacccacgccga

SEQ ID NO: 10573 - DNA, 18 bp, Artificial sequence
  synthetic polynucleotide sequence
catcatgccactggggca

SEQ ID NO: 10574 - DNA, 18 bp, Artificial sequence
  synthetic polynucleotide sequence
gcaggatggacctggaga

SEQ ID NO: 10575 - DNA, 18 bp, Artificial sequence
  synthetic polynucleotide sequence
gacctcgtggcctcagca

SEQ ID NO: 10576 - DNA, 18 bp, Artificial sequence
  synthetic polynucleotide sequence
gtccacacagctccacca

SEQ ID NO: 10577 - DNA, 18 bp, Artificial sequence
  synthetic polynucleotide sequence
ctgcagaagccctgagca

SEQ ID NO: 10578 - DNA, 18 bp, Artificial sequence
  synthetic polynucleotide sequence
ctgcagaagccctgagca

SEQ ID NO: 10579 - DNA, 18 bp, Artificial sequence
  synthetic polynucleotide sequence
agctgagtggcaggccca

SEQ ID NO: 10580 - DNA, 18 bp, Artificial sequence
  synthetic polynucleotide sequence
taagccagcaaggccaca

SEQ ID NO: 10581 - DNA, 18 bp, Artificial sequence
  synthetic polynucleotide sequence
tccagcggatcatcacca

SEQ ID NO: 10582 - DNA, 18 bp, Artificial sequence
  synthetic polynucleotide sequence
gcctggcagcctccagga

SEQ ID NO: 10583 - DNA, 18 bp, Artificial sequence
  synthetic polynucleotide sequence
gaagaaagggaggccaca

SEQ ID NO: 10584 - DNA, 18 bp, Artificial sequence
  synthetic polynucleotide sequence
cctgcagctgcgcgtcga

SEQ ID NO: 10585 - DNA, 18 bp, Artificial sequence
  synthetic polynucleotide sequence
ctgaaggaggacccctca

SEQ ID NO: 10586 - DNA, 18 bp, Artificial sequence
  synthetic polynucleotide sequence
gctcagggacacagggca

SEQ ID NO: 10587 - DNA, 18 bp, Artificial sequence
  synthetic polynucleotide sequence
aagctgagaccacatcca

SEQ ID NO: 10588 - DNA, 18 bp, Artificial sequence
  synthetic polynucleotide sequence
gtctgggctgcagacaga

SEQ ID NO: 10589 - DNA, 18 bp, Artificial sequence
  synthetic polynucleotide sequence
gtgaggacctgtgaggga

SEQ ID NO: 10590 - DNA, 18 bp, Artificial sequence
  synthetic polynucleotide sequence
ggtggagattgccccaga

SEQ ID NO: 10591 - DNA, 18 bp, Artificial sequence
  synthetic polynucleotide sequence
tagtcccaggcgacccca

SEQ ID NO: 10592 - DNA, 18 bp, Artificial sequence
  synthetic polynucleotide sequence
cacaccgtgaaagagcca

SEQ ID NO: 10593 - DNA, 18 bp, Artificial sequence
  synthetic polynucleotide sequence
agcccaggaggcacagga

SEQ ID NO: 10594 - DNA, 18 bp, Artificial sequence
  synthetic polynucleotide sequence
ggaggggccttcaccaca

SEQ ID NO: 10595 - DNA, 18 bp, Artificial sequence
  synthetic polynucleotide sequence
cccacctccagagcccca

SEQ ID NO: 10596 - DNA, 18 bp, Artificial sequence
  synthetic polynucleotide sequence
cccacctccagagcccca

SEQ ID NO: 10597 - DNA, 18 bp, Artificial sequence
  synthetic polynucleotide sequence
ctgaagcaggccctctca

SEQ ID NO: 10598 - DNA, 18 bp, Artificial sequence
  synthetic polynucleotide sequence
ccgtcaacctctgcagga

SEQ ID NO: 10599 - DNA, 18 bp, Artificial sequence
  synthetic polynucleotide sequence
gccaccaacgaggacaga

SEQ ID NO: 10600 - DNA, 18 bp, Artificial sequence
  synthetic polynucleotide sequence
cgcccgaatccttcacga

SEQ ID NO: 10601 - DNA, 18 bp, Artificial sequence
  synthetic polynucleotide sequence
tgaagtcccccaaggcca

SEQ ID NO: 10602 - DNA, 18 bp, Artificial sequence
  synthetic polynucleotide sequence
ctgagccacggatgggga

SEQ ID NO: 10603 - DNA, 18 bp, Artificial sequence
  synthetic polynucleotide sequence
ctccagacaggtggcaga

SEQ ID NO: 10604 - DNA, 18 bp, Artificial sequence
  synthetic polynucleotide sequence
ccagttgcaaccgaggca

SEQ ID NO: 10605 - DNA, 18 bp, Artificial sequence
  synthetic polynucleotide sequence
cagccacccaaccaagca

SEQ ID NO: 10606 - DNA, 18 bp, Artificial sequence
  synthetic polynucleotide sequence
tggaagtgcggtcacaga

SEQ ID NO: 10607 - DNA, 18 bp, Artificial sequence
  synthetic polynucleotide sequence
gccctagtgccatccaga

SEQ ID NO: 10608 - DNA, 18 bp, Artificial sequence
  synthetic polynucleotide sequence
gttccccaaagcggcaga

SEQ ID NO: 10609 - DNA, 18 bp, Artificial sequence
  synthetic polynucleotide sequence
tccaggggctcatcagca

SEQ ID NO: 10610 - DNA, 18 bp, Artificial sequence
  synthetic polynucleotide sequence
cactcagagtgccccaga

SEQ ID NO: 10611 - DNA, 18 bp, Artificial sequence
  synthetic polynucleotide sequence
cacgaattcctcccggga

SEQ ID NO: 10612 - DNA, 18 bp, Artificial sequence
  synthetic polynucleotide sequence
accatagcctgggaggca

SEQ ID NO: 10613 - DNA, 18 bp, Artificial sequence
  synthetic polynucleotide sequence
ctccatcagaccctggca

SEQ ID NO: 10614 - DNA, 18 bp, Artificial sequence
  synthetic polynucleotide sequence
ctccatcagaccctggca

SEQ ID NO: 10615 - DNA, 18 bp, Artificial sequence
  synthetic polynucleotide sequence
tctggaggaggcagagga

SEQ ID NO: 10616 - DNA, 18 bp, Artificial sequence
  synthetic polynucleotide sequence
cggcttcaggggacagga

SEQ ID NO: 10617 - DNA, 18 bp, Artificial sequence
  synthetic polynucleotide sequence
ctgggagacatgggcaga

SEQ ID NO: 10618 - DNA, 18 bp, Artificial sequence
  synthetic polynucleotide sequence
gtcatcaggtgcaggaga

SEQ ID NO: 10619 - DNA, 18 bp, Artificial sequence
  synthetic polynucleotide sequence
gccttgaagcccaaggca

SEQ ID NO: 10620 - DNA, 18 bp, Artificial sequence
  synthetic polynucleotide sequence
ccactttgccaggcagca

SEQ ID NO: 10621 - DNA, 18 bp, Artificial sequence
  synthetic polynucleotide sequence
agagccatggccaagcaa

SEQ ID NO: 10622 - DNA, 18 bp, Artificial sequence
  synthetic polynucleotide sequence
gggtctgggcagatggca

SEQ ID NO: 10623 - DNA, 18 bp, Artificial sequence
  synthetic polynucleotide sequence
agacgacccggaaggaga

SEQ ID NO: 10624 - DNA, 18 bp, Artificial sequence
  synthetic polynucleotide sequence
cccagaactcagcagcca

SEQ ID NO: 10625 - DNA, 18 bp, Artificial sequence
  synthetic polynucleotide sequence
gcagcagcaagcatggca

SEQ ID NO: 10626 - DNA, 18 bp, Artificial sequence
  synthetic polynucleotide sequence
gtgaggaaagggtaccga

SEQ ID NO: 10627 - DNA, 18 bp, Artificial sequence
  synthetic polynucleotide sequence
aagggcagatgactgtga

SEQ ID NO: 10628 - DNA, 18 bp, Artificial sequence
  synthetic polynucleotide sequence
caggcagttcaagagcaa

SEQ ID NO: 10629 - DNA, 18 bp, Artificial sequence
  synthetic polynucleotide sequence
ctccacgcctctgagaga

SEQ ID NO: 10630 - DNA, 18 bp, Artificial sequence
  synthetic polynucleotide sequence
cggtactgcccctggaca

SEQ ID NO: 10631 - DNA, 18 bp, Artificial sequence
  synthetic polynucleotide sequence
ccaagatcaaggagccca

SEQ ID NO: 10632 - DNA, 18 bp, Artificial sequence
  synthetic polynucleotide sequence
ccaagatcaaggagccca

SEQ ID NO: 10633 - DNA, 18 bp, Artificial sequence
  synthetic polynucleotide sequence
ggagtcaggtcgacccca

SEQ ID NO: 10634 - DNA, 18 bp, Artificial sequence
  synthetic polynucleotide sequence
gacgcgggagggctggca

SEQ ID NO: 10635 - DNA, 18 bp, Artificial sequence
  synthetic polynucleotide sequence
gctgctgcaacaaccgca

SEQ ID NO: 10636 - DNA, 18 bp, Artificial sequence
  synthetic polynucleotide sequence
cgggtcacaggccgtgca

SEQ ID NO: 10637 - DNA, 18 bp, Artificial sequence
  synthetic polynucleotide sequence
acagctgcacacctcgta

SEQ ID NO: 10638 - DNA, 18 bp, Artificial sequence
  synthetic polynucleotide sequence
gtggagacaacaggcaca

SEQ ID NO: 10639 - DNA, 18 bp, Artificial sequence
  synthetic polynucleotide sequence
cagttgcactcccaggaa

SEQ ID NO: 10640 - DNA, 18 bp, Artificial sequence
  synthetic polynucleotide sequence
gcatgtgcaggacctcca

SEQ ID NO: 10641 - DNA, 18 bp, Artificial sequence
  synthetic polynucleotide sequence
tgggtaccggatggccaa

SEQ ID NO: 10642 - DNA, 18 bp, Artificial sequence
  synthetic polynucleotide sequence
ggcagcagattctccaca

SEQ ID NO: 10643 - DNA, 18 bp, Artificial sequence
  synthetic polynucleotide sequence
gagcaggatcccgaagga

SEQ ID NO: 10644 - DNA, 18 bp, Artificial sequence
  synthetic polynucleotide sequence
cagctaccaggtggccaa

SEQ ID NO: 10645 - DNA, 18 bp, Artificial sequence
  synthetic polynucleotide sequence
ccactgggaaccgccaca

SEQ ID NO: 10646 - DNA, 18 bp, Artificial sequence
  synthetic polynucleotide sequence
ccaaggagatcccagcca

SEQ ID NO: 10647 - DNA, 18 bp, Artificial sequence
  synthetic polynucleotide sequence
cctctcggacgcacagga

SEQ ID NO: 10648 - DNA, 18 bp, Artificial sequence
  synthetic polynucleotide sequence
agagagcggcagccagca

SEQ ID NO: 10649 - DNA, 18 bp, Artificial sequence
  synthetic polynucleotide sequence
caggccagagcaatgcca

SEQ ID NO: 10650 - DNA, 18 bp, Artificial sequence
  synthetic polynucleotide sequence
caggccagagcaatgcca

SEQ ID NO: 10651 - DNA, 18 bp, Artificial sequence
  synthetic polynucleotide sequence
ggaaggaggctggccaca

SEQ ID NO: 10652 - DNA, 18 bp, Artificial sequence
  synthetic polynucleotide sequence
ggcatagggacatcagca

SEQ ID NO: 10653 - DNA, 18 bp, Artificial sequence
  synthetic polynucleotide sequence
cccaatgcagtgggcaca

SEQ ID NO: 10654 - DNA, 18 bp, Artificial sequence
  synthetic polynucleotide sequence
aacagctccaaggtcaca

SEQ ID NO: 10655 - DNA, 18 bp, Artificial sequence
  synthetic polynucleotide sequence
gcacccactgcaaggaga

SEQ ID NO: 10656 - DNA, 18 bp, Artificial sequence
  synthetic polynucleotide sequence
gtagggaagccgtgcaca

SEQ ID NO: 10657 - DNA, 19 bp, Artificial sequence
  synthetic polynucleotide sequence
atgctgggcacaaactcaa

SEQ ID NO: 10658 - DNA, 19 bp, Artificial sequence
  synthetic polynucleotide sequence
ccttcccatcacgcgagaa

SEQ ID NO: 10659 - DNA, 18 bp, Artificial sequence
  synthetic polynucleotide sequence
cctagaggtggccaagga

SEQ ID NO: 10660 - DNA, 18 bp, Artificial sequence
  synthetic polynucleotide sequence
tcgtccaggatggcggca

SEQ ID NO: 10661 - DNA, 18 bp, Artificial sequence
  synthetic polynucleotide sequence
acaggtgccgtggagcca

SEQ ID NO: 10662 - DNA, 18 bp, Artificial sequence
  synthetic polynucleotide sequence
cgccatcaatgcacgcaa

SEQ ID NO: 10663 - DNA, 18 bp, Artificial sequence
  synthetic polynucleotide sequence
ccacgagctgcttaacca

SEQ ID NO: 10664 - DNA, 18 bp, Artificial sequence
  synthetic polynucleotide sequence
gatgcagacgaacccaga

SEQ ID NO: 10665 - DNA, 18 bp, Artificial sequence
  synthetic polynucleotide sequence
ctggggacgcaccagtca

SEQ ID NO: 10666 - DNA, 18 bp, Artificial sequence
  synthetic polynucleotide sequence
ggttacgggacagatgca

SEQ ID NO: 10667 - DNA, 18 bp, Artificial sequence
  synthetic polynucleotide sequence
ctcaagggaacaccccca

SEQ ID NO: 10668 - DNA, 18 bp, Artificial sequence
  synthetic polynucleotide sequence
ctcaagggaacaccccca

SEQ ID NO: 10669 - DNA, 18 bp, Artificial sequence
  synthetic polynucleotide sequence
cacctgtaacgtggcgga

SEQ ID NO: 10670 - DNA, 18 bp, Artificial sequence
  synthetic polynucleotide sequence
ccagctctggagctacca

SEQ ID NO: 10671 - DNA, 18 bp, Artificial sequence
  synthetic polynucleotide sequence
agaatgcaatgcgggcaa

SEQ ID NO: 10672 - DNA, 18 bp, Artificial sequence
  synthetic polynucleotide sequence
attctcaggggaacacca

SEQ ID NO: 10673 - DNA, 18 bp, Artificial sequence
  synthetic polynucleotide sequence
agcctctgaaccccagga

SEQ ID NO: 10674 - DNA, 18 bp, Artificial sequence
  synthetic polynucleotide sequence
agtgctggaggcaggcga

SEQ ID NO: 10675 - DNA, 18 bp, Artificial sequence
  synthetic polynucleotide sequence
agtcggacgtgtaccgga

SEQ ID NO: 10676 - DNA, 18 bp, Artificial sequence
  synthetic polynucleotide sequence
cagagccatcgtccacca

SEQ ID NO: 10677 - DNA, 18 bp, Artificial sequence
  synthetic polynucleotide sequence
caagcccacggccagcaa

SEQ ID NO: 10678 - DNA, 18 bp, Artificial sequence
  synthetic polynucleotide sequence
caggccgcagtcactgca

SEQ ID NO: 10679 - DNA, 18 bp, Artificial sequence
  synthetic polynucleotide sequence
ggttacaatgggcgcaca

SEQ ID NO: 10680 - DNA, 18 bp, Artificial sequence
  synthetic polynucleotide sequence
ccagccaagtgaccagga

SEQ ID NO: 10681 - DNA, 18 bp, Artificial sequence
  synthetic polynucleotide sequence
ctcgctcgcaatagggca

SEQ ID NO: 10682 - DNA, 18 bp, Artificial sequence
  synthetic polynucleotide sequence
tgcacccagctgtgccaa

SEQ ID NO: 10683 - DNA, 18 bp, Artificial sequence
  synthetic polynucleotide sequence
ttgcccacagcgtggcga

SEQ ID NO: 10684 - DNA, 18 bp, Artificial sequence
  synthetic polynucleotide sequence
aggtgactctgggacaga

SEQ ID NO: 10685 - DNA, 18 bp, Artificial sequence
  synthetic polynucleotide sequence
cttccgacatagccggca

SEQ ID NO: 10686 - DNA, 18 bp, Artificial sequence
  synthetic polynucleotide sequence
cttccgacatagccggca

SEQ ID NO: 10687 - DNA, 18 bp, Artificial sequence
  synthetic polynucleotide sequence
caaagtccaagcgccaca

SEQ ID NO: 10688 - DNA, 18 bp, Artificial sequence
  synthetic polynucleotide sequence
atggctagtaagacccca

SEQ ID NO: 10689 - DNA, 18 bp, Artificial sequence
  synthetic polynucleotide sequence
gaggagatggtgagacga

SEQ ID NO: 10690 - DNA, 18 bp, Artificial sequence
  synthetic polynucleotide sequence
cagcaaggcagcaggcta

SEQ ID NO: 10691 - DNA, 18 bp, Artificial sequence
  synthetic polynucleotide sequence
cgcggagcctgagcagga

SEQ ID NO: 10692 - DNA, 18 bp, Artificial sequence
  synthetic polynucleotide sequence
gctggagggctgtggcga

SEQ ID NO: 10693 - DNA, 18 bp, Artificial sequence
  synthetic polynucleotide sequence
tagcatgggccatgagga

SEQ ID NO: 10694 - DNA, 18 bp, Artificial sequence
  synthetic polynucleotide sequence
cctgagaccgagtcacca

SEQ ID NO: 10695 - DNA, 18 bp, Artificial sequence
  synthetic polynucleotide sequence
caaggccagcgaccagga

SEQ ID NO: 10696 - DNA, 18 bp, Artificial sequence
  synthetic polynucleotide sequence
gccaggctgggaagacca

SEQ ID NO: 10697 - DNA, 18 bp, Artificial sequence
  synthetic polynucleotide sequence
tagctgccaccaggccca

SEQ ID NO: 10698 - DNA, 18 bp, Artificial sequence
  synthetic polynucleotide sequence
gtccaggatccaggggca

SEQ ID NO: 10699 - DNA, 18 bp, Artificial sequence
  synthetic polynucleotide sequence
caagaggaggtggcacca

SEQ ID NO: 10700 - DNA, 18 bp, Artificial sequence
  synthetic polynucleotide sequence
caccacgaccacaagcga

SEQ ID NO: 10701 - DNA, 18 bp, Artificial sequence
  synthetic polynucleotide sequence
aagtggatcagccaggga

SEQ ID NO: 10702 - DNA, 18 bp, Artificial sequence
  synthetic polynucleotide sequence
tgggctagaggatgagga

SEQ ID NO: 10703 - DNA, 18 bp, Artificial sequence
  synthetic polynucleotide sequence
ggaacacggccaccgcga

SEQ ID NO: 10704 - DNA, 18 bp, Artificial sequence
  synthetic polynucleotide sequence
ggaacacggccaccgcga

SEQ ID NO: 10705 - DNA, 18 bp, Artificial sequence
  synthetic polynucleotide sequence
gctggagctgctgaacga

SEQ ID NO: 10706 - DNA, 18 bp, Artificial sequence
  synthetic polynucleotide sequence
catccaggactcgcggta

SEQ ID NO: 10707 - DNA, 18 bp, Artificial sequence
  synthetic polynucleotide sequence
cctcttccggacagagca

SEQ ID NO: 10708 - DNA, 18 bp, Artificial sequence
  synthetic polynucleotide sequence
gaggagctgtggtaagga

SEQ ID NO: 10709 - DNA, 18 bp, Artificial sequence
  synthetic polynucleotide sequence
cccctgatccatgaccga

SEQ ID NO: 10710 - DNA, 18 bp, Artificial sequence
  synthetic polynucleotide sequence
gatgccgtactggaggca

SEQ ID NO: 10711 - DNA, 18 bp, Artificial sequence
  synthetic polynucleotide sequence
gccgctaaagtgtgacga

SEQ ID NO: 10712 - DNA, 18 bp, Artificial sequence
  synthetic polynucleotide sequence
gcctggtaacacgtgcca

SEQ ID NO: 10713 - DNA, 18 bp, Artificial sequence
  synthetic polynucleotide sequence
ccctcttggacgaggaca

SEQ ID NO: 10714 - DNA, 18 bp, Artificial sequence
  synthetic polynucleotide sequence
gggcatctggatccacca

SEQ ID NO: 10715 - DNA, 18 bp, Artificial sequence
  synthetic polynucleotide sequence
tcacagcacattgcagca

SEQ ID NO: 10716 - DNA, 18 bp, Artificial sequence
  synthetic polynucleotide sequence
cggtggatgaggtccaga

SEQ ID NO: 10717 - DNA, 18 bp, Artificial sequence
  synthetic polynucleotide sequence
ctcaagcacagcgtgcca

SEQ ID NO: 10718 - DNA, 18 bp, Artificial sequence
  synthetic polynucleotide sequence
catccggaatgaggagga

SEQ ID NO: 10719 - DNA, 18 bp, Artificial sequence
  synthetic polynucleotide sequence
cctgcagctgggtgcaca

SEQ ID NO: 10720 - DNA, 18 bp, Artificial sequence
  synthetic polynucleotide sequence
gagcccccagttcaccca

SEQ ID NO: 10721 - DNA, 18 bp, Artificial sequence
  synthetic polynucleotide sequence
ggtgtctggcgagggaca

SEQ ID NO: 10722 - DNA, 18 bp, Artificial sequence
  synthetic polynucleotide sequence
ggtgtctggcgagggaca

SEQ ID NO: 10723 - DNA, 18 bp, Artificial sequence
  synthetic polynucleotide sequence
caatgcagcacgacctca

SEQ ID NO: 10724 - DNA, 18 bp, Artificial sequence
  synthetic polynucleotide sequence
agcttcacatccaagcca

SEQ ID NO: 10725 - DNA, 18 bp, Artificial sequence
  synthetic polynucleotide sequence
ggcatcaggatgtagcca

SEQ ID NO: 10726 - DNA, 18 bp, Artificial sequence
  synthetic polynucleotide sequence
cgggaacagggaagcgga

SEQ ID NO: 10727 - DNA, 18 bp, Artificial sequence
  synthetic polynucleotide sequence
gcaggccatgctgagcca

SEQ ID NO: 10728 - DNA, 18 bp, Artificial sequence
  synthetic polynucleotide sequence
agaagctggagagcacga

SEQ ID NO: 10729 - DNA, 18 bp, Artificial sequence
  synthetic polynucleotide sequence
gaagtgagatcctcgcca

SEQ ID NO: 10730 - DNA, 18 bp, Artificial sequence
  synthetic polynucleotide sequence
tgaggaattggccagcga

SEQ ID NO: 10731 - DNA, 18 bp, Artificial sequence
  synthetic polynucleotide sequence
cgtgggaggctacccaga

SEQ ID NO: 10732 - DNA, 18 bp, Artificial sequence
  synthetic polynucleotide sequence
ggacctcgcggttaagga

SEQ ID NO: 10733 - DNA, 18 bp, Artificial sequence
  synthetic polynucleotide sequence
taggaggaggaggaggca

SEQ ID NO: 10734 - DNA, 18 bp, Artificial sequence
  synthetic polynucleotide sequence
gctgctcctaccagcaga

SEQ ID NO: 10735 - DNA, 18 bp, Artificial sequence
  synthetic polynucleotide sequence
tctggaacacagcagcca

SEQ ID NO: 10736 - DNA, 18 bp, Artificial sequence
  synthetic polynucleotide sequence
cagcgggtcctacgagga

SEQ ID NO: 10737 - DNA, 18 bp, Artificial sequence
  synthetic polynucleotide sequence
acgtcataggtggcccca

SEQ ID NO: 10738 - DNA, 18 bp, Artificial sequence
  synthetic polynucleotide sequence
ggaagaccgcaggaagga

SEQ ID NO: 10739 - DNA, 18 bp, Artificial sequence
  synthetic polynucleotide sequence
gttccgggacagcaggca

SEQ ID NO: 10740 - DNA, 18 bp, Artificial sequence
  synthetic polynucleotide sequence
gttccgggacagcaggca

SEQ ID NO: 10741 - DNA, 18 bp, Artificial sequence
  synthetic polynucleotide sequence
ccgatctctgaagcagca

SEQ ID NO: 10742 - DNA, 18 bp, Artificial sequence
  synthetic polynucleotide sequence
acaagacctccaagtcca

SEQ ID NO: 10743 - DNA, 18 bp, Artificial sequence
  synthetic polynucleotide sequence
ggaggaggtctgccccaa

SEQ ID NO: 10744 - DNA, 18 bp, Artificial sequence
  synthetic polynucleotide sequence
cccacaatcccagggcca

SEQ ID NO: 10745 - DNA, 18 bp, Artificial sequence
  synthetic polynucleotide sequence
agggaacctggctgacca

SEQ ID NO: 10746 - DNA, 18 bp, Artificial sequence
  synthetic polynucleotide sequence
gagcagagagagggccca

SEQ ID NO: 10747 - DNA, 18 bp, Artificial sequence
  synthetic polynucleotide sequence
ctgcctactccaccacca

SEQ ID NO: 10748 - DNA, 18 bp, Artificial sequence
  synthetic polynucleotide sequence
tacgacacagtgggcaca

SEQ ID NO: 10749 - DNA, 18 bp, Artificial sequence
  synthetic polynucleotide sequence
ctgggcaagtggtgagga

SEQ ID NO: 10750 - DNA, 18 bp, Artificial sequence
  synthetic polynucleotide sequence
gcatatcaccagcccgga

SEQ ID NO: 10751 - DNA, 18 bp, Artificial sequence
  synthetic polynucleotide sequence
ctgatggggatggaggga

SEQ ID NO: 10752 - DNA, 18 bp, Artificial sequence
  synthetic polynucleotide sequence
gctgccaaggccaccaca

SEQ ID NO: 10753 - DNA, 18 bp, Artificial sequence
  synthetic polynucleotide sequence
gtgaccaggccaacgcca

SEQ ID NO: 10754 - DNA, 18 bp, Artificial sequence
  synthetic polynucleotide sequence
gaaagggcctgacccgga

SEQ ID NO: 10755 - DNA, 18 bp, Artificial sequence
  synthetic polynucleotide sequence
ccgatgactctgcaacca

SEQ ID NO: 10756 - DNA, 18 bp, Artificial sequence
  synthetic polynucleotide sequence
gggctaggcatggacgaa

SEQ ID NO: 10757 - DNA, 18 bp, Artificial sequence
  synthetic polynucleotide sequence
aagcgagctaacagccca

SEQ ID NO: 10758 - DNA, 18 bp, Artificial sequence
  synthetic polynucleotide sequence
aagcgagctaacagccca

SEQ ID NO: 10759 - DNA, 18 bp, Artificial sequence
  synthetic polynucleotide sequence
gctccaagacccagccaa

SEQ ID NO: 10760 - DNA, 18 bp, Artificial sequence
  synthetic polynucleotide sequence
agtcgccgctcctcacca

SEQ ID NO: 10761 - DNA, 18 bp, Artificial sequence
  synthetic polynucleotide sequence
cccgctataacctgggca

SEQ ID NO: 10762 - DNA, 18 bp, Artificial sequence
  synthetic polynucleotide sequence
aacgcagggtgctccaga

SEQ ID NO: 10763 - DNA, 18 bp, Artificial sequence
  synthetic polynucleotide sequence
cccttctgacccacagca

SEQ ID NO: 10764 - DNA, 18 bp, Artificial sequence
  synthetic polynucleotide sequence
tcctcagccaggagagga

SEQ ID NO: 10765 - DNA, 18 bp, Artificial sequence
  synthetic polynucleotide sequence
gattggagccaaaccaga

SEQ ID NO: 10766 - DNA, 18 bp, Artificial sequence
  synthetic polynucleotide sequence
caaccagggatgtgggga

SEQ ID NO: 10767 - DNA, 18 bp, Artificial sequence
  synthetic polynucleotide sequence
cactgccccactgcccaa

SEQ ID NO: 10768 - DNA, 18 bp, Artificial sequence
  synthetic polynucleotide sequence
cggggcttgcaggtccaa

SEQ ID NO: 10769 - DNA, 18 bp, Artificial sequence
  synthetic polynucleotide sequence
tcacacacaggcactgca

SEQ ID NO: 10770 - DNA, 18 bp, Artificial sequence
  synthetic polynucleotide sequence
cagccaggtcccgcctca

SEQ ID NO: 10771 - DNA, 18 bp, Artificial sequence
  synthetic polynucleotide sequence
ccatcagcatctcccgga

SEQ ID NO: 10772 - DNA, 18 bp, Artificial sequence
  synthetic polynucleotide sequence
cttcagtccaaggaagca

SEQ ID NO: 10773 - DNA, 18 bp, Artificial sequence
  synthetic polynucleotide sequence
aggccaggaggcaccgca

SEQ ID NO: 10774 - DNA, 18 bp, Artificial sequence
  synthetic polynucleotide sequence
ccgctatcccaagggaga

SEQ ID NO: 10775 - DNA, 18 bp, Artificial sequence
  synthetic polynucleotide sequence
gtgtgcagacggactcca

SEQ ID NO: 10776 - DNA, 18 bp, Artificial sequence
  synthetic polynucleotide sequence
gtgtgcagacggactcca

SEQ ID NO: 10777 - DNA, 18 bp, Artificial sequence
  synthetic polynucleotide sequence
cccagccaccatcagcaa

SEQ ID NO: 10778 - DNA, 18 bp, Artificial sequence
  synthetic polynucleotide sequence
acggtggccaggtagcca

SEQ ID NO: 10779 - DNA, 18 bp, Artificial sequence
  synthetic polynucleotide sequence
agcagggtgggagcccaa

SEQ ID NO: 10780 - DNA, 18 bp, Artificial sequence
  synthetic polynucleotide sequence
ccagagccctcttacgca

SEQ ID NO: 10781 - DNA, 18 bp, Artificial sequence
  synthetic polynucleotide sequence
cacagatgcgcacgcaca

SEQ ID NO: 10782 - DNA, 18 bp, Artificial sequence
  synthetic polynucleotide sequence
catgaccatggggacaca

SEQ ID NO: 10783 - DNA, 18 bp, Artificial sequence
  synthetic polynucleotide sequence
catcgtgggctacaagga

SEQ ID NO: 10784 - DNA, 18 bp, Artificial sequence
  synthetic polynucleotide sequence
tgccaaccaggacaccca

SEQ ID NO: 10785 - DNA, 18 bp, Artificial sequence
  synthetic polynucleotide sequence
ggggtccatggaggcgga

SEQ ID NO: 10786 - DNA, 17 bp, Artificial sequence
  synthetic polynucleotide sequence
ccccaccaacagaggga

SEQ ID NO: 10787 - DNA, 18 bp, Artificial sequence
  synthetic polynucleotide sequence
tgaagacgatgtcgggca

SEQ ID NO: 10788 - DNA, 18 bp, Artificial sequence
  synthetic polynucleotide sequence
acatcggagccagcgaga

SEQ ID NO: 10789 - DNA, 18 bp, Artificial sequence
  synthetic polynucleotide sequence
tactggcggatgaagaca

SEQ ID NO: 10790 - DNA, 18 bp, Artificial sequence
  synthetic polynucleotide sequence
tcctgcagagcgagggga

SEQ ID NO: 10791 - DNA, 18 bp, Artificial sequence
  synthetic polynucleotide sequence
acatcacccaggatccaa

SEQ ID NO: 10792 - DNA, 18 bp, Artificial sequence
  synthetic polynucleotide sequence
caccatcaatggagtcca

SEQ ID NO: 10793 - DNA, 18 bp, Artificial sequence
  synthetic polynucleotide sequence
gactctcacaggagggta

SEQ ID NO: 10794 - DNA, 18 bp, Artificial sequence
  synthetic polynucleotide sequence
gactctcacaggagggta

SEQ ID NO: 10795 - DNA, 18 bp, Artificial sequence
  synthetic polynucleotide sequence
gcgagagcctcaaggaca

SEQ ID NO: 10796 - DNA, 18 bp, Artificial sequence
  synthetic polynucleotide sequence
cgtgggctgcaatgagca

SEQ ID NO: 10797 - DNA, 18 bp, Artificial sequence
  synthetic polynucleotide sequence
gcgtctgcaaagtcagca

SEQ ID NO: 10798 - DNA, 18 bp, Artificial sequence
  synthetic polynucleotide sequence
ccggcttccaatgagaca

SEQ ID NO: 10799 - DNA, 18 bp, Artificial sequence
  synthetic polynucleotide sequence
accattgcacaggctcca

SEQ ID NO: 10800 - DNA, 18 bp, Artificial sequence
  synthetic polynucleotide sequence
taagcaggaagagctcca

SEQ ID NO: 10801 - DNA, 18 bp, Artificial sequence
  synthetic polynucleotide sequence
aggctggagtgtacacca

SEQ ID NO: 10802 - DNA, 18 bp, Artificial sequence
  synthetic polynucleotide sequence
gttcccgaagtcccacca

SEQ ID NO: 10803 - DNA, 18 bp, Artificial sequence
  synthetic polynucleotide sequence
gggctctacctccaggaa

SEQ ID NO: 10804 - DNA, 18 bp, Artificial sequence
  synthetic polynucleotide sequence
gtggtacatgggggagga

SEQ ID NO: 10805 - DNA, 18 bp, Artificial sequence
  synthetic polynucleotide sequence
aggaaggtggcagaggga

SEQ ID NO: 10806 - DNA, 18 bp, Artificial sequence
  synthetic polynucleotide sequence
ctgagggttgccaggcca

SEQ ID NO: 10807 - DNA, 18 bp, Artificial sequence
  synthetic polynucleotide sequence
ctggctccaggcactcca

SEQ ID NO: 10808 - DNA, 18 bp, Artificial sequence
  synthetic polynucleotide sequence
cagggccatcatggagga

SEQ ID NO: 10809 - DNA, 18 bp, Artificial sequence
  synthetic polynucleotide sequence
gaggatgacacggtgcca

SEQ ID NO: 10810 - DNA, 18 bp, Artificial sequence
  synthetic polynucleotide sequence
catccaggctcagcggga

SEQ ID NO: 10811 - DNA, 18 bp, Artificial sequence
  synthetic polynucleotide sequence
accggcacacagtgcaga

SEQ ID NO: 10812 - DNA, 18 bp, Artificial sequence
  synthetic polynucleotide sequence
accggcacacagtgcaga

SEQ ID NO: 10813 - DNA, 17 bp, Artificial sequence
  synthetic polynucleotide sequence
gtgcccatgcctgacaa

SEQ ID NO: 10814 - DNA, 19 bp, Artificial sequence
  synthetic polynucleotide sequence
tctccagcaggatgacaga

SEQ ID NO: 10815 - DNA, 18 bp, Artificial sequence
  synthetic polynucleotide sequence
tgatgaagagggagccaa

SEQ ID NO: 10816 - DNA, 18 bp, Artificial sequence
  synthetic polynucleotide sequence
tgagccacaacttgagca

SEQ ID NO: 10817 - DNA, 18 bp, Artificial sequence
  synthetic polynucleotide sequence
cgagctgcctgtggagga

SEQ ID NO: 10818 - DNA, 18 bp, Artificial sequence
  synthetic polynucleotide sequence
agtgagcaggtgtgacca

SEQ ID NO: 10819 - DNA, 18 bp, Artificial sequence
  synthetic polynucleotide sequence
ggagaagacgggctcgta

SEQ ID NO: 10820 - DNA, 18 bp, Artificial sequence
  synthetic polynucleotide sequence
cccatgaagctgatgcca

SEQ ID NO: 10821 - DNA, 18 bp, Artificial sequence
  synthetic polynucleotide sequence
ctaccaccaggacacgca

SEQ ID NO: 10822 - DNA, 18 bp, Artificial sequence
  synthetic polynucleotide sequence
gcaccgcacaactcggga

SEQ ID NO: 10823 - DNA, 18 bp, Artificial sequence
  synthetic polynucleotide sequence
accccttcatacacgcca

SEQ ID NO: 10824 - DNA, 18 bp, Artificial sequence
  synthetic polynucleotide sequence
ggaagccagagagacaca

SEQ ID NO: 10825 - DNA, 18 bp, Artificial sequence
  synthetic polynucleotide sequence
gagacaaggttcgggcca

SEQ ID NO: 10826 - DNA, 18 bp, Artificial sequence
  synthetic polynucleotide sequence
gcactagaggcagcccaa

SEQ ID NO: 10827 - DNA, 18 bp, Artificial sequence
  synthetic polynucleotide sequence
aggacagcccacagtcca

SEQ ID NO: 10828 - DNA, 18 bp, Artificial sequence
  synthetic polynucleotide sequence
cacggagcatgcccacga

SEQ ID NO: 10829 - DNA, 18 bp, Artificial sequence
  synthetic polynucleotide sequence
aagctatgacccacccca

SEQ ID NO: 10830 - DNA, 18 bp, Artificial sequence
  synthetic polynucleotide sequence
aagctatgacccacccca

SEQ ID NO: 10831 - DNA, 18 bp, Artificial sequence
  synthetic polynucleotide sequence
gtcccacaatcctgagga

SEQ ID NO: 10832 - DNA, 18 bp, Artificial sequence
  synthetic polynucleotide sequence
cctcccaggatggtgcca

SEQ ID NO: 10833 - DNA, 18 bp, Artificial sequence
  synthetic polynucleotide sequence
tggtccgagccgtggaga

SEQ ID NO: 10834 - DNA, 18 bp, Artificial sequence
  synthetic polynucleotide sequence
cctgggacacgcagtcga

SEQ ID NO: 10835 - DNA, 18 bp, Artificial sequence
  synthetic polynucleotide sequence
aggacgggcctgaaagca

SEQ ID NO: 10836 - DNA, 18 bp, Artificial sequence
  synthetic polynucleotide sequence
aaggctgatcgaccgtga

SEQ ID NO: 10837 - DNA, 18 bp, Artificial sequence
  synthetic polynucleotide sequence
gtggcagatcccacagga

SEQ ID NO: 10838 - DNA, 18 bp, Artificial sequence
  synthetic polynucleotide sequence
aacgctgtgagctcgaca

SEQ ID NO: 10839 - DNA, 18 bp, Artificial sequence
  synthetic polynucleotide sequence
acccaagcgatctggaga

SEQ ID NO: 10840 - DNA, 18 bp, Artificial sequence
  synthetic polynucleotide sequence
aggaagatgcagaggcca

SEQ ID NO: 10841 - DNA, 18 bp, Artificial sequence
  synthetic polynucleotide sequence
gctgtcccaggctgcaca

SEQ ID NO: 10842 - DNA, 18 bp, Artificial sequence
  synthetic polynucleotide sequence
cctgctggcctcaccaga

SEQ ID NO: 10843 - DNA, 18 bp, Artificial sequence
  synthetic polynucleotide sequence
ggagtcgccctcagcaga

SEQ ID NO: 10844 - DNA, 18 bp, Artificial sequence
  synthetic polynucleotide sequence
ctcagcaggaagcagaga

SEQ ID NO: 10845 - DNA, 18 bp, Artificial sequence
  synthetic polynucleotide sequence
cctccttgagcagcagca

SEQ ID NO: 10846 - DNA, 18 bp, Artificial sequence
  synthetic polynucleotide sequence
gccaagtgagcccaccaa

SEQ ID NO: 10847 - DNA, 18 bp, Artificial sequence
  synthetic polynucleotide sequence
tgagggggactgtgagca

SEQ ID NO: 10848 - DNA, 18 bp, Artificial sequence
  synthetic polynucleotide sequence
tgagggggactgtgagca

SEQ ID NO: 10849 - DNA, 18 bp, Artificial sequence
  synthetic polynucleotide sequence
caatcagcccgagcccca

SEQ ID NO: 10850 - DNA, 18 bp, Artificial sequence
  synthetic polynucleotide sequence
gctgggggatggtggaga

SEQ ID NO: 10851 - DNA, 18 bp, Artificial sequence
  synthetic polynucleotide sequence
ggacagctcctctggcaa

SEQ ID NO: 10852 - DNA, 18 bp, Artificial sequence
  synthetic polynucleotide sequence
cccaggaactgacttgga

SEQ ID NO: 10853 - DNA, 18 bp, Artificial sequence
  synthetic polynucleotide sequence
agaggagccaccgtggga

SEQ ID NO: 10854 - DNA, 19 bp, Artificial sequence
  synthetic polynucleotide sequence
gatgatcgggaattgagca

SEQ ID NO: 10855 - DNA, 18 bp, Artificial sequence
  synthetic polynucleotide sequence
agaaccacaccgtcggca

SEQ ID NO: 10856 - DNA, 18 bp, Artificial sequence
  synthetic polynucleotide sequence
ggcaggcttgggacagga

SEQ ID NO: 10857 - DNA, 18 bp, Artificial sequence
  synthetic polynucleotide sequence
tccgagatgaggacagca

SEQ ID NO: 10858 - DNA, 18 bp, Artificial sequence
  synthetic polynucleotide sequence
gcaggtcacgaggtccca

SEQ ID NO: 10859 - DNA, 18 bp, Artificial sequence
  synthetic polynucleotide sequence
caacccccttcactggca

SEQ ID NO: 10860 - DNA, 18 bp, Artificial sequence
  synthetic polynucleotide sequence
cgggagtgatgaagacga

SEQ ID NO: 10861 - DNA, 18 bp, Artificial sequence
  synthetic polynucleotide sequence
agctctctgggaccacca

SEQ ID NO: 10862 - DNA, 18 bp, Artificial sequence
  synthetic polynucleotide sequence
gccctggaagtgaaggca

SEQ ID NO: 10863 - DNA, 18 bp, Artificial sequence
  synthetic polynucleotide sequence
cttgaggtgggacaggga

SEQ ID NO: 10864 - DNA, 18 bp, Artificial sequence
  synthetic polynucleotide sequence
ccagatggacagtgggca

SEQ ID NO: 10865 - DNA, 18 bp, Artificial sequence
  synthetic polynucleotide sequence
cggtctcgatggaagcca

SEQ ID NO: 10866 - DNA, 18 bp, Artificial sequence
  synthetic polynucleotide sequence
cggtctcgatggaagcca

SEQ ID NO: 10867 - DNA, 18 bp, Artificial sequence
  synthetic polynucleotide sequence
gctggacagaggtggaga

SEQ ID NO: 10868 - DNA, 18 bp, Artificial sequence
  synthetic polynucleotide sequence
cccagtgtagtccagcca

SEQ ID NO: 10869 - DNA, 18 bp, Artificial sequence
  synthetic polynucleotide sequence
cctggagaccgagaggaa

SEQ ID NO: 10870 - DNA, 18 bp, Artificial sequence
  synthetic polynucleotide sequence
acctggggcacacccaca

SEQ ID NO: 10871 - DNA, 18 bp, Artificial sequence
  synthetic polynucleotide sequence
gctccagtgaaggcgaga

SEQ ID NO: 10872 - DNA, 18 bp, Artificial sequence
  synthetic polynucleotide sequence
aggtggatccacgtccca

SEQ ID NO: 10873 - DNA, 18 bp, Artificial sequence
  synthetic polynucleotide sequence
ggcaagcagcaggacgaa

SEQ ID NO: 10874 - DNA, 18 bp, Artificial sequence
  synthetic polynucleotide sequence
tgtgtgacaggccaggca

SEQ ID NO: 10875 - DNA, 19 bp, Artificial sequence
  synthetic polynucleotide sequence
gcaccatccaggagaagga

SEQ ID NO: 10876 - DNA, 18 bp, Artificial sequence
  synthetic polynucleotide sequence
gaaggggccacccaccaa

SEQ ID NO: 10877 - DNA, 18 bp, Artificial sequence
  synthetic polynucleotide sequence
atagtagcaccaggctga

SEQ ID NO: 10878 - DNA, 18 bp, Artificial sequence
  synthetic polynucleotide sequence
ggcacagtccagctcaca

SEQ ID NO: 10879 - DNA, 18 bp, Artificial sequence
  synthetic polynucleotide sequence
aaggaaggttctggccaa

SEQ ID NO: 10880 - DNA, 18 bp, Artificial sequence
  synthetic polynucleotide sequence
ccacggaacccacaggga

SEQ ID NO: 10881 - DNA, 18 bp, Artificial sequence
  synthetic polynucleotide sequence
aaggcttcgcacggggca

SEQ ID NO: 10882 - DNA, 18 bp, Artificial sequence
  synthetic polynucleotide sequence
ggctaggctgatggcaga

SEQ ID NO: 10883 - DNA, 18 bp, Artificial sequence
  synthetic polynucleotide sequence
ggtaggacagcagccgca

SEQ ID NO: 10884 - DNA, 18 bp, Artificial sequence
  synthetic polynucleotide sequence
ggtaggacagcagccgca

SEQ ID NO: 10885 - DNA, 18 bp, Artificial sequence
  synthetic polynucleotide sequence
ggcgacgggaagcacaga

SEQ ID NO: 10886 - DNA, 18 bp, Artificial sequence
  synthetic polynucleotide sequence
gtcccatcacgactgcca

SEQ ID NO: 10887 - DNA, 18 bp, Artificial sequence
  synthetic polynucleotide sequence
atcctcgacgacccgaga

SEQ ID NO: 10888 - DNA, 18 bp, Artificial sequence
  synthetic polynucleotide sequence
ccgagagcagcgtcagca

SEQ ID NO: 10889 - DNA, 18 bp, Artificial sequence
  synthetic polynucleotide sequence
tctggcaccggaagcaga

SEQ ID NO: 10890 - DNA, 18 bp, Artificial sequence
  synthetic polynucleotide sequence
ggggttgcaccaccagga

SEQ ID NO: 10891 - DNA, 18 bp, Artificial sequence
  synthetic polynucleotide sequence
acccatcgtgtacggcca

SEQ ID NO: 10892 - DNA, 18 bp, Artificial sequence
  synthetic polynucleotide sequence
ccgtagagccggaaggca

SEQ ID NO: 10893 - DNA, 18 bp, Artificial sequence
  synthetic polynucleotide sequence
gccggtcaagctcaagga

SEQ ID NO: 10894 - DNA, 18 bp, Artificial sequence
  synthetic polynucleotide sequence
gcaccatctgcagcgtga

SEQ ID NO: 10895 - DNA, 18 bp, Artificial sequence
  synthetic polynucleotide sequence
tgcgctccacgcagtcca

SEQ ID NO: 10896 - DNA, 18 bp, Artificial sequence
  synthetic polynucleotide sequence
cggggtgctcacctccga

SEQ ID NO: 10897 - DNA, 18 bp, Artificial sequence
  synthetic polynucleotide sequence
tgggcgttccagccggga

SEQ ID NO: 10898 - DNA, 18 bp, Artificial sequence
  synthetic polynucleotide sequence
ccgcatcaaggccgtgga

SEQ ID NO: 10899 - DNA, 18 bp, Artificial sequence
  synthetic polynucleotide sequence
cagcacagagactgagga

SEQ ID NO: 10900 - DNA, 18 bp, Artificial sequence
  synthetic polynucleotide sequence
tgcccttcgggaacggaa

SEQ ID NO: 10901 - DNA, 18 bp, Artificial sequence
  synthetic polynucleotide sequence
ggaggacagaaccccgga

SEQ ID NO: 10902 - DNA, 18 bp, Artificial sequence
  synthetic polynucleotide sequence
ggaggacagaaccccgga

SEQ ID NO: 10903 - DNA, 18 bp, Artificial sequence
  synthetic polynucleotide sequence
gacctcacagaggcgcga

SEQ ID NO: 10904 - DNA, 18 bp, Artificial sequence
  synthetic polynucleotide sequence
gtccctggaagagtcaga

SEQ ID NO: 10905 - DNA, 18 bp, Artificial sequence
  synthetic polynucleotide sequence
ggaacaactcacagcaca

SEQ ID NO: 10906 - DNA, 18 bp, Artificial sequence
  synthetic polynucleotide sequence
cacacaagagacacgcga

SEQ ID NO: 10907 - DNA, 18 bp, Artificial sequence
  synthetic polynucleotide sequence
ccggcagcaaatatggaa

SEQ ID NO: 10908 - DNA, 18 bp, Artificial sequence
  synthetic polynucleotide sequence
gtgtgcacatgggaccaa

SEQ ID NO: 10909 - DNA, 18 bp, Artificial sequence
  synthetic polynucleotide sequence
gaggcagctgtcacggga

SEQ ID NO: 10910 - DNA, 18 bp, Artificial sequence
  synthetic polynucleotide sequence
gggattcaacatggcgca

SEQ ID NO: 10911 - DNA, 18 bp, Artificial sequence
  synthetic polynucleotide sequence
tcggcaacaagccaccca

SEQ ID NO: 10912 - DNA, 18 bp, Artificial sequence
  synthetic polynucleotide sequence
cgatctcagtggccagca

SEQ ID NO: 10913 - DNA, 18 bp, Artificial sequence
  synthetic polynucleotide sequence
accgagacgagtgtagga

SEQ ID NO: 10914 - DNA, 18 bp, Artificial sequence
  synthetic polynucleotide sequence
cagtatcccgcaccccaa

SEQ ID NO: 10915 - DNA, 18 bp, Artificial sequence
  synthetic polynucleotide sequence
agcagcaggatcaaccga

SEQ ID NO: 10916 - DNA, 18 bp, Artificial sequence
  synthetic polynucleotide sequence
ccctcctgccaaaaggaa

SEQ ID NO: 10917 - DNA, 18 bp, Artificial sequence
  synthetic polynucleotide sequence
gctcccagtgggaaggca

SEQ ID NO: 10918 - DNA, 18 bp, Artificial sequence
  synthetic polynucleotide sequence
acatctggccaccagcca

SEQ ID NO: 10919 - DNA, 18 bp, Artificial sequence
  synthetic polynucleotide sequence
tagtagcaggataggcca

SEQ ID NO: 10920 - DNA, 18 bp, Artificial sequence
  synthetic polynucleotide sequence
tagtagcaggataggcca

SEQ ID NO: 10921 - DNA, 18 bp, Artificial sequence
  synthetic polynucleotide sequence
ctcccagatgcgcaagga

SEQ ID NO: 10922 - DNA, 18 bp, Artificial sequence
  synthetic polynucleotide sequence
agacgtcggcatcccgca

SEQ ID NO: 10923 - DNA, 18 bp, Artificial sequence
  synthetic polynucleotide sequence
ctcctggaaatccggcca

SEQ ID NO: 10924 - DNA, 18 bp, Artificial sequence
  synthetic polynucleotide sequence
cgggccacctggaaggta

SEQ ID NO: 10925 - DNA, 18 bp, Artificial sequence
  synthetic polynucleotide sequence
gggcgatgtccatccaca

SEQ ID NO: 10926 - DNA, 18 bp, Artificial sequence
  synthetic polynucleotide sequence
ggtcacagcgaaccgcca

SEQ ID NO: 10927 - DNA, 18 bp, Artificial sequence
  synthetic polynucleotide sequence
cagcgtggccgctagtca

SEQ ID NO: 10928 - DNA, 18 bp, Artificial sequence
  synthetic polynucleotide sequence
atcgggatgtacacacca

SEQ ID NO: 10929 - DNA, 18 bp, Artificial sequence
  synthetic polynucleotide sequence
gagtaagtggccacagca

SEQ ID NO: 10930 - DNA, 18 bp, Artificial sequence
  synthetic polynucleotide sequence
ttgagcacgaagaggaca

SEQ ID NO: 10931 - DNA, 18 bp, Artificial sequence
  synthetic polynucleotide sequence
accatggtgaccgcagca

SEQ ID NO: 10932 - DNA, 18 bp, Artificial sequence
  synthetic polynucleotide sequence
gtgctcctgaacacggca

SEQ ID NO: 10933 - DNA, 18 bp, Artificial sequence
  synthetic polynucleotide sequence
cggtgctggactggagca

SEQ ID NO: 10934 - DNA, 18 bp, Artificial sequence
  synthetic polynucleotide sequence
ccaccactgagagcacca

SEQ ID NO: 10935 - DNA, 18 bp, Artificial sequence
  synthetic polynucleotide sequence
ggaaggttcgggtgagga

SEQ ID NO: 10936 - DNA, 18 bp, Artificial sequence
  synthetic polynucleotide sequence
ctggtgaacctgccgaca

SEQ ID NO: 10937 - DNA, 18 bp, Artificial sequence
  synthetic polynucleotide sequence
aagcacaaggggctgcca

SEQ ID NO: 10938 - DNA, 18 bp, Artificial sequence
  synthetic polynucleotide sequence
aagcacaaggggctgcca

SEQ ID NO: 10939 - DNA, 18 bp, Artificial sequence
  synthetic polynucleotide sequence
ggcgagacatggcacgca

SEQ ID NO: 10940 - DNA, 18 bp, Artificial sequence
  synthetic polynucleotide sequence
aggcagatagcagggcca

SEQ ID NO: 10941 - DNA, 18 bp, Artificial sequence
  synthetic polynucleotide sequence
tcagtgtgagcagcggga

SEQ ID NO: 10942 - DNA, 18 bp, Artificial sequence
  synthetic polynucleotide sequence
ggggtctctcgagggaca

SEQ ID NO: 10943 - DNA, 19 bp, Artificial sequence
  synthetic polynucleotide sequence
accccaaactacagacgca

SEQ ID NO: 10944 - DNA, 21 bp, Artificial sequence
  synthetic polynucleotide sequence
ccagaaaaacgaagctgagca

SEQ ID NO: 10945 - DNA, 18 bp, Artificial sequence
  synthetic polynucleotide sequence
gggaagaagaccagcgca

SEQ ID NO: 10946 - DNA, 18 bp, Artificial sequence
  synthetic polynucleotide sequence
gcacagccatacgacgca

SEQ ID NO: 10947 - DNA, 18 bp, Artificial sequence
  synthetic polynucleotide sequence
tgacaaagtcgggccaca

SEQ ID NO: 10948 - DNA, 18 bp, Artificial sequence
  synthetic polynucleotide sequence
gcagtcctgcatacagca

SEQ ID NO: 10949 - DNA, 18 bp, Artificial sequence
  synthetic polynucleotide sequence
cgcaaccgggcaacagca

SEQ ID NO: 10950 - DNA, 20 bp, Artificial sequence
  synthetic polynucleotide sequence
ggatctacctcaagaggcca

SEQ ID NO: 10951 - DNA, 18 bp, Artificial sequence
  synthetic polynucleotide sequence
gcattccagagccaagca

SEQ ID NO: 10952 - DNA, 18 bp, Artificial sequence
  synthetic polynucleotide sequence
ggagcccaagaatgcaca

SEQ ID NO: 10953 - DNA, 18 bp, Artificial sequence
  synthetic polynucleotide sequence
tcaatgaggccagagcga

SEQ ID NO: 10954 - DNA, 18 bp, Artificial sequence
  synthetic polynucleotide sequence
cagtcacccctgaaccca

SEQ ID NO: 10955 - DNA, 18 bp, Artificial sequence
  synthetic polynucleotide sequence
ccacgcagacttcagcca

SEQ ID NO: 10956 - DNA, 18 bp, Artificial sequence
  synthetic polynucleotide sequence
ccacgcagacttcagcca

SEQ ID NO: 10957 - DNA, 18 bp, Artificial sequence
  synthetic polynucleotide sequence
acagtgggcaacacggga

SEQ ID NO: 10958 - DNA, 18 bp, Artificial sequence
  synthetic polynucleotide sequence
gccacacagtagcctgca

SEQ ID NO: 10959 - DNA, 18 bp, Artificial sequence
  synthetic polynucleotide sequence
gcggatgaactccaagga

SEQ ID NO: 10960 - DNA, 18 bp, Artificial sequence
  synthetic polynucleotide sequence
tgaaggcagacaagggca

SEQ ID NO: 10961 - DNA, 18 bp, Artificial sequence
  synthetic polynucleotide sequence
cgacagcctgcaccagca

SEQ ID NO: 10962 - DNA, 18 bp, Artificial sequence
  synthetic polynucleotide sequence
ccccagtaccattcagca

SEQ ID NO: 10963 - DNA, 18 bp, Artificial sequence
  synthetic polynucleotide sequence
atcaaccgcacgcaggca

SEQ ID NO: 10964 - DNA, 18 bp, Artificial sequence
  synthetic polynucleotide sequence
cgtgcggtagatgacgca

SEQ ID NO: 10965 - DNA, 18 bp, Artificial sequence
  synthetic polynucleotide sequence
ctccattaccagcagaca

SEQ ID NO: 10966 - DNA, 18 bp, Artificial sequence
  synthetic polynucleotide sequence
gcatgaacagggtaggca

SEQ ID NO: 10967 - DNA, 18 bp, Artificial sequence
  synthetic polynucleotide sequence
tgtcagccaggatgggca

SEQ ID NO: 10968 - DNA, 18 bp, Artificial sequence
  synthetic polynucleotide sequence
acccctggtatgagcgca

SEQ ID NO: 10969 - DNA, 18 bp, Artificial sequence
  synthetic polynucleotide sequence
gaggcaacagcctgcgga

SEQ ID NO: 10970 - DNA, 18 bp, Artificial sequence
  synthetic polynucleotide sequence
gattgagggacgagggca

SEQ ID NO: 10971 - DNA, 18 bp, Artificial sequence
  synthetic polynucleotide sequence
tgagcacagcgacagcca

SEQ ID NO: 10972 - DNA, 18 bp, Artificial sequence
  synthetic polynucleotide sequence
ccagcagcacaaccacca

SEQ ID NO: 10973 - DNA, 18 bp, Artificial sequence
  synthetic polynucleotide sequence
tggtctcagggccaagca

SEQ ID NO: 10974 - DNA, 18 bp, Artificial sequence
  synthetic polynucleotide sequence
tggtctcagggccaagca

SEQ ID NO: 10975 - DNA, 19 bp, Artificial sequence
  synthetic polynucleotide sequence
cgaccctcactggaagaga

SEQ ID NO: 10976 - DNA, 18 bp, Artificial sequence
  synthetic polynucleotide sequence
tagcaaggaccaggccaa

SEQ ID NO: 10977 - DNA, 18 bp, Artificial sequence
  synthetic polynucleotide sequence
ctctccagagtgccagca

SEQ ID NO: 10978 - DNA, 18 bp, Artificial sequence
  synthetic polynucleotide sequence
cagggtcgagggtgcaca

SEQ ID NO: 10979 - DNA, 18 bp, Artificial sequence
  synthetic polynucleotide sequence
taacgccagccagtggga

SEQ ID NO: 10980 - DNA, 18 bp, Artificial sequence
  synthetic polynucleotide sequence
gcaggtgcgagcagcgga

SEQ ID NO: 10981 - DNA, 18 bp, Artificial sequence
  synthetic polynucleotide sequence
gggcatcgcgcacagaga

SEQ ID NO: 10982 - DNA, 18 bp, Artificial sequence
  synthetic polynucleotide sequence
tggacacctctggggcca

SEQ ID NO: 10983 - DNA, 18 bp, Artificial sequence
  synthetic polynucleotide sequence
ccaagtttggccagcgga

SEQ ID NO: 10984 - DNA, 17 bp, Artificial sequence
  synthetic polynucleotide sequence
ggtagctccgagtccca

SEQ ID NO: 10985 - DNA, 18 bp, Artificial sequence
  synthetic polynucleotide sequence
tgaactgcaagcactgca

SEQ ID NO: 10986 - DNA, 18 bp, Artificial sequence
  synthetic polynucleotide sequence
tcagggccagccctgcca

SEQ ID NO: 10987 - DNA, 18 bp, Artificial sequence
  synthetic polynucleotide sequence
ggaataggcgagccctca

SEQ ID NO: 10988 - DNA, 18 bp, Artificial sequence
  synthetic polynucleotide sequence
agcaggctccagtggcaa

SEQ ID NO: 10989 - DNA, 18 bp, Artificial sequence
  synthetic polynucleotide sequence
ggtggggacacaagccca

SEQ ID NO: 10990 - DNA, 18 bp, Artificial sequence
  synthetic polynucleotide sequence
cagcaggtccttggacca

SEQ ID NO: 10991 - DNA, 18 bp, Artificial sequence
  synthetic polynucleotide sequence
taggcacacatctgggga

SEQ ID NO: 10992 - DNA, 18 bp, Artificial sequence
  synthetic polynucleotide sequence
taggcacacatctgggga

SEQ ID NO: 10993 - DNA, 18 bp, Artificial sequence
  synthetic polynucleotide sequence
tgcagccctacgacgaca

SEQ ID NO: 10994 - DNA, 18 bp, Artificial sequence
  synthetic polynucleotide sequence
tcactgctgagggcacca

SEQ ID NO: 10995 - DNA, 18 bp, Artificial sequence
  synthetic polynucleotide sequence
cggctactcgtacggcaa

SEQ ID NO: 10996 - DNA, 18 bp, Artificial sequence
  synthetic polynucleotide sequence
gatggagctgggtggcga

SEQ ID NO: 10997 - DNA, 18 bp, Artificial sequence
  synthetic polynucleotide sequence
tgcccagtcccaagccaa

SEQ ID NO: 10998 - DNA, 18 bp, Artificial sequence
  synthetic polynucleotide sequence
gttaacactggccacgca

SEQ ID NO: 10999 - DNA, 18 bp, Artificial sequence
  synthetic polynucleotide sequence
ggtcaccgtgctgaacga

SEQ ID NO: 11000 - DNA, 18 bp, Artificial sequence
  synthetic polynucleotide sequence
tgtggaccctcagggaca

SEQ ID NO: 11001 - DNA, 18 bp, Artificial sequence
  synthetic polynucleotide sequence
gcggcaaggaggaggcaa

SEQ ID NO: 11002 - DNA, 18 bp, Artificial sequence
  synthetic polynucleotide sequence
catccaggcttcgaggga

SEQ ID NO: 11003 - DNA, 19 bp, Artificial sequence
  synthetic polynucleotide sequence
gcagggaattctgccacca

SEQ ID NO: 11004 - DNA, 18 bp, Artificial sequence
  synthetic polynucleotide sequence
gctggatcacaagaggga

SEQ ID NO: 11005 - DNA, 18 bp, Artificial sequence
  synthetic polynucleotide sequence
aaggcccgacactgggca

SEQ ID NO: 11006 - DNA, 18 bp, Artificial sequence
  synthetic polynucleotide sequence
catcctaccaccacggga

SEQ ID NO: 11007 - DNA, 18 bp, Artificial sequence
  synthetic polynucleotide sequence
gcaccaggaaggtggcga

SEQ ID NO: 11008 - DNA, 18 bp, Artificial sequence
  synthetic polynucleotide sequence
agtgggacccaacagcga

SEQ ID NO: 11009 - DNA, 18 bp, Artificial sequence
  synthetic polynucleotide sequence
tccccgaagcaacgcaca

SEQ ID NO: 11010 - DNA, 18 bp, Artificial sequence
  synthetic polynucleotide sequence
tccccgaagcaacgcaca

SEQ ID NO: 11011 - DNA, 18 bp, Artificial sequence
  synthetic polynucleotide sequence
caaccgagtccgagggaa

SEQ ID NO: 11012 - DNA, 18 bp, Artificial sequence
  synthetic polynucleotide sequence
cctgggcaaggttcacca

SEQ ID NO: 11013 - DNA, 17 bp, Artificial sequence
  synthetic polynucleotide sequence
ggggaagcccagggaga

SEQ ID NO: 11014 - DNA, 17 bp, Artificial sequence
  synthetic polynucleotide sequence
gcaatgcagcacagcca

SEQ ID NO: 11015 - DNA, 18 bp, Artificial sequence
  synthetic polynucleotide sequence
ccaacgagggcagagaca

SEQ ID NO: 11016 - DNA, 18 bp, Artificial sequence
  synthetic polynucleotide sequence
aaggcagcctccacagca

SEQ ID NO: 11017 - DNA, 18 bp, Artificial sequence
  synthetic polynucleotide sequence
gcgaccccacagaagcca

SEQ ID NO: 11018 - DNA, 18 bp, Artificial sequence
  synthetic polynucleotide sequence
ggattccgggtcacagca

SEQ ID NO: 11019 - DNA, 18 bp, Artificial sequence
  synthetic polynucleotide sequence
cccaggggatgatgagga

SEQ ID NO: 11020 - DNA, 18 bp, Artificial sequence
  synthetic polynucleotide sequence
cgatggcttcggccgaca

SEQ ID NO: 11021 - DNA, 18 bp, Artificial sequence
  synthetic polynucleotide sequence
ccaagaccagcccgctga

SEQ ID NO: 11022 - DNA, 18 bp, Artificial sequence
  synthetic polynucleotide sequence
agggcagagcgaggacga

SEQ ID NO: 11023 - DNA, 18 bp, Artificial sequence
  synthetic polynucleotide sequence
caagcatgggctgcagga

SEQ ID NO: 11024 - DNA, 18 bp, Artificial sequence
  synthetic polynucleotide sequence
gcccaagcatgccaccaa

SEQ ID NO: 11025 - DNA, 18 bp, Artificial sequence
  synthetic polynucleotide sequence
ggctcatgccactggaca

SEQ ID NO: 11026 - DNA, 18 bp, Artificial sequence
  synthetic polynucleotide sequence
gcaacgcctacaccgaga

SEQ ID NO: 11027 - DNA, 18 bp, Artificial sequence
  synthetic polynucleotide sequence
cgtgtgtgcccacagaga

SEQ ID NO: 11028 - DNA, 18 bp, Artificial sequence
  synthetic polynucleotide sequence
cgtgtgtgcccacagaga

SEQ ID NO: 11029 - DNA, 18 bp, Artificial sequence
  synthetic polynucleotide sequence
cacgaaggtggtgagcca

SEQ ID NO: 11030 - DNA, 18 bp, Artificial sequence
  synthetic polynucleotide sequence
tacagcaggtctcgggca

SEQ ID NO: 11031 - DNA, 18 bp, Artificial sequence
  synthetic polynucleotide sequence
gactgtcgaagtccccca

SEQ ID NO: 11032 - DNA, 18 bp, Artificial sequence
  synthetic polynucleotide sequence
gctccacaaggatgggga

SEQ ID NO: 11033 - DNA, 18 bp, Artificial sequence
  synthetic polynucleotide sequence
ttcgtcaacggaggccaa

SEQ ID NO: 11034 - DNA, 18 bp, Artificial sequence
  synthetic polynucleotide sequence
tccagacagcgtccagca

SEQ ID NO: 11035 - DNA, 18 bp, Artificial sequence
  synthetic polynucleotide sequence
gtgctgccatggccacga

SEQ ID NO: 11036 - DNA, 18 bp, Artificial sequence
  synthetic polynucleotide sequence
attgacgcactgccagga

SEQ ID NO: 11037 - DNA, 18 bp, Artificial sequence
  synthetic polynucleotide sequence
cctcctgggaggcgagga

SEQ ID NO: 11038 - DNA, 18 bp, Artificial sequence
  synthetic polynucleotide sequence
gtcagggaagggatacca

SEQ ID NO: 11039 - DNA, 18 bp, Artificial sequence
  synthetic polynucleotide sequence
ccgcttaaggtcagagca

SEQ ID NO: 11040 - DNA, 18 bp, Artificial sequence
  synthetic polynucleotide sequence
gggtctcaaggtaccaga

SEQ ID NO: 11041 - DNA, 18 bp, Artificial sequence
  synthetic polynucleotide sequence
gtaccatcgccgtcacca

SEQ ID NO: 11042 - DNA, 18 bp, Artificial sequence
  synthetic polynucleotide sequence
ggctggtggaagccacga

SEQ ID NO: 11043 - DNA, 18 bp, Artificial sequence
  synthetic polynucleotide sequence
caggtgattgccgagcca

SEQ ID NO: 11044 - DNA, 18 bp, Artificial sequence
  synthetic polynucleotide sequence
aggccaagaagctggaca

SEQ ID NO: 11045 - DNA, 18 bp, Artificial sequence
  synthetic polynucleotide sequence
gcaaaacaggtggcagca

SEQ ID NO: 11046 - DNA, 18 bp, Artificial sequence
  synthetic polynucleotide sequence
gcaaaacaggtggcagca

SEQ ID NO: 11047 - DNA, 18 bp, Artificial sequence
  synthetic polynucleotide sequence
ccgtggatgacactgaca

SEQ ID NO: 11048 - DNA, 18 bp, Artificial sequence
  synthetic polynucleotide sequence
gttcaacacaggctggca

SEQ ID NO: 11049 - DNA, 18 bp, Artificial sequence
  synthetic polynucleotide sequence
actgctctgacaagggaa

SEQ ID NO: 11050 - DNA, 18 bp, Artificial sequence
  synthetic polynucleotide sequence
gcttcaggcagaaggcca

SEQ ID NO: 11051 - DNA, 18 bp, Artificial sequence
  synthetic polynucleotide sequence
cgagaagatgacaggcaa

SEQ ID NO: 11052 - DNA, 18 bp, Artificial sequence
  synthetic polynucleotide sequence
agtctggtccaccggcca

SEQ ID NO: 11053 - DNA, 18 bp, Artificial sequence
  synthetic polynucleotide sequence
gcctcgacagaagcagca

SEQ ID NO: 11054 - DNA, 18 bp, Artificial sequence
  synthetic polynucleotide sequence
caagcctgggagagacca

SEQ ID NO: 11055 - DNA, 18 bp, Artificial sequence
  synthetic polynucleotide sequence
cacacgaacccaaaggca

SEQ ID NO: 11056 - DNA, 18 bp, Artificial sequence
  synthetic polynucleotide sequence
tgagattcaagcccagca

SEQ ID NO: 11057 - DNA, 18 bp, Artificial sequence
  synthetic polynucleotide sequence
ttggggagcccatccaga

SEQ ID NO: 11058 - DNA, 18 bp, Artificial sequence
  synthetic polynucleotide sequence
ggtcaggaaccaggccaa

SEQ ID NO: 11059 - DNA, 18 bp, Artificial sequence
  synthetic polynucleotide sequence
gtgcagcacaatggggga

SEQ ID NO: 11060 - DNA, 18 bp, Artificial sequence
  synthetic polynucleotide sequence
actgcctggaccgaggaa

SEQ ID NO: 11061 - DNA, 18 bp, Artificial sequence
  synthetic polynucleotide sequence
gcaggtgaccacgcccca

SEQ ID NO: 11062 - DNA, 18 bp, Artificial sequence
  synthetic polynucleotide sequence
ccccaaggatggcaccga

SEQ ID NO: 11063 - DNA, 18 bp, Artificial sequence
  synthetic polynucleotide sequence
cccagagggcgttgacca

SEQ ID NO: 11064 - DNA, 18 bp, Artificial sequence
  synthetic polynucleotide sequence
cccagagggcgttgacca

SEQ ID NO: 11065 - DNA, 18 bp, Artificial sequence
  synthetic polynucleotide sequence
aggtacggcaaagagcaa

SEQ ID NO: 11066 - DNA, 18 bp, Artificial sequence
  synthetic polynucleotide sequence
atccatgcatccagggca

SEQ ID NO: 11067 - DNA, 18 bp, Artificial sequence
  synthetic polynucleotide sequence
gccggtgcagtacacaca

SEQ ID NO: 11068 - DNA, 18 bp, Artificial sequence
  synthetic polynucleotide sequence
gctgcttgcacaaggaca

SEQ ID NO: 11069 - DNA, 18 bp, Artificial sequence
  synthetic polynucleotide sequence
agcaagagcagggccaca

SEQ ID NO: 11070 - DNA, 18 bp, Artificial sequence
  synthetic polynucleotide sequence
acaaggtggacaatcgca

SEQ ID NO: 11071 - DNA, 18 bp, Artificial sequence
  synthetic polynucleotide sequence
gcagacaggcatgtgtga

SEQ ID NO: 11072 - DNA, 18 bp, Artificial sequence
  synthetic polynucleotide sequence
atagatccagggatgcca

SEQ ID NO: 11073 - DNA, 18 bp, Artificial sequence
  synthetic polynucleotide sequence
tggaggagatggtagaga

SEQ ID NO: 11074 - DNA, 18 bp, Artificial sequence
  synthetic polynucleotide sequence
gctcctccagcaggccca

SEQ ID NO: 11075 - DNA, 18 bp, Artificial sequence
  synthetic polynucleotide sequence
gctgacagtgagtgcaga

SEQ ID NO: 11076 - DNA, 18 bp, Artificial sequence
  synthetic polynucleotide sequence
ttcccaggaagaagcaca

SEQ ID NO: 11077 - DNA, 18 bp, Artificial sequence
  synthetic polynucleotide sequence
gaggctcttgcagaggca

SEQ ID NO: 11078 - DNA, 18 bp, Artificial sequence
  synthetic polynucleotide sequence
tatgcagccgctgccaga

SEQ ID NO: 11079 - DNA, 18 bp, Artificial sequence
  synthetic polynucleotide sequence
gcggccatcgttcagaca

SEQ ID NO: 11080 - DNA, 18 bp, Artificial sequence
  synthetic polynucleotide sequence
ccatccagccgctgcaca

SEQ ID NO: 11081 - DNA, 18 bp, Artificial sequence
  synthetic polynucleotide sequence
cggatcttcagcaaggca

SEQ ID NO: 11082 - DNA, 18 bp, Artificial sequence
  synthetic polynucleotide sequence
cggatcttcagcaaggca

SEQ ID NO: 11083 - DNA, 18 bp, Artificial sequence
  synthetic polynucleotide sequence
cgccttcagcatgaacca

SEQ ID NO: 11084 - DNA, 18 bp, Artificial sequence
  synthetic polynucleotide sequence
gtgaggctgagatgggca

SEQ ID NO: 11085 - DNA, 18 bp, Artificial sequence
  synthetic polynucleotide sequence
tccaacaggccctggaca

SEQ ID NO: 11086 - DNA, 18 bp, Artificial sequence
  synthetic polynucleotide sequence
agctgccagcatggcaca

SEQ ID NO: 11087 - DNA, 18 bp, Artificial sequence
  synthetic polynucleotide sequence
caaagcctgcaaccccca

SEQ ID NO: 11088 - DNA, 18 bp, Artificial sequence
  synthetic polynucleotide sequence
catgggagcgctgacgca

SEQ ID NO: 11089 - DNA, 18 bp, Artificial sequence
  synthetic polynucleotide sequence
gaagggacggactgcaga

SEQ ID NO: 11090 - DNA, 18 bp, Artificial sequence
  synthetic polynucleotide sequence
tccaggggctccatgaga

SEQ ID NO: 11091 - DNA, 18 bp, Artificial sequence
  synthetic polynucleotide sequence
gcctgcacagtgagagca

SEQ ID NO: 11092 - DNA, 18 bp, Artificial sequence
  synthetic polynucleotide sequence
ggaagggcttctcaggca

SEQ ID NO: 11093 - DNA, 18 bp, Artificial sequence
  synthetic polynucleotide sequence
acaccagaggccagggca

SEQ ID NO: 11094 - DNA, 18 bp, Artificial sequence
  synthetic polynucleotide sequence
gaaaggccaacaccgcca

SEQ ID NO: 11095 - DNA, 18 bp, Artificial sequence
  synthetic polynucleotide sequence
ctctcgcacgaggaagga

SEQ ID NO: 11096 - DNA, 18 bp, Artificial sequence
  synthetic polynucleotide sequence
tgaggaggagcccaagga

SEQ ID NO: 11097 - DNA, 18 bp, Artificial sequence
  synthetic polynucleotide sequence
gatgagggcaccacggca

SEQ ID NO: 11098 - DNA, 18 bp, Artificial sequence
  synthetic polynucleotide sequence
ccctctacgacgtcagca

SEQ ID NO: 11099 - DNA, 18 bp, Artificial sequence
  synthetic polynucleotide sequence
tccacgcagcggcagcca

SEQ ID NO: 11100 - DNA, 18 bp, Artificial sequence
  synthetic polynucleotide sequence
tccacgcagcggcagcca

SEQ ID NO: 11101 - DNA, 18 bp, Artificial sequence
  synthetic polynucleotide sequence
gaggaggaaaggcacaga

SEQ ID NO: 11102 - DNA, 18 bp, Artificial sequence
  synthetic polynucleotide sequence
gactggcaattggaggga

SEQ ID NO: 11103 - DNA, 19 bp, Artificial sequence
  synthetic polynucleotide sequence
gatgacccaagtgaggaca

SEQ ID NO: 11104 - DNA, 18 bp, Artificial sequence
  synthetic polynucleotide sequence
cattgggaaggcaccgga

SEQ ID NO: 11105 - DNA, 18 bp, Artificial sequence
  synthetic polynucleotide sequence
ggctgagagcaacgccaa

SEQ ID NO: 11106 - DNA, 18 bp, Artificial sequence
  synthetic polynucleotide sequence
tgagggggaagtggacca

SEQ ID NO: 11107 - DNA, 18 bp, Artificial sequence
  synthetic polynucleotide sequence
tcaccgagttcgccgaca

SEQ ID NO: 11108 - DNA, 18 bp, Artificial sequence
  synthetic polynucleotide sequence
tgtccaggatgccagcca

SEQ ID NO: 11109 - DNA, 18 bp, Artificial sequence
  synthetic polynucleotide sequence
agaccctgcctacctgca

SEQ ID NO: 11110 - DNA, 18 bp, Artificial sequence
  synthetic polynucleotide sequence
tccactgaagtcaccaca

SEQ ID NO: 11111 - DNA, 18 bp, Artificial sequence
  synthetic polynucleotide sequence
aggaactgctcggccaga

SEQ ID NO: 11112 - DNA, 18 bp, Artificial sequence
  synthetic polynucleotide sequence
ccaacagcttcacggcca

SEQ ID NO: 11113 - DNA, 18 bp, Artificial sequence
  synthetic polynucleotide sequence
ctgaccggaaggctcgca

SEQ ID NO: 11114 - DNA, 18 bp, Artificial sequence
  synthetic polynucleotide sequence
cttgccaaggtcaagcca

SEQ ID NO: 11115 - DNA, 18 bp, Artificial sequence
  synthetic polynucleotide sequence
tggctgatcccagggcca

SEQ ID NO: 11116 - DNA, 18 bp, Artificial sequence
  synthetic polynucleotide sequence
ggaaaggttgcaaaggga

SEQ ID NO: 11117 - DNA, 18 bp, Artificial sequence
  synthetic polynucleotide sequence
gcagctggaacatgggca

SEQ ID NO: 11118 - DNA, 18 bp, Artificial sequence
  synthetic polynucleotide sequence
gcagctggaacatgggca

SEQ ID NO: 11119 - DNA, 18 bp, Artificial sequence
  synthetic polynucleotide sequence
ggcacaggaggacagcaa

SEQ ID NO: 11120 - DNA, 18 bp, Artificial sequence
  synthetic polynucleotide sequence
gagctgacagctgaggga

SEQ ID NO: 11121 - DNA, 18 bp, Artificial sequence
  synthetic polynucleotide sequence
gctcagcagccatggcaa

SEQ ID NO: 11122 - DNA, 18 bp, Artificial sequence
  synthetic polynucleotide sequence
agcgcgtacttggccaca

SEQ ID NO: 11123 - DNA, 18 bp, Artificial sequence
  synthetic polynucleotide sequence
gcaggaggaggaagagga

SEQ ID NO: 11124 - DNA, 18 bp, Artificial sequence
  synthetic polynucleotide sequence
tccccaggctctaccaca

SEQ ID NO: 11125 - DNA, 18 bp, Artificial sequence
  synthetic polynucleotide sequence
catcctgggtgcacacca

SEQ ID NO: 11126 - DNA, 18 bp, Artificial sequence
  synthetic polynucleotide sequence
tcagtgatgacggcagga

SEQ ID NO: 11127 - DNA, 18 bp, Artificial sequence
  synthetic polynucleotide sequence
cagacagacacggaggga

SEQ ID NO: 11128 - DNA, 18 bp, Artificial sequence
  synthetic polynucleotide sequence
gtgccacaccacccagga

SEQ ID NO: 11129 - DNA, 18 bp, Artificial sequence
  synthetic polynucleotide sequence
cgcctgccatcaccccca

SEQ ID NO: 11130 - DNA, 18 bp, Artificial sequence
  synthetic polynucleotide sequence
ctcagcagctccagacca

SEQ ID NO: 11131 - DNA, 18 bp, Artificial sequence
  synthetic polynucleotide sequence
cccacgagccacgtgaca

SEQ ID NO: 11132 - DNA, 18 bp, Artificial sequence
  synthetic polynucleotide sequence
ccgccgccaggtggagga

SEQ ID NO: 11133 - DNA, 18 bp, Artificial sequence
  synthetic polynucleotide sequence
cattgaagagcaccccca

SEQ ID NO: 11134 - DNA, 18 bp, Artificial sequence
  synthetic polynucleotide sequence
gcaagaggaggctgagga

SEQ ID NO: 11135 - DNA, 18 bp, Artificial sequence
  synthetic polynucleotide sequence
aggaggctcatgtgagca

SEQ ID NO: 11136 - DNA, 18 bp, Artificial sequence
  synthetic polynucleotide sequence
aggaggctcatgtgagca

SEQ ID NO: 11137 - DNA, 18 bp, Artificial sequence
  synthetic polynucleotide sequence
gcagtgggtcaagacgga

SEQ ID NO: 11138 - DNA, 18 bp, Artificial sequence
  synthetic polynucleotide sequence
ctgccgcaggtctggaga

SEQ ID NO: 11139 - DNA, 18 bp, Artificial sequence
  synthetic polynucleotide sequence
ctccaacacaggcaccaa

SEQ ID NO: 11140 - DNA, 18 bp, Artificial sequence
  synthetic polynucleotide sequence
aagacactcctgcctgca

SEQ ID NO: 11141 - DNA, 18 bp, Artificial sequence
  synthetic polynucleotide sequence
tgcggacaccccgtacca

SEQ ID NO: 11142 - DNA, 18 bp, Artificial sequence
  synthetic polynucleotide sequence
caggtcaactgccgcaga

SEQ ID NO: 11143 - DNA, 19 bp, Artificial sequence
  synthetic polynucleotide sequence
gcctcaacaagcacgtcaa

SEQ ID NO: 11144 - DNA, 20 bp, Artificial sequence
  synthetic polynucleotide sequence
agcagaacttcagagaagca

SEQ ID NO: 11145 - DNA, 18 bp, Artificial sequence
  synthetic polynucleotide sequence
ctactacaccagggccca

SEQ ID NO: 11146 - DNA, 18 bp, Artificial sequence
  synthetic polynucleotide sequence
gtagcgcaggaaccgaca

SEQ ID NO: 11147 - DNA, 18 bp, Artificial sequence
  synthetic polynucleotide sequence
gactcaatgctccccaga

SEQ ID NO: 11148 - DNA, 18 bp, Artificial sequence
  synthetic polynucleotide sequence
agtcaagcggaagccaga

SEQ ID NO: 11149 - DNA, 18 bp, Artificial sequence
  synthetic polynucleotide sequence
gtggtgtggccgcagaga

SEQ ID NO: 11150 - DNA, 18 bp, Artificial sequence
  synthetic polynucleotide sequence
atgtgcccaccgtggaca

SEQ ID NO: 11151 - DNA, 18 bp, Artificial sequence
  synthetic polynucleotide sequence
gacagaaggttggagcca

SEQ ID NO: 11152 - DNA, 18 bp, Artificial sequence
  synthetic polynucleotide sequence
cacctggaccacctgcca

SEQ ID NO: 11153 - DNA, 18 bp, Artificial sequence
  synthetic polynucleotide sequence
ccactgacaacatcagca

SEQ ID NO: 11154 - DNA, 18 bp, Artificial sequence
  synthetic polynucleotide sequence
ccactgacaacatcagca

SEQ ID NO: 11155 - DNA, 18 bp, Artificial sequence
  synthetic polynucleotide sequence
agctacccacccccacca

SEQ ID NO: 11156 - DNA, 18 bp, Artificial sequence
  synthetic polynucleotide sequence
ggtacccctgcagctcca

SEQ ID NO: 11157 - DNA, 18 bp, Artificial sequence
  synthetic polynucleotide sequence
tgccagacaagagctgga

SEQ ID NO: 11158 - DNA, 18 bp, Artificial sequence
  synthetic polynucleotide sequence
gaatctgaaccacagcca

SEQ ID NO: 11159 - DNA, 18 bp, Artificial sequence
  synthetic polynucleotide sequence
aggtccagctgtccagca

SEQ ID NO: 11160 - DNA, 18 bp, Artificial sequence
  synthetic polynucleotide sequence
tgggatcagagccagcga

SEQ ID NO: 11161 - DNA, 18 bp, Artificial sequence
  synthetic polynucleotide sequence
ccagcaaggtcaccagca

SEQ ID NO: 11162 - DNA, 18 bp, Artificial sequence
  synthetic polynucleotide sequence
gcctcctgtgcacagcca

SEQ ID NO: 11163 - DNA, 18 bp, Artificial sequence
  synthetic polynucleotide sequence
tgacggtcacaggcacca

SEQ ID NO: 11164 - DNA, 18 bp, Artificial sequence
  synthetic polynucleotide sequence
cacagggttggccacaga

SEQ ID NO: 11165 - DNA, 18 bp, Artificial sequence
  synthetic polynucleotide sequence
tgtccacctgcaccgaca

SEQ ID NO: 11166 - DNA, 18 bp, Artificial sequence
  synthetic polynucleotide sequence
gagggacccaagtgacca

SEQ ID NO: 11167 - DNA, 18 bp, Artificial sequence
  synthetic polynucleotide sequence
agtcagtggctccaccga

SEQ ID NO: 11168 - DNA, 18 bp, Artificial sequence
  synthetic polynucleotide sequence
ccaaactgccatgcccca

SEQ ID NO: 11169 - DNA, 18 bp, Artificial sequence
  synthetic polynucleotide sequence
cagggcctcatacacgca

SEQ ID NO: 11170 - DNA, 18 bp, Artificial sequence
  synthetic polynucleotide sequence
cccacgatgccaacgaga

SEQ ID NO: 11171 - DNA, 18 bp, Artificial sequence
  synthetic polynucleotide sequence
agccacctgactcaggga

SEQ ID NO: 11172 - DNA, 18 bp, Artificial sequence
  synthetic polynucleotide sequence
agccacctgactcaggga

SEQ ID NO: 11173 - DNA, 18 bp, Artificial sequence
  synthetic polynucleotide sequence
atcaggaccaccacggca

SEQ ID NO: 11174 - DNA, 18 bp, Artificial sequence
  synthetic polynucleotide sequence
cagaagggctgacgggga

SEQ ID NO: 11175 - DNA, 18 bp, Artificial sequence
  synthetic polynucleotide sequence
ggacacccgatcccagca

SEQ ID NO: 11176 - DNA, 21 bp, Artificial sequence
  synthetic polynucleotide sequence
gagtagcacactcgacttcca

SEQ ID NO: 11177 - DNA, 18 bp, Artificial sequence
  synthetic polynucleotide sequence
ttcccagctgagaatgga

SEQ ID NO: 11178 - DNA, 18 bp, Artificial sequence
  synthetic polynucleotide sequence
gccaacaaggtcggtaga

SEQ ID NO: 11179 - DNA, 18 bp, Artificial sequence
  synthetic polynucleotide sequence
gggtaccacactggcaga

SEQ ID NO: 11180 - DNA, 18 bp, Artificial sequence
  synthetic polynucleotide sequence
gaccttcaggctcaggga

SEQ ID NO: 11181 - DNA, 18 bp, Artificial sequence
  synthetic polynucleotide sequence
gctggaactgaaccggga

SEQ ID NO: 11182 - DNA, 18 bp, Artificial sequence
  synthetic polynucleotide sequence
ccagcctggcactatcca

SEQ ID NO: 11183 - DNA, 18 bp, Artificial sequence
  synthetic polynucleotide sequence
ggtagacatgctgggcca

SEQ ID NO: 11184 - DNA, 18 bp, Artificial sequence
  synthetic polynucleotide sequence
gggaattccaggaggcca

SEQ ID NO: 11185 - DNA, 18 bp, Artificial sequence
  synthetic polynucleotide sequence
tgtcccagccctcgggga

SEQ ID NO: 11186 - DNA, 18 bp, Artificial sequence
  synthetic polynucleotide sequence
cctggaggagaggatcga

SEQ ID NO: 11187 - DNA, 18 bp, Artificial sequence
  synthetic polynucleotide sequence
agtccgatccgcctacca

SEQ ID NO: 11188 - DNA, 18 bp, Artificial sequence
  synthetic polynucleotide sequence
acgtggatgggaccctca

SEQ ID NO: 11189 - DNA, 18 bp, Artificial sequence
  synthetic polynucleotide sequence
accgtgtagatggccgca

SEQ ID NO: 11190 - DNA, 18 bp, Artificial sequence
  synthetic polynucleotide sequence
accgtgtagatggccgca

SEQ ID NO: 11191 - DNA, 18 bp, Artificial sequence
  synthetic polynucleotide sequence
ggagctggaacgagccaa

SEQ ID NO: 11192 - DNA, 18 bp, Artificial sequence
  synthetic polynucleotide sequence
tggagcgagtggccagca

SEQ ID NO: 11193 - DNA, 18 bp, Artificial sequence
  synthetic polynucleotide sequence
cctgcggcaacagttcga

SEQ ID NO: 11194 - DNA, 18 bp, Artificial sequence
  synthetic polynucleotide sequence
acgcttgtggcaccagca

SEQ ID NO: 11195 - DNA, 18 bp, Artificial sequence
  synthetic polynucleotide sequence
gaccttcggaccccagga

SEQ ID NO: 11196 - DNA, 18 bp, Artificial sequence
  synthetic polynucleotide sequence
catcaccgacttccggca

SEQ ID NO: 11197 - DNA, 18 bp, Artificial sequence
  synthetic polynucleotide sequence
gggagaggagaaacgcca

SEQ ID NO: 11198 - DNA, 18 bp, Artificial sequence
  synthetic polynucleotide sequence
accactggatgtcagaca

SEQ ID NO: 11199 - DNA, 18 bp, Artificial sequence
  synthetic polynucleotide sequence
tacacctggccacacaca

SEQ ID NO: 11200 - DNA, 18 bp, Artificial sequence
  synthetic polynucleotide sequence
actcatgaccaggccaca

SEQ ID NO: 11201 - DNA, 18 bp, Artificial sequence
  synthetic polynucleotide sequence
gcagcctccacttggaca

SEQ ID NO: 11202 - DNA, 18 bp, Artificial sequence
  synthetic polynucleotide sequence
ctgggaagggactcgaga

SEQ ID NO: 11203 - DNA, 18 bp, Artificial sequence
  synthetic polynucleotide sequence
gtgcagggatatgcagca

SEQ ID NO: 11204 - DNA, 18 bp, Artificial sequence
  synthetic polynucleotide sequence
tccccaatggaggagaga

SEQ ID NO: 11205 - DNA, 18 bp, Artificial sequence
  synthetic polynucleotide sequence
acccagcttccccagcca

SEQ ID NO: 11206 - DNA, 18 bp, Artificial sequence
  synthetic polynucleotide sequence
atcaacggttcacgggaa

SEQ ID NO: 11207 - DNA, 18 bp, Artificial sequence
  synthetic polynucleotide sequence
gagctctcaacgctccca

SEQ ID NO: 11208 - DNA, 18 bp, Artificial sequence
  synthetic polynucleotide sequence
gagctctcaacgctccca

SEQ ID NO: 11209 - DNA, 18 bp, Artificial sequence
  synthetic polynucleotide sequence
ggaggctgtgagcccaga

SEQ ID NO: 11210 - DNA, 18 bp, Artificial sequence
  synthetic polynucleotide sequence
cctcagacactggcacca

SEQ ID NO: 11211 - DNA, 18 bp, Artificial sequence
  synthetic polynucleotide sequence
aggcccatccaagccaga

SEQ ID NO: 11212 - DNA, 18 bp, Artificial sequence
  synthetic polynucleotide sequence
ctgagaatccacgcctca

SEQ ID NO: 11213 - DNA, 18 bp, Artificial sequence
  synthetic polynucleotide sequence
gagaatgtgacacggaca

SEQ ID NO: 11214 - DNA, 18 bp, Artificial sequence
  synthetic polynucleotide sequence
ctgctagccacagctcga

SEQ ID NO: 11215 - DNA, 18 bp, Artificial sequence
  synthetic polynucleotide sequence
cgagcctggcatggagga

SEQ ID NO: 11216 - DNA, 18 bp, Artificial sequence
  synthetic polynucleotide sequence
ccccggtgaagcccccaa

SEQ ID NO: 11217 - DNA, 18 bp, Artificial sequence
  synthetic polynucleotide sequence
gtgagctacaggaaggca

SEQ ID NO: 11218 - DNA, 18 bp, Artificial sequence
  synthetic polynucleotide sequence
cccagcttctgcagcaca

SEQ ID NO: 11219 - DNA, 18 bp, Artificial sequence
  synthetic polynucleotide sequence
gaggcctccgtccaccca

SEQ ID NO: 11220 - DNA, 18 bp, Artificial sequence
  synthetic polynucleotide sequence
caacgccaaaaccagaga

SEQ ID NO: 11221 - DNA, 18 bp, Artificial sequence
  synthetic polynucleotide sequence
ggggcatgtaaccggaca

SEQ ID NO: 11222 - DNA, 18 bp, Artificial sequence
  synthetic polynucleotide sequence
ggaccagcagatcgagga

SEQ ID NO: 11223 - DNA, 18 bp, Artificial sequence
  synthetic polynucleotide sequence
aagtagcctggagcagca

SEQ ID NO: 11224 - DNA, 18 bp, Artificial sequence
  synthetic polynucleotide sequence
acagcaagaaaccccaca

SEQ ID NO: 11225 - DNA, 18 bp, Artificial sequence
  synthetic polynucleotide sequence
gaagcagtaccgcagtca

SEQ ID NO: 11226 - DNA, 18 bp, Artificial sequence
  synthetic polynucleotide sequence
gaagcagtaccgcagtca

SEQ ID NO: 11227 - DNA, 18 bp, Artificial sequence
  synthetic polynucleotide sequence
ccctcccgatggtgacca

SEQ ID NO: 11228 - DNA, 18 bp, Artificial sequence
  synthetic polynucleotide sequence
gaggagtgcctcccgcca

SEQ ID NO: 11229 - DNA, 18 bp, Artificial sequence
  synthetic polynucleotide sequence
tcggaggagccagcgcga

SEQ ID NO: 11230 - DNA, 18 bp, Artificial sequence
  synthetic polynucleotide sequence
gctgcagatcctgcacca

SEQ ID NO: 11231 - DNA, 18 bp, Artificial sequence
  synthetic polynucleotide sequence
ggtgctgccccacaacca

SEQ ID NO: 11232 - DNA, 18 bp, Artificial sequence
  synthetic polynucleotide sequence
ccaggcggttataggcca

SEQ ID NO: 11233 - DNA, 18 bp, Artificial sequence
  synthetic polynucleotide sequence
gccgagcagtcaaagcca

SEQ ID NO: 11234 - DNA, 18 bp, Artificial sequence
  synthetic polynucleotide sequence
acacatccttggcaggga

SEQ ID NO: 11235 - DNA, 18 bp, Artificial sequence
  synthetic polynucleotide sequence
gccagcaaatccaagcca

SEQ ID NO: 11236 - DNA, 18 bp, Artificial sequence
  synthetic polynucleotide sequence
tacggctcagatcagcaa

SEQ ID NO: 11237 - DNA, 18 bp, Artificial sequence
  synthetic polynucleotide sequence
cttcaggtcaggcaggca

SEQ ID NO: 11238 - DNA, 18 bp, Artificial sequence
  synthetic polynucleotide sequence
ccatgctgaaggacggga

SEQ ID NO: 11239 - DNA, 18 bp, Artificial sequence
  synthetic polynucleotide sequence
acctggcgtgtgcgcaga

SEQ ID NO: 11240 - DNA, 18 bp, Artificial sequence
  synthetic polynucleotide sequence
tgaacccacgtgggagga

SEQ ID NO: 11241 - DNA, 18 bp, Artificial sequence
  synthetic polynucleotide sequence
caagtgagccacacagga

SEQ ID NO: 11242 - DNA, 18 bp, Artificial sequence
  synthetic polynucleotide sequence
ccaaaaaccaggcctgga

SEQ ID NO: 11243 - DNA, 18 bp, Artificial sequence
  synthetic polynucleotide sequence
cagctgggtgtacaggga

SEQ ID NO: 11244 - DNA, 18 bp, Artificial sequence
  synthetic polynucleotide sequence
cagctgggtgtacaggga

SEQ ID NO: 11245 - DNA, 18 bp, Artificial sequence
  synthetic polynucleotide sequence
caaccatgaccggccaga

SEQ ID NO: 11246 - DNA, 18 bp, Artificial sequence
  synthetic polynucleotide sequence
acaggctcatggtgcaca

SEQ ID NO: 11247 - DNA, 20 bp, Artificial sequence
  synthetic polynucleotide sequence
cagaatcaaccaaacagcca

SEQ ID NO: 11248 - DNA, 18 bp, Artificial sequence
  synthetic polynucleotide sequence
gaagctggcaaacaccca

SEQ ID NO: 11249 - DNA, 18 bp, Artificial sequence
  synthetic polynucleotide sequence
gctggccaaggagacaga

SEQ ID NO: 11250 - DNA, 18 bp, Artificial sequence
  synthetic polynucleotide sequence
agatctccaggcacggca

SEQ ID NO: 11251 - DNA, 18 bp, Artificial sequence
  synthetic polynucleotide sequence
cttcccagagtgcccgca

SEQ ID NO: 11252 - DNA, 18 bp, Artificial sequence
  synthetic polynucleotide sequence
gcactgaagtcagggaca

SEQ ID NO: 11253 - DNA, 18 bp, Artificial sequence
  synthetic polynucleotide sequence
gctgagtcaccatcccca

SEQ ID NO: 11254 - DNA, 18 bp, Artificial sequence
  synthetic polynucleotide sequence
gaaggaggttcaggctca

SEQ ID NO: 11255 - DNA, 18 bp, Artificial sequence
  synthetic polynucleotide sequence
tgccacacctctggggga

SEQ ID NO: 11256 - DNA, 18 bp, Artificial sequence
  synthetic polynucleotide sequence
cgggatcacacggctgca

SEQ ID NO: 11257 - DNA, 18 bp, Artificial sequence
  synthetic polynucleotide sequence
tgcgcacagtgtccagca

SEQ ID NO: 11258 - DNA, 18 bp, Artificial sequence
  synthetic polynucleotide sequence
gctacctggaaccaggga

SEQ ID NO: 11259 - DNA, 18 bp, Artificial sequence
  synthetic polynucleotide sequence
gagagcacatcactggca

SEQ ID NO: 11260 - DNA, 18 bp, Artificial sequence
  synthetic polynucleotide sequence
atgccgtgatcaccagga

SEQ ID NO: 11261 - DNA, 18 bp, Artificial sequence
  synthetic polynucleotide sequence
aggccttcactcgcgcca

SEQ ID NO: 11262 - DNA, 18 bp, Artificial sequence
  synthetic polynucleotide sequence
aggccttcactcgcgcca

SEQ ID NO: 11263 - DNA, 18 bp, Artificial sequence
  synthetic polynucleotide sequence
gcagcagcttagccggga

SEQ ID NO: 11264 - DNA, 18 bp, Artificial sequence
  synthetic polynucleotide sequence
cctgctccctgaacacca

SEQ ID NO: 11265 - DNA, 18 bp, Artificial sequence
  synthetic polynucleotide sequence
cccacaacagccaaagca

SEQ ID NO: 11266 - DNA, 18 bp, Artificial sequence
  synthetic polynucleotide sequence
cacacttctcacagggca

SEQ ID NO: 11267 - DNA, 18 bp, Artificial sequence
  synthetic polynucleotide sequence
atgagcgttgagaggaca

SEQ ID NO: 11268 - DNA, 18 bp, Artificial sequence
  synthetic polynucleotide sequence
agatcctgagcaagctca

SEQ ID NO: 11269 - DNA, 18 bp, Artificial sequence
  synthetic polynucleotide sequence
gagccctggccaaaacca

SEQ ID NO: 11270 - DNA, 18 bp, Artificial sequence
  synthetic polynucleotide sequence
cagtgggagtgggcagca

SEQ ID NO: 11271 - DNA, 18 bp, Artificial sequence
  synthetic polynucleotide sequence
tctgggcgatacagagca

SEQ ID NO: 11272 - DNA, 18 bp, Artificial sequence
  synthetic polynucleotide sequence
agcagtactgagagggca

SEQ ID NO: 11273 - DNA, 17 bp, Artificial sequence
  synthetic polynucleotide sequence
gacgaccttcccgacca

SEQ ID NO: 11274 - DNA, 18 bp, Artificial sequence
  synthetic polynucleotide sequence
ccgctacagcagatgaca

SEQ ID NO: 11275 - DNA, 19 bp, Artificial sequence
  synthetic polynucleotide sequence
cacacacatgggctaccga

SEQ ID NO: 11276 - DNA, 19 bp, Artificial sequence
  synthetic polynucleotide sequence
gagacagagtcaccaacca

SEQ ID NO: 11277 - DNA, 18 bp, Artificial sequence
  synthetic polynucleotide sequence
gccaatgcccttgacaca

SEQ ID NO: 11278 - DNA, 18 bp, Artificial sequence
  synthetic polynucleotide sequence
gatccccctggggaacca

SEQ ID NO: 11279 - DNA, 18 bp, Artificial sequence
  synthetic polynucleotide sequence
cggaacctcgagcgcgga

SEQ ID NO: 11280 - DNA, 18 bp, Artificial sequence
  synthetic polynucleotide sequence
cggaacctcgagcgcgga

SEQ ID NO: 11281 - DNA, 18 bp, Artificial sequence
  synthetic polynucleotide sequence
gcatggagatccccacca

SEQ ID NO: 11282 - DNA, 18 bp, Artificial sequence
  synthetic polynucleotide sequence
ctggcatctgacgcagca

SEQ ID NO: 11283 - DNA, 18 bp, Artificial sequence
  synthetic polynucleotide sequence
atgccagggcatgaggca

SEQ ID NO: 11284 - DNA, 18 bp, Artificial sequence
  synthetic polynucleotide sequence
gatacacgaacccctgga

SEQ ID NO: 11285 - DNA, 18 bp, Artificial sequence
  synthetic polynucleotide sequence
ctcggagctggatgagga

SEQ ID NO: 11286 - DNA, 18 bp, Artificial sequence
  synthetic polynucleotide sequence
gagagccacaggactcca

SEQ ID NO: 11287 - DNA, 18 bp, Artificial sequence
  synthetic polynucleotide sequence
tgcagaggacgaacagga

SEQ ID NO: 11288 - DNA, 18 bp, Artificial sequence
  synthetic polynucleotide sequence
aagctacgaacactggca

SEQ ID NO: 11289 - DNA, 18 bp, Artificial sequence
  synthetic polynucleotide sequence
gacaccctccgccaagca

SEQ ID NO: 11290 - DNA, 18 bp, Artificial sequence
  synthetic polynucleotide sequence
tgacgacgtgctcaggga

SEQ ID NO: 11291 - DNA, 18 bp, Artificial sequence
  synthetic polynucleotide sequence
acaggggcacacatcgca

SEQ ID NO: 11292 - DNA, 18 bp, Artificial sequence
  synthetic polynucleotide sequence
cagaagcgaatcaccaca

SEQ ID NO: 11293 - DNA, 18 bp, Artificial sequence
  synthetic polynucleotide sequence
acctgagtgacaacagca

SEQ ID NO: 11294 - DNA, 18 bp, Artificial sequence
  synthetic polynucleotide sequence
gtgatccagccaggccga

SEQ ID NO: 11295 - DNA, 18 bp, Artificial sequence
  synthetic polynucleotide sequence
gagtccacctcgaatcca

SEQ ID NO: 11296 - DNA, 18 bp, Artificial sequence
  synthetic polynucleotide sequence
gccttccagggctgacca

SEQ ID NO: 11297 - DNA, 18 bp, Artificial sequence
  synthetic polynucleotide sequence
ggtccagcggtggccgca

SEQ ID NO: 11298 - DNA, 18 bp, Artificial sequence
  synthetic polynucleotide sequence
ggtccagcggtggccgca

SEQ ID NO: 11299 - DNA, 18 bp, Artificial sequence
  synthetic polynucleotide sequence
gactacagcccccaggaa

SEQ ID NO: 11300 - DNA, 18 bp, Artificial sequence
  synthetic polynucleotide sequence
gcgctcctccagcaggga

SEQ ID NO: 11301 - DNA, 18 bp, Artificial sequence
  synthetic polynucleotide sequence
cctccaaagcagcaacca

SEQ ID NO: 11302 - DNA, 18 bp, Artificial sequence
  synthetic polynucleotide sequence
cccagcattcatcgagca

SEQ ID NO: 11303 - DNA, 18 bp, Artificial sequence
  synthetic polynucleotide sequence
gcattggtgagccaggca

SEQ ID NO: 11304 - DNA, 18 bp, Artificial sequence
  synthetic polynucleotide sequence
cctttcacgaggcgagca

SEQ ID NO: 11305 - DNA, 18 bp, Artificial sequence
  synthetic polynucleotide sequence
accatgccccatccagga

SEQ ID NO: 11306 - DNA, 18 bp, Artificial sequence
  synthetic polynucleotide sequence
ctgcaccagtagcctgca

SEQ ID NO: 11307 - DNA, 19 bp, Artificial sequence
  synthetic polynucleotide sequence
cttcgagacttagggagca

SEQ ID NO: 11308 - DNA, 20 bp, Artificial sequence
  synthetic polynucleotide sequence
gctaaatccaacagcctcaa

SEQ ID NO: 11309 - DNA, 18 bp, Artificial sequence
  synthetic polynucleotide sequence
ccgccaatcagggttcca

SEQ ID NO: 11310 - DNA, 18 bp, Artificial sequence
  synthetic polynucleotide sequence
catgaggcagctccccta

SEQ ID NO: 11311 - DNA, 18 bp, Artificial sequence
  synthetic polynucleotide sequence
gcaggggtgttcagacca

SEQ ID NO: 11312 - DNA, 18 bp, Artificial sequence
  synthetic polynucleotide sequence
agagtgggagcacagcca

SEQ ID NO: 11313 - DNA, 18 bp, Artificial sequence
  synthetic polynucleotide sequence
ggggaaggcctcggccga

SEQ ID NO: 11314 - DNA, 18 bp, Artificial sequence
  synthetic polynucleotide sequence
agggcagaagcgcgagga

SEQ ID NO: 11315 - DNA, 18 bp, Artificial sequence
  synthetic polynucleotide sequence
agaggaggtagagggcga

SEQ ID NO: 11316 - DNA, 18 bp, Artificial sequence
  synthetic polynucleotide sequence
agaggaggtagagggcga

SEQ ID NO: 11317 - DNA, 18 bp, Artificial sequence
  synthetic polynucleotide sequence
agctgagcaggacccaga

SEQ ID NO: 11318 - DNA, 18 bp, Artificial sequence
  synthetic polynucleotide sequence
tggaccactggctcacga

SEQ ID NO: 11319 - DNA, 18 bp, Artificial sequence
  synthetic polynucleotide sequence
gaaccatccagatgccaa

SEQ ID NO: 11320 - DNA, 18 bp, Artificial sequence
  synthetic polynucleotide sequence
aagtgctcaggtcccaca

SEQ ID NO: 11321 - DNA, 18 bp, Artificial sequence
  synthetic polynucleotide sequence
atccacatggcatcagca

SEQ ID NO: 11322 - DNA, 18 bp, Artificial sequence
  synthetic polynucleotide sequence
ccggtccaacagctgtga

SEQ ID NO: 11323 - DNA, 18 bp, Artificial sequence
  synthetic polynucleotide sequence
ccttcctgaagcgcagca

SEQ ID NO: 11324 - DNA, 18 bp, Artificial sequence
  synthetic polynucleotide sequence
ggcgggtgaagtactcca

SEQ ID NO: 11325 - DNA, 18 bp, Artificial sequence
  synthetic polynucleotide sequence
agaacgcgtgctctgaga

SEQ ID NO: 11326 - DNA, 18 bp, Artificial sequence
  synthetic polynucleotide sequence
attggcagccacctgcaa

SEQ ID NO: 11327 - DNA, 18 bp, Artificial sequence
  synthetic polynucleotide sequence
tccgtgcatccccacaga

SEQ ID NO: 11328 - DNA, 18 bp, Artificial sequence
  synthetic polynucleotide sequence
agctggcgcagttccaca

SEQ ID NO: 11329 - DNA, 18 bp, Artificial sequence
  synthetic polynucleotide sequence
taaggaggcgctgatcca

SEQ ID NO: 11330 - DNA, 18 bp, Artificial sequence
  synthetic polynucleotide sequence
gcaaaccaccttcacgga

SEQ ID NO: 11331 - DNA, 18 bp, Artificial sequence
  synthetic polynucleotide sequence
agctgacaagtcaggtca

SEQ ID NO: 11332 - DNA, 18 bp, Artificial sequence
  synthetic polynucleotide sequence
acctcgcacttcaagcaa

SEQ ID NO: 11333 - DNA, 18 bp, Artificial sequence
  synthetic polynucleotide sequence
aagtggtgtgaggccaca

SEQ ID NO: 11334 - DNA, 18 bp, Artificial sequence
  synthetic polynucleotide sequence
aagtggtgtgaggccaca

SEQ ID NO: 11335 - DNA, 18 bp, Artificial sequence
  synthetic polynucleotide sequence
ttctggagaccacgacga

SEQ ID NO: 11336 - DNA, 18 bp, Artificial sequence
  synthetic polynucleotide sequence
ggggaagcagtggcggca

SEQ ID NO: 11337 - DNA, 16 bp, Artificial sequence
  synthetic polynucleotide sequence
gagagcggcaagagca

SEQ ID NO: 11338 - DNA, 16 bp, Artificial sequence
  synthetic polynucleotide sequence
agcagtggcagcacca

SEQ ID NO: 11339 - DNA, 19 bp, Artificial sequence
  synthetic polynucleotide sequence
catggacaccttacaccga

SEQ ID NO: 11340 - DNA, 19 bp, Artificial sequence
  synthetic polynucleotide sequence
gcggagaggcataggtcaa

SEQ ID NO: 11341 - DNA, 18 bp, Artificial sequence
  synthetic polynucleotide sequence
caagcagtggtgggacca

SEQ ID NO: 11342 - DNA, 18 bp, Artificial sequence
  synthetic polynucleotide sequence
aggggagggactcagaga

SEQ ID NO: 11343 - DNA, 18 bp, Artificial sequence
  synthetic polynucleotide sequence
ccttcaagcaacgccgca

SEQ ID NO: 11344 - DNA, 18 bp, Artificial sequence
  synthetic polynucleotide sequence
gagggcctcgaagcggga

SEQ ID NO: 11345 - DNA, 18 bp, Artificial sequence
  synthetic polynucleotide sequence
gggagataccagccggga

SEQ ID NO: 11346 - DNA, 18 bp, Artificial sequence
  synthetic polynucleotide sequence
ggaccagcatcgagacca

SEQ ID NO: 11347 - DNA, 18 bp, Artificial sequence
  synthetic polynucleotide sequence
aatgcatgggagagccca

SEQ ID NO: 11348 - DNA, 18 bp, Artificial sequence
  synthetic polynucleotide sequence
cgccagaagggcaagcga

SEQ ID NO: 11349 - DNA, 18 bp, Artificial sequence
  synthetic polynucleotide sequence
ctcagcctcagccatcca

SEQ ID NO: 11350 - DNA, 18 bp, Artificial sequence
  synthetic polynucleotide sequence
cggccatctgcagacaca

SEQ ID NO: 11351 - DNA, 18 bp, Artificial sequence
  synthetic polynucleotide sequence
gccctggagacttggcaa

SEQ ID NO: 11352 - DNA, 18 bp, Artificial sequence
  synthetic polynucleotide sequence
gccctggagacttggcaa

SEQ ID NO: 11353 - DNA, 18 bp, Artificial sequence
  synthetic polynucleotide sequence
aggcagactgcggcctca

SEQ ID NO: 11354 - DNA, 18 bp, Artificial sequence
  synthetic polynucleotide sequence
cagcatgcagtacatgga

SEQ ID NO: 11355 - DNA, 18 bp, Artificial sequence
  synthetic polynucleotide sequence
agtccaggaagccaggaa

SEQ ID NO: 11356 - DNA, 18 bp, Artificial sequence
  synthetic polynucleotide sequence
ctatgcagcaggccacca

SEQ ID NO: 11357 - DNA, 18 bp, Artificial sequence
  synthetic polynucleotide sequence
cggctgctgcgacccaca

SEQ ID NO: 11358 - DNA, 18 bp, Artificial sequence
  synthetic polynucleotide sequence
gcaggaggccaacaagga

SEQ ID NO: 11359 - DNA, 18 bp, Artificial sequence
  synthetic polynucleotide sequence
ggccaagctggtggccaa

SEQ ID NO: 11360 - DNA, 18 bp, Artificial sequence
  synthetic polynucleotide sequence
cactgacgtgcactggca

SEQ ID NO: 11361 - DNA, 18 bp, Artificial sequence
  synthetic polynucleotide sequence
ggtggaggctatccagga

SEQ ID NO: 11362 - DNA, 18 bp, Artificial sequence
  synthetic polynucleotide sequence
gttgccgcaggtcagcca

SEQ ID NO: 11363 - DNA, 18 bp, Artificial sequence
  synthetic polynucleotide sequence
acagcctccacggagcga

SEQ ID NO: 11364 - DNA, 18 bp, Artificial sequence
  synthetic polynucleotide sequence
aagcaaaggcgagggcga

SEQ ID NO: 11365 - DNA, 18 bp, Artificial sequence
  synthetic polynucleotide sequence
cgtgtccaccagtgagga

SEQ ID NO: 11366 - DNA, 18 bp, Artificial sequence
  synthetic polynucleotide sequence
actgtggtgccaccacca

SEQ ID NO: 11367 - DNA, 18 bp, Artificial sequence
  synthetic polynucleotide sequence
ttctgaagacaccaccca

SEQ ID NO: 11368 - DNA, 18 bp, Artificial sequence
  synthetic polynucleotide sequence
aaggaagcacccacagca

SEQ ID NO: 11369 - DNA, 18 bp, Artificial sequence
  synthetic polynucleotide sequence
atgcagcggagttcagca

SEQ ID NO: 11370 - DNA, 18 bp, Artificial sequence
  synthetic polynucleotide sequence
atgcagcggagttcagca

SEQ ID NO: 11371 - DNA, 18 bp, Artificial sequence
  synthetic polynucleotide sequence
cttgggcacagaccggaa

SEQ ID NO: 11372 - DNA, 18 bp, Artificial sequence
  synthetic polynucleotide sequence
gtccccagggtggacaca

SEQ ID NO: 11373 - DNA, 18 bp, Artificial sequence
  synthetic polynucleotide sequence
gagaataccatcgcccca

SEQ ID NO: 11374 - DNA, 18 bp, Artificial sequence
  synthetic polynucleotide sequence
aacgaggctctagaacca

SEQ ID NO: 11375 - DNA, 18 bp, Artificial sequence
  synthetic polynucleotide sequence
tcacacgccataatggca

SEQ ID NO: 11376 - DNA, 18 bp, Artificial sequence
  synthetic polynucleotide sequence
gccatggacaagatgcca

SEQ ID NO: 11377 - DNA, 18 bp, Artificial sequence
  synthetic polynucleotide sequence
catgatccagggcggaga

SEQ ID NO: 11378 - DNA, 18 bp, Artificial sequence
  synthetic polynucleotide sequence
tcatcggggaagcgctca

SEQ ID NO: 11379 - DNA, 18 bp, Artificial sequence
  synthetic polynucleotide sequence
tgaccgtccactcaccaa

SEQ ID NO: 11380 - DNA, 18 bp, Artificial sequence
  synthetic polynucleotide sequence
tcagcgatctcaaccaca

SEQ ID NO: 11381 - DNA, 18 bp, Artificial sequence
  synthetic polynucleotide sequence
acaggacacctggcccca

SEQ ID NO: 11382 - DNA, 18 bp, Artificial sequence
  synthetic polynucleotide sequence
accaaccacaatggcaca

SEQ ID NO: 11383 - DNA, 18 bp, Artificial sequence
  synthetic polynucleotide sequence
gggaatcagctctccaca

SEQ ID NO: 11384 - DNA, 18 bp, Artificial sequence
  synthetic polynucleotide sequence
ggccaacagagggaagga

SEQ ID NO: 11385 - DNA, 18 bp, Artificial sequence
  synthetic polynucleotide sequence
ccacaagctccaggcgga

SEQ ID NO: 11386 - DNA, 18 bp, Artificial sequence
  synthetic polynucleotide sequence
atgggccttggaggagga

SEQ ID NO: 11387 - DNA, 18 bp, Artificial sequence
  synthetic polynucleotide sequence
catggactaagtcgggga

SEQ ID NO: 11388 - DNA, 18 bp, Artificial sequence
  synthetic polynucleotide sequence
catggactaagtcgggga

SEQ ID NO: 11389 - DNA, 18 bp, Artificial sequence
  synthetic polynucleotide sequence
acacaagggaagtcgaga

SEQ ID NO: 11390 - DNA, 18 bp, Artificial sequence
  synthetic polynucleotide sequence
atgcgcatgacatgggca

SEQ ID NO: 11391 - DNA, 18 bp, Artificial sequence
  synthetic polynucleotide sequence
caagtcactggaggagga

SEQ ID NO: 11392 - DNA, 18 bp, Artificial sequence
  synthetic polynucleotide sequence
ttgctacgaaccagggca

SEQ ID NO: 11393 - DNA, 18 bp, Artificial sequence
  synthetic polynucleotide sequence
gcagcatggttgcccaca

SEQ ID NO: 11394 - DNA, 18 bp, Artificial sequence
  synthetic polynucleotide sequence
gcactggtgctgaggcca

SEQ ID NO: 11395 - DNA, 18 bp, Artificial sequence
  synthetic polynucleotide sequence
ggccctgatacgagggaa

SEQ ID NO: 11396 - DNA, 18 bp, Artificial sequence
  synthetic polynucleotide sequence
ccccaatggctctggaga

SEQ ID NO: 11397 - DNA, 18 bp, Artificial sequence
  synthetic polynucleotide sequence
acaagacgcacccgtcca

SEQ ID NO: 11398 - DNA, 18 bp, Artificial sequence
  synthetic polynucleotide sequence
agggcctctgggagtcga

SEQ ID NO: 11399 - DNA, 18 bp, Artificial sequence
  synthetic polynucleotide sequence
accaggaacctcccagca

SEQ ID NO: 11400 - DNA, 18 bp, Artificial sequence
  synthetic polynucleotide sequence
gcagtaccaaggagccca

SEQ ID NO: 11401 - DNA, 18 bp, Artificial sequence
  synthetic polynucleotide sequence
cctccagggttcaggcca

SEQ ID NO: 11402 - DNA, 18 bp, Artificial sequence
  synthetic polynucleotide sequence
gtgtggacgagaccctca

SEQ ID NO: 11403 - DNA, 18 bp, Artificial sequence
  synthetic polynucleotide sequence
gcagggggtgtggaagca

SEQ ID NO: 11404 - DNA, 18 bp, Artificial sequence
  synthetic polynucleotide sequence
cagccaggagaggacaca

SEQ ID NO: 11405 - DNA, 18 bp, Artificial sequence
  synthetic polynucleotide sequence
cactggatgcacctccca

SEQ ID NO: 11406 - DNA, 18 bp, Artificial sequence
  synthetic polynucleotide sequence
cactggatgcacctccca

SEQ ID NO: 11407 - DNA, 19 bp, Artificial sequence
  synthetic polynucleotide sequence
cttcaccgtacagcagcaa

SEQ ID NO: 11408 - DNA, 18 bp, Artificial sequence
  synthetic polynucleotide sequence
gagatacggcaacagcca

SEQ ID NO: 11409 - DNA, 18 bp, Artificial sequence
  synthetic polynucleotide sequence
caagctcaaggcaacgaa

SEQ ID NO: 11410 - DNA, 18 bp, Artificial sequence
  synthetic polynucleotide sequence
ttcccaggatagccagga

SEQ ID NO: 11411 - DNA, 18 bp, Artificial sequence
  synthetic polynucleotide sequence
agcgaacagtgacaggga

SEQ ID NO: 11412 - DNA, 18 bp, Artificial sequence
  synthetic polynucleotide sequence
atgacagggggtaagtca

SEQ ID NO: 11413 - DNA, 18 bp, Artificial sequence
  synthetic polynucleotide sequence
agcaggctcccagccaca

SEQ ID NO: 11414 - DNA, 18 bp, Artificial sequence
  synthetic polynucleotide sequence
acaggagtcaagtccaca

SEQ ID NO: 11415 - DNA, 18 bp, Artificial sequence
  synthetic polynucleotide sequence
cagcggcttaggagcaga

SEQ ID NO: 11416 - DNA, 18 bp, Artificial sequence
  synthetic polynucleotide sequence
aacctgctgcacactcca

SEQ ID NO: 11417 - DNA, 18 bp, Artificial sequence
  synthetic polynucleotide sequence
tccacaggggacagtgca

SEQ ID NO: 11418 - DNA, 18 bp, Artificial sequence
  synthetic polynucleotide sequence
atgaggagctgagcccca

SEQ ID NO: 11419 - DNA, 18 bp, Artificial sequence
  synthetic polynucleotide sequence
agcagcctggttcccaca

SEQ ID NO: 11420 - DNA, 18 bp, Artificial sequence
  synthetic polynucleotide sequence
ttccacatgagggcccaa

SEQ ID NO: 11421 - DNA, 18 bp, Artificial sequence
  synthetic polynucleotide sequence
gcccacagacctcagaca

SEQ ID NO: 11422 - DNA, 18 bp, Artificial sequence
  synthetic polynucleotide sequence
tatgccatccgcgaggca

SEQ ID NO: 11423 - DNA, 18 bp, Artificial sequence
  synthetic polynucleotide sequence
cagcagcacgtcgtacca

SEQ ID NO: 11424 - DNA, 18 bp, Artificial sequence
  synthetic polynucleotide sequence
cagcagcacgtcgtacca

SEQ ID NO: 11425 - DNA, 18 bp, Artificial sequence
  synthetic polynucleotide sequence
agccgagttccaccccca

SEQ ID NO: 11426 - DNA, 18 bp, Artificial sequence
  synthetic polynucleotide sequence
tgcctgtcacacagggca

SEQ ID NO: 11427 - DNA, 18 bp, Artificial sequence
  synthetic polynucleotide sequence
cgggctgtgctcaagcca

SEQ ID NO: 11428 - DNA, 18 bp, Artificial sequence
  synthetic polynucleotide sequence
gccaggccgtgtgcagga

SEQ ID NO: 11429 - DNA, 18 bp, Artificial sequence
  synthetic polynucleotide sequence
tgcagagcactccaacca

SEQ ID NO: 11430 - DNA, 18 bp, Artificial sequence
  synthetic polynucleotide sequence
agggaacttctccaggca

SEQ ID NO: 11431 - DNA, 18 bp, Artificial sequence
  synthetic polynucleotide sequence
cccagctcaaagatgcca

SEQ ID NO: 11432 - DNA, 18 bp, Artificial sequence
  synthetic polynucleotide sequence
tggaggaagtgtacggaa

SEQ ID NO: 11433 - DNA, 18 bp, Artificial sequence
  synthetic polynucleotide sequence
gaagacggagcacaagca

SEQ ID NO: 11434 - DNA, 18 bp, Artificial sequence
  synthetic polynucleotide sequence
tctccaggaactgcacca

SEQ ID NO: 11435 - DNA, 18 bp, Artificial sequence
  synthetic polynucleotide sequence
gccggaagaggggttcca

SEQ ID NO: 11436 - DNA, 18 bp, Artificial sequence
  synthetic polynucleotide sequence
ccaaagactcacagtcca

SEQ ID NO: 11437 - DNA, 17 bp, Artificial sequence
  synthetic polynucleotide sequence
aagtgcagcaagaggca

SEQ ID NO: 11438 - DNA, 18 bp, Artificial sequence
  synthetic polynucleotide sequence
ctgagaggcaaccatgaa

SEQ ID NO: 11439 - DNA, 18 bp, Artificial sequence
  synthetic polynucleotide sequence
actgggaggtccccagga

SEQ ID NO: 11440 - DNA, 18 bp, Artificial sequence
  synthetic polynucleotide sequence
tgccggagctgcgccaca

SEQ ID NO: 11441 - DNA, 18 bp, Artificial sequence
  synthetic polynucleotide sequence
accagaggaggtcacaca

SEQ ID NO: 11442 - DNA, 18 bp, Artificial sequence
  synthetic polynucleotide sequence
accagaggaggtcacaca

SEQ ID NO: 11443 - DNA, 18 bp, Artificial sequence
  synthetic polynucleotide sequence
catcgaacggaatcagga

SEQ ID NO: 11444 - DNA, 18 bp, Artificial sequence
  synthetic polynucleotide sequence
tcggggactgatagccca

SEQ ID NO: 11445 - DNA, 18 bp, Artificial sequence
  synthetic polynucleotide sequence
gtgactcagaaggcgcca

SEQ ID NO: 11446 - DNA, 18 bp, Artificial sequence
  synthetic polynucleotide sequence
cccacacactggaaccca

SEQ ID NO: 11447 - DNA, 18 bp, Artificial sequence
  synthetic polynucleotide sequence
cagccaagaactccagga

SEQ ID NO: 11448 - DNA, 18 bp, Artificial sequence
  synthetic polynucleotide sequence
gcagtgcttgccacggaa

SEQ ID NO: 11449 - DNA, 18 bp, Artificial sequence
  synthetic polynucleotide sequence
gcagagcactgtccccaa

SEQ ID NO: 11450 - DNA, 18 bp, Artificial sequence
  synthetic polynucleotide sequence
gctccagcagactggaca

SEQ ID NO: 11451 - DNA, 18 bp, Artificial sequence
  synthetic polynucleotide sequence
gaccatcccaatgccaca

SEQ ID NO: 11452 - DNA, 18 bp, Artificial sequence
  synthetic polynucleotide sequence
gataccggccattggaca

SEQ ID NO: 11453 - DNA, 18 bp, Artificial sequence
  synthetic polynucleotide sequence
cccactccgagaaggcca

SEQ ID NO: 11454 - DNA, 18 bp, Artificial sequence
  synthetic polynucleotide sequence
atgccacaccagagcaga

SEQ ID NO: 11455 - DNA, 18 bp, Artificial sequence
  synthetic polynucleotide sequence
aggccaccaccatcacca

SEQ ID NO: 11456 - DNA, 18 bp, Artificial sequence
  synthetic polynucleotide sequence
accgcaccatctacacca

SEQ ID NO: 11457 - DNA, 18 bp, Artificial sequence
  synthetic polynucleotide sequence
gagaactgcagaggggca

SEQ ID NO: 11458 - DNA, 18 bp, Artificial sequence
  synthetic polynucleotide sequence
ccgcaaccaccgccacca

SEQ ID NO: 11459 - DNA, 18 bp, Artificial sequence
  synthetic polynucleotide sequence
agggcaggtggtgcagca

SEQ ID NO: 11460 - DNA, 18 bp, Artificial sequence
  synthetic polynucleotide sequence
agggcaggtggtgcagca

SEQ ID NO: 11461 - DNA, 18 bp, Artificial sequence
  synthetic polynucleotide sequence
gccgggtacgtgcggcca

SEQ ID NO: 11462 - DNA, 18 bp, Artificial sequence
  synthetic polynucleotide sequence
gcaacgaggcgtgcacca

SEQ ID NO: 11463 - DNA, 18 bp, Artificial sequence
  synthetic polynucleotide sequence
gcatgccaggctcaggga

SEQ ID NO: 11464 - DNA, 18 bp, Artificial sequence
  synthetic polynucleotide sequence
gtccccacagtgaggaca

SEQ ID NO: 11465 - DNA, 18 bp, Artificial sequence
  synthetic polynucleotide sequence
cagagcaggacccagaga

SEQ ID NO: 11466 - DNA, 18 bp, Artificial sequence
  synthetic polynucleotide sequence
cggcttctggacagggaa

SEQ ID NO: 11467 - DNA, 18 bp, Artificial sequence
  synthetic polynucleotide sequence
caaccccaaggtccccca

SEQ ID NO: 11468 - DNA, 18 bp, Artificial sequence
  synthetic polynucleotide sequence
ggaggtgggggaccctga

SEQ ID NO: 11469 - DNA, 18 bp, Artificial sequence
  synthetic polynucleotide sequence
ggaggcaaccagccccaa

SEQ ID NO: 11470 - DNA, 18 bp, Artificial sequence
  synthetic polynucleotide sequence
cctggaggagatcgggca

SEQ ID NO: 11471 - DNA, 18 bp, Artificial sequence
  synthetic polynucleotide sequence
agatcgggcacttcggga

SEQ ID NO: 11472 - DNA, 18 bp, Artificial sequence
  synthetic polynucleotide sequence
agaccacccccacaagga

SEQ ID NO: 11473 - DNA, 18 bp, Artificial sequence
  synthetic polynucleotide sequence
gccgagccagggtaccca

SEQ ID NO: 11474 - DNA, 18 bp, Artificial sequence
  synthetic polynucleotide sequence
ccttctggcagcaagcca

SEQ ID NO: 11475 - DNA, 18 bp, Artificial sequence
  synthetic polynucleotide sequence
gcaggatagtagccacca

SEQ ID NO: 11476 - DNA, 18 bp, Artificial sequence
  synthetic polynucleotide sequence
ccaggacgatgcagccaa

SEQ ID NO: 11477 - DNA, 18 bp, Artificial sequence
  synthetic polynucleotide sequence
cttccaaggagcgggcta

SEQ ID NO: 11478 - DNA, 18 bp, Artificial sequence
  synthetic polynucleotide sequence
cttccaaggagcgggcta

SEQ ID NO: 11479 - DNA, 18 bp, Artificial sequence
  synthetic polynucleotide sequence
tgctgaccggctcgagga

SEQ ID NO: 11480 - DNA, 18 bp, Artificial sequence
  synthetic polynucleotide sequence
aaggctgcaccctgagga

SEQ ID NO: 11481 - DNA, 18 bp, Artificial sequence
  synthetic polynucleotide sequence
ggggatgtacacccccaa

SEQ ID NO: 11482 - DNA, 18 bp, Artificial sequence
  synthetic polynucleotide sequence
gtgaggtgctcagggcca

SEQ ID NO: 11483 - DNA, 18 bp, Artificial sequence
  synthetic polynucleotide sequence
gcatccacacgctggaca

SEQ ID NO: 11484 - DNA, 18 bp, Artificial sequence
  synthetic polynucleotide sequence
gttgcgcagcgtggacga

SEQ ID NO: 11485 - DNA, 18 bp, Artificial sequence
  synthetic polynucleotide sequence
taagcccaagaccggcca

SEQ ID NO: 11486 - DNA, 18 bp, Artificial sequence
  synthetic polynucleotide sequence
cttgccgcagaactcgca

SEQ ID NO: 11487 - DNA, 18 bp, Artificial sequence
  synthetic polynucleotide sequence
gcgagtccactctggaga

SEQ ID NO: 11488 - DNA, 18 bp, Artificial sequence
  synthetic polynucleotide sequence
gaagggcttctccccgga

SEQ ID NO: 11489 - DNA, 18 bp, Artificial sequence
  synthetic polynucleotide sequence
agacgtcagtctggggca

SEQ ID NO: 11490 - DNA, 18 bp, Artificial sequence
  synthetic polynucleotide sequence
ggaagcctcgaacccaca

SEQ ID NO: 11491 - DNA, 18 bp, Artificial sequence
  synthetic polynucleotide sequence
cgactctgaggtgggaga

SEQ ID NO: 11492 - DNA, 18 bp, Artificial sequence
  synthetic polynucleotide sequence
ttcgaacctccagcggca

SEQ ID NO: 11493 - DNA, 18 bp, Artificial sequence
  synthetic polynucleotide sequence
aagagcaagaggggacca

SEQ ID NO: 11494 - DNA, 18 bp, Artificial sequence
  synthetic polynucleotide sequence
gaggccaagaagcggaga

SEQ ID NO: 11495 - DNA, 18 bp, Artificial sequence
  synthetic polynucleotide sequence
atggagtcactgagggca

SEQ ID NO: 11496 - DNA, 18 bp, Artificial sequence
  synthetic polynucleotide sequence
atggagtcactgagggca

SEQ ID NO: 11497 - DNA, 18 bp, Artificial sequence
  synthetic polynucleotide sequence
caccatctcaggagcaga

SEQ ID NO: 11498 - DNA, 18 bp, Artificial sequence
  synthetic polynucleotide sequence
tccaggtagccaatcaga

SEQ ID NO: 11499 - DNA, 18 bp, Artificial sequence
  synthetic polynucleotide sequence
ggacaaggggcatcccaa

SEQ ID NO: 11500 - DNA, 18 bp, Artificial sequence
  synthetic polynucleotide sequence
agtgcagacccagtggca

SEQ ID NO: 11501 - DNA, 18 bp, Artificial sequence
  synthetic polynucleotide sequence
gcagaactggtgcgccaa

SEQ ID NO: 11502 - DNA, 18 bp, Artificial sequence
  synthetic polynucleotide sequence
gtggcgctccctgaagga

SEQ ID NO: 11503 - DNA, 18 bp, Artificial sequence
  synthetic polynucleotide sequence
ggctgatcaccaagggga

SEQ ID NO: 11504 - DNA, 18 bp, Artificial sequence
  synthetic polynucleotide sequence
catccccataccagacca

SEQ ID NO: 11505 - DNA, 18 bp, Artificial sequence
  synthetic polynucleotide sequence
gcgcaccattgctcagga

SEQ ID NO: 11506 - DNA, 18 bp, Artificial sequence
  synthetic polynucleotide sequence
tccagccagctgggcaca

SEQ ID NO: 11507 - DNA, 18 bp, Artificial sequence
  synthetic polynucleotide sequence
ggcttccagccagcggga

SEQ ID NO: 11508 - DNA, 18 bp, Artificial sequence
  synthetic polynucleotide sequence
cggcgtgctgaaaacaga

SEQ ID NO: 11509 - DNA, 18 bp, Artificial sequence
  synthetic polynucleotide sequence
acgccttcaccaagcgga

SEQ ID NO: 11510 - DNA, 18 bp, Artificial sequence
  synthetic polynucleotide sequence
ggccacatgaacatcgca

SEQ ID NO: 11511 - DNA, 18 bp, Artificial sequence
  synthetic polynucleotide sequence
ggcgaccgatacccggga

SEQ ID NO: 11512 - DNA, 18 bp, Artificial sequence
  synthetic polynucleotide sequence
ccggactcgcgaagagga

SEQ ID NO: 11513 - DNA, 18 bp, Artificial sequence
  synthetic polynucleotide sequence
gtgccaggctgcaggtga

SEQ ID NO: 11514 - DNA, 18 bp, Artificial sequence
  synthetic polynucleotide sequence
gtgccaggctgcaggtga

SEQ ID NO: 11515 - DNA, 18 bp, Artificial sequence
  synthetic polynucleotide sequence
agctaccactggcaggaa

SEQ ID NO: 11516 - DNA, 18 bp, Artificial sequence
  synthetic polynucleotide sequence
gttggaaggaccatcaca

SEQ ID NO: 11517 - DNA, 18 bp, Artificial sequence
  synthetic polynucleotide sequence
ctacgtgagggaggccca

SEQ ID NO: 11518 - DNA, 18 bp, Artificial sequence
  synthetic polynucleotide sequence
cgacacacagcaggagca

SEQ ID NO: 11519 - DNA, 18 bp, Artificial sequence
  synthetic polynucleotide sequence
cctggagaacgtgccaca

SEQ ID NO: 11520 - DNA, 18 bp, Artificial sequence
  synthetic polynucleotide sequence
tcatgaggtccagcggga

SEQ ID NO: 11521 - DNA, 18 bp, Artificial sequence
  synthetic polynucleotide sequence
atcagaggaggtggcgaa

SEQ ID NO: 11522 - DNA, 18 bp, Artificial sequence
  synthetic polynucleotide sequence
gccactaagaggcctcca

SEQ ID NO: 11523 - DNA, 18 bp, Artificial sequence
  synthetic polynucleotide sequence
gcgagtacgaggagagca

SEQ ID NO: 11524 - DNA, 18 bp, Artificial sequence
  synthetic polynucleotide sequence
ctctgacagcgtcaccca

SEQ ID NO: 11525 - DNA, 18 bp, Artificial sequence
  synthetic polynucleotide sequence
ggggacatagtccaggca

SEQ ID NO: 11526 - DNA, 18 bp, Artificial sequence
  synthetic polynucleotide sequence
aggagctgaggacgagca

SEQ ID NO: 11527 - DNA, 18 bp, Artificial sequence
  synthetic polynucleotide sequence
agcgacccgagcctgtga

SEQ ID NO: 11528 - DNA, 18 bp, Artificial sequence
  synthetic polynucleotide sequence
gaggtgctacaggggcaa

SEQ ID NO: 11529 - DNA, 18 bp, Artificial sequence
  synthetic polynucleotide sequence
ggtgcatagggccacaca

SEQ ID NO: 11530 - DNA, 18 bp, Artificial sequence
  synthetic polynucleotide sequence
ctggactgatgggagcca

SEQ ID NO: 11531 - DNA, 18 bp, Artificial sequence
  synthetic polynucleotide sequence
cgggagtaacttcaggca

SEQ ID NO: 11532 - DNA, 18 bp, Artificial sequence
  synthetic polynucleotide sequence
cgggagtaacttcaggca

SEQ ID NO: 11533 - DNA, 18 bp, Artificial sequence
  synthetic polynucleotide sequence
ggaccaccccaacaggga

SEQ ID NO: 11534 - DNA, 18 bp, Artificial sequence
  synthetic polynucleotide sequence
cctcgaggaggacgggga

SEQ ID NO: 11535 - DNA, 18 bp, Artificial sequence
  synthetic polynucleotide sequence
tcctggacgtgaggcaga

SEQ ID NO: 11536 - DNA, 18 bp, Artificial sequence
  synthetic polynucleotide sequence
cctgtgggaactgcacca

SEQ ID NO: 11537 - DNA, 18 bp, Artificial sequence
  synthetic polynucleotide sequence
cctggctggagtgggaga

SEQ ID NO: 11538 - DNA, 18 bp, Artificial sequence
  synthetic polynucleotide sequence
ggcatccaattcacggca

SEQ ID NO: 11539 - DNA, 18 bp, Artificial sequence
  synthetic polynucleotide sequence
gcaccttcggcaaagtga

SEQ ID NO: 11540 - DNA, 18 bp, Artificial sequence
  synthetic polynucleotide sequence
accacatcaaggctccga

SEQ ID NO: 11541 - DNA, 18 bp, Artificial sequence
  synthetic polynucleotide sequence
cacaactgcagagagcca

SEQ ID NO: 11542 - DNA, 18 bp, Artificial sequence
  synthetic polynucleotide sequence
gtgtgactgcccaggcga

SEQ ID NO: 11543 - DNA, 18 bp, Artificial sequence
  synthetic polynucleotide sequence
gggttgcgctgagcacca

SEQ ID NO: 11544 - DNA, 18 bp, Artificial sequence
  synthetic polynucleotide sequence
tgaacaaggacacgggga

SEQ ID NO: 11545 - DNA, 18 bp, Artificial sequence
  synthetic polynucleotide sequence
caagctgactggtaacca

SEQ ID NO: 11546 - DNA, 18 bp, Artificial sequence
  synthetic polynucleotide sequence
gtctgaaggaggcaagga

SEQ ID NO: 11547 - DNA, 18 bp, Artificial sequence
  synthetic polynucleotide sequence
agctgaagtgggaaggga

SEQ ID NO: 11548 - DNA, 18 bp, Artificial sequence
  synthetic polynucleotide sequence
agtacctggcccctgaga

SEQ ID NO: 11549 - DNA, 18 bp, Artificial sequence
  synthetic polynucleotide sequence
ctccacctgtgagcacca

SEQ ID NO: 11550 - DNA, 18 bp, Artificial sequence
  synthetic polynucleotide sequence
ctccacctgtgagcacca

SEQ ID NO: 11551 - DNA, 18 bp, Artificial sequence
  synthetic polynucleotide sequence
ggggcatcgaccgagaca

SEQ ID NO: 11552 - DNA, 18 bp, Artificial sequence
  synthetic polynucleotide sequence
gaccgacgttgtagcaca

SEQ ID NO: 11553 - DNA, 18 bp, Artificial sequence
  synthetic polynucleotide sequence
ggaaccaggaggtcgaga

SEQ ID NO: 11554 - DNA, 18 bp, Artificial sequence
  synthetic polynucleotide sequence
actgcataagctgaggca

SEQ ID NO: 11555 - DNA, 18 bp, Artificial sequence
  synthetic polynucleotide sequence
ggtcaaagatggggagca

SEQ ID NO: 11556 - DNA, 18 bp, Artificial sequence
  synthetic polynucleotide sequence
taaggccagttcgccgaa

SEQ ID NO: 11557 - DNA, 18 bp, Artificial sequence
  synthetic polynucleotide sequence
atgacgtggagtgcacca

SEQ ID NO: 11558 - DNA, 18 bp, Artificial sequence
  synthetic polynucleotide sequence
atgacgaagtacagccga

SEQ ID NO: 11559 - DNA, 18 bp, Artificial sequence
  synthetic polynucleotide sequence
ggggtgacaaccaagaca

SEQ ID NO: 11560 - DNA, 18 bp, Artificial sequence
  synthetic polynucleotide sequence
agggtgcctgcccagcca

SEQ ID NO: 11561 - DNA, 18 bp, Artificial sequence
  synthetic polynucleotide sequence
gaagccagcgaatgcaga

SEQ ID NO: 11562 - DNA, 18 bp, Artificial sequence
  synthetic polynucleotide sequence
aagcggaggttggagcca

SEQ ID NO: 11563 - DNA, 18 bp, Artificial sequence
  synthetic polynucleotide sequence
gcgctccggccaggccca

SEQ ID NO: 11564 - DNA, 18 bp, Artificial sequence
  synthetic polynucleotide sequence
aggccgaagttggagaga

SEQ ID NO: 11565 - DNA, 18 bp, Artificial sequence
  synthetic polynucleotide sequence
gcgatgccacacagccca

SEQ ID NO: 11566 - DNA, 18 bp, Artificial sequence
  synthetic polynucleotide sequence
ggccgacaatgaggacga

SEQ ID NO: 11567 - DNA, 18 bp, Artificial sequence
  synthetic polynucleotide sequence
accagcgtgcagtccaca

SEQ ID NO: 11568 - DNA, 18 bp, Artificial sequence
  synthetic polynucleotide sequence
accagcgtgcagtccaca

SEQ ID NO: 11569 - DNA, 18 bp, Artificial sequence
  synthetic polynucleotide sequence
ggtgtcaccacggccaca

SEQ ID NO: 11570 - DNA, 18 bp, Artificial sequence
  synthetic polynucleotide sequence
gccaggtagggtagacca

SEQ ID NO: 11571 - DNA, 18 bp, Artificial sequence
  synthetic polynucleotide sequence
aggattacggccaggaga

SEQ ID NO: 11572 - DNA, 18 bp, Artificial sequence
  synthetic polynucleotide sequence
gagcactccaagagccca

SEQ ID NO: 11573 - DNA, 18 bp, Artificial sequence
  synthetic polynucleotide sequence
aggagatgccaagacgaa

SEQ ID NO: 11574 - DNA, 18 bp, Artificial sequence
  synthetic polynucleotide sequence
gcgactgaccaatcagca

SEQ ID NO: 11575 - DNA, 18 bp, Artificial sequence
  synthetic polynucleotide sequence
ctacgacgagcagacgca

SEQ ID NO: 11576 - DNA, 18 bp, Artificial sequence
  synthetic polynucleotide sequence
gacaagcttgaaggggca

SEQ ID NO: 11577 - DNA, 18 bp, Artificial sequence
  synthetic polynucleotide sequence
tcaccgacaacccggaca

SEQ ID NO: 11578 - DNA, 18 bp, Artificial sequence
  synthetic polynucleotide sequence
gggaggctttgacggaca

SEQ ID NO: 11579 - DNA, 18 bp, Artificial sequence
  synthetic polynucleotide sequence
ccttgggaatgacgggca

SEQ ID NO: 11580 - DNA, 18 bp, Artificial sequence
  synthetic polynucleotide sequence
ccttccagcccatcacca

SEQ ID NO: 11581 - DNA, 17 bp, Artificial sequence
  synthetic polynucleotide sequence
cagctctcggaggtcca

SEQ ID NO: 11582 - DNA, 19 bp, Artificial sequence
  synthetic polynucleotide sequence
gagccacatctcagctgga

SEQ ID NO: 11583 - DNA, 18 bp, Artificial sequence
  synthetic polynucleotide sequence
gtgggctgccagtcagga

SEQ ID NO: 11584 - DNA, 18 bp, Artificial sequence
  synthetic polynucleotide sequence
cagggacctcaagccaga

SEQ ID NO: 11585 - DNA, 18 bp, Artificial sequence
  synthetic polynucleotide sequence
tggagagagaccaatcca

SEQ ID NO: 11586 - DNA, 18 bp, Artificial sequence
  synthetic polynucleotide sequence
tggagagagaccaatcca

SEQ ID NO: 11587 - DNA, 18 bp, Artificial sequence
  synthetic polynucleotide sequence
ctggacgtggcatgacga

SEQ ID NO: 11588 - DNA, 18 bp, Artificial sequence
  synthetic polynucleotide sequence
caggtactcgatggcaca

SEQ ID NO: 11589 - DNA, 18 bp, Artificial sequence
  synthetic polynucleotide sequence
ccatcaacagctgccaca

SEQ ID NO: 11590 - DNA, 18 bp, Artificial sequence
  synthetic polynucleotide sequence
cagaggctcattccagga

SEQ ID NO: 11591 - DNA, 18 bp, Artificial sequence
  synthetic polynucleotide sequence
tcggtcggaggagggcaa

SEQ ID NO: 11592 - DNA, 18 bp, Artificial sequence
  synthetic polynucleotide sequence
caccgccttccaggggga

SEQ ID NO: 11593 - DNA, 18 bp, Artificial sequence
  synthetic polynucleotide sequence
ggcaacccagcagaggga

SEQ ID NO: 11594 - DNA, 18 bp, Artificial sequence
  synthetic polynucleotide sequence
aagggtttagcggagcca

SEQ ID NO: 11595 - DNA, 18 bp, Artificial sequence
  synthetic polynucleotide sequence
ggctgcaccggatccaca

SEQ ID NO: 11596 - DNA, 18 bp, Artificial sequence
  synthetic polynucleotide sequence
cctccggtgcctgcagga

SEQ ID NO: 11597 - DNA, 18 bp, Artificial sequence
  synthetic polynucleotide sequence
ccagtgcgtgtacgggga

SEQ ID NO: 11598 - DNA, 18 bp, Artificial sequence
  synthetic polynucleotide sequence
gcctgcaagtgaagcgga

SEQ ID NO: 11599 - DNA, 18 bp, Artificial sequence
  synthetic polynucleotide sequence
cagcccagctcagagcca

SEQ ID NO: 11600 - DNA, 18 bp, Artificial sequence
  synthetic polynucleotide sequence
cttccaccccaccacaca

SEQ ID NO: 11601 - DNA, 18 bp, Artificial sequence
  synthetic polynucleotide sequence
ggcccgtagagaacacga

SEQ ID NO: 11602 - DNA, 18 bp, Artificial sequence
  synthetic polynucleotide sequence
catccatgtgcacggcaa

SEQ ID NO: 11603 - DNA, 18 bp, Artificial sequence
  synthetic polynucleotide sequence
aggaagagatgggagcca

SEQ ID NO: 11604 - DNA, 18 bp, Artificial sequence
  synthetic polynucleotide sequence
aggaagagatgggagcca

SEQ ID NO: 11605 - DNA, 18 bp, Artificial sequence
  synthetic polynucleotide sequence
ctacggactcctgcacga

SEQ ID NO: 11606 - DNA, 18 bp, Artificial sequence
  synthetic polynucleotide sequence
ccggacaatccctgcaca

SEQ ID NO: 11607 - DNA, 18 bp, Artificial sequence
  synthetic polynucleotide sequence
atggtgatgccccaggca

SEQ ID NO: 11608 - DNA, 18 bp, Artificial sequence
  synthetic polynucleotide sequence
tccctgaagtccagggca

SEQ ID NO: 11609 - DNA, 18 bp, Artificial sequence
  synthetic polynucleotide sequence
catgacctgcatccggga

SEQ ID NO: 11610 - DNA, 18 bp, Artificial sequence
  synthetic polynucleotide sequence
ctgcaggcagaatgcaga

SEQ ID NO: 11611 - DNA, 18 bp, Artificial sequence
  synthetic polynucleotide sequence
gtcagtggaacaagccga

SEQ ID NO: 11612 - DNA, 18 bp, Artificial sequence
  synthetic polynucleotide sequence
cccagcatgtagccgcca

SEQ ID NO: 11613 - DNA, 18 bp, Artificial sequence
  synthetic polynucleotide sequence
cggtatgaactgcgggaa

SEQ ID NO: 11614 - DNA, 18 bp, Artificial sequence
  synthetic polynucleotide sequence
atgcctacagccacacca

SEQ ID NO: 11615 - DNA, 18 bp, Artificial sequence
  synthetic polynucleotide sequence
cctcaagagctccagcca

SEQ ID NO: 11616 - DNA, 18 bp, Artificial sequence
  synthetic polynucleotide sequence
actgcgcaggatggagga

SEQ ID NO: 11617 - DNA, 18 bp, Artificial sequence
  synthetic polynucleotide sequence
gtccatggagcagcggta

SEQ ID NO: 11618 - DNA, 18 bp, Artificial sequence
  synthetic polynucleotide sequence
ggaaacgcaagcaccaca

SEQ ID NO: 11619 - DNA, 18 bp, Artificial sequence
  synthetic polynucleotide sequence
gcctggcagacatgggca

SEQ ID NO: 11620 - DNA, 18 bp, Artificial sequence
  synthetic polynucleotide sequence
tgggcaaactgggagaca

SEQ ID NO: 11621 - DNA, 18 bp, Artificial sequence
  synthetic polynucleotide sequence
agggacgccagtgcagca

SEQ ID NO: 11622 - DNA, 18 bp, Artificial sequence
  synthetic polynucleotide sequence
agggacgccagtgcagca

SEQ ID NO: 11623 - DNA, 18 bp, Artificial sequence
  synthetic polynucleotide sequence
ccccgcagcatctactga

SEQ ID NO: 11624 - DNA, 18 bp, Artificial sequence
  synthetic polynucleotide sequence
ggacagtggcattgagca

SEQ ID NO: 11625 - DNA, 18 bp, Artificial sequence
  synthetic polynucleotide sequence
ccaaagaggcgttggaga

SEQ ID NO: 11626 - DNA, 18 bp, Artificial sequence
  synthetic polynucleotide sequence
ggatgcaccaagcacaga

SEQ ID NO: 11627 - DNA, 18 bp, Artificial sequence
  synthetic polynucleotide sequence
aggaggtgactcagcgca

SEQ ID NO: 11628 - DNA, 18 bp, Artificial sequence
  synthetic polynucleotide sequence
tgcaccatgccaggcaga

SEQ ID NO: 11629 - DNA, 18 bp, Artificial sequence
  synthetic polynucleotide sequence
gaaccgcagagctaagca

SEQ ID NO: 11630 - DNA, 18 bp, Artificial sequence
  synthetic polynucleotide sequence
ggctgggaagggagggca

SEQ ID NO: 11631 - DNA, 18 bp, Artificial sequence
  synthetic polynucleotide sequence
ctggagttgtcgacacca

SEQ ID NO: 11632 - DNA, 18 bp, Artificial sequence
  synthetic polynucleotide sequence
catctggaaggccaccca

SEQ ID NO: 11633 - DNA, 18 bp, Artificial sequence
  synthetic polynucleotide sequence
ccttggtgacaaggacca

SEQ ID NO: 11634 - DNA, 18 bp, Artificial sequence
  synthetic polynucleotide sequence
ggaagtgtggtcaccaga

SEQ ID NO: 11635 - DNA, 18 bp, Artificial sequence
  synthetic polynucleotide sequence
acagattcactcagcgca

SEQ ID NO: 11636 - DNA, 18 bp, Artificial sequence
  synthetic polynucleotide sequence
gtacagccaaagaccgga

SEQ ID NO: 11637 - DNA, 18 bp, Artificial sequence
  synthetic polynucleotide sequence
ggagtggggtgaaggcca

SEQ ID NO: 11638 - DNA, 18 bp, Artificial sequence
  synthetic polynucleotide sequence
ggaccctgcagaagcaga

SEQ ID NO: 11639 - DNA, 18 bp, Artificial sequence
  synthetic polynucleotide sequence
tctacgaccaccgcgtga

SEQ ID NO: 11640 - DNA, 18 bp, Artificial sequence
  synthetic polynucleotide sequence
tctacgaccaccgcgtga

SEQ ID NO: 11641 - DNA, 18 bp, Artificial sequence
  synthetic polynucleotide sequence
ggagacgagtgaaggcga

SEQ ID NO: 11642 - DNA, 18 bp, Artificial sequence
  synthetic polynucleotide sequence
gcagcagcctgttgagca

SEQ ID NO: 11643 - DNA, 18 bp, Artificial sequence
  synthetic polynucleotide sequence
ccaatgaagtggaccgca

SEQ ID NO: 11644 - DNA, 18 bp, Artificial sequence
  synthetic polynucleotide sequence
tgccacaagtgtcagcca

SEQ ID NO: 11645 - DNA, 18 bp, Artificial sequence
  synthetic polynucleotide sequence
ggtgggcgacgtgaagga

SEQ ID NO: 11646 - DNA, 18 bp, Artificial sequence
  synthetic polynucleotide sequence
tggctccagctgacagca

SEQ ID NO: 11647 - DNA, 18 bp, Artificial sequence
  synthetic polynucleotide sequence
tccagttcagggccagga

SEQ ID NO: 11648 - DNA, 18 bp, Artificial sequence
  synthetic polynucleotide sequence
ggacaatggacgagggca

SEQ ID NO: 11649 - DNA, 18 bp, Artificial sequence
  synthetic polynucleotide sequence
gcaacgttggtgcaggca

SEQ ID NO: 11650 - DNA, 18 bp, Artificial sequence
  synthetic polynucleotide sequence
ccacaccgttgcgggaca

SEQ ID NO: 11651 - DNA, 18 bp, Artificial sequence
  synthetic polynucleotide sequence
gactgaggacgcagacca

SEQ ID NO: 11652 - DNA, 18 bp, Artificial sequence
  synthetic polynucleotide sequence
ggcagggccagtgagaga

SEQ ID NO: 11653 - DNA, 18 bp, Artificial sequence
  synthetic polynucleotide sequence
tcggagcaggacgaggta

SEQ ID NO: 11654 - DNA, 18 bp, Artificial sequence
  synthetic polynucleotide sequence
gcaggaatgagagagcca

SEQ ID NO: 11655 - DNA, 18 bp, Artificial sequence
  synthetic polynucleotide sequence
ctccctcaaggaagccca

SEQ ID NO: 11656 - DNA, 18 bp, Artificial sequence
  synthetic polynucleotide sequence
ctacccagacgagctgca

SEQ ID NO: 11657 - DNA, 18 bp, Artificial sequence
  synthetic polynucleotide sequence
tccacagccataccccca

SEQ ID NO: 11658 - DNA, 18 bp, Artificial sequence
  synthetic polynucleotide sequence
tccacagccataccccca

SEQ ID NO: 11659 - DNA, 18 bp, Artificial sequence
  synthetic polynucleotide sequence
gcacagctgaggagcaca

SEQ ID NO: 11660 - DNA, 18 bp, Artificial sequence
  synthetic polynucleotide sequence
gacaaggctgagagccca

SEQ ID NO: 11661 - DNA, 18 bp, Artificial sequence
  synthetic polynucleotide sequence
tgcccaaggcgggaagga

SEQ ID NO: 11662 - DNA, 18 bp, Artificial sequence
  synthetic polynucleotide sequence
ccgattgggccgaccaca

SEQ ID NO: 11663 - DNA, 18 bp, Artificial sequence
  synthetic polynucleotide sequence
aaggtgcctgtgcagaca

SEQ ID NO: 11664 - DNA, 18 bp, Artificial sequence
  synthetic polynucleotide sequence
ccagcctgagatccagca

SEQ ID NO: 11665 - DNA, 18 bp, Artificial sequence
  synthetic polynucleotide sequence
cagccatgcccgagcaga

SEQ ID NO: 11666 - DNA, 18 bp, Artificial sequence
  synthetic polynucleotide sequence
gcaggagggctcacccca

SEQ ID NO: 11667 - DNA, 18 bp, Artificial sequence
  synthetic polynucleotide sequence
cgaggagggcaagaagga

SEQ ID NO: 11668 - DNA, 18 bp, Artificial sequence
  synthetic polynucleotide sequence
ggcacagccctcacccca

SEQ ID NO: 11669 - DNA, 18 bp, Artificial sequence
  synthetic polynucleotide sequence
ctccctcaaggaagccca

SEQ ID NO: 11670 - DNA, 18 bp, Artificial sequence
  synthetic polynucleotide sequence
tgctgactacccagacga

SEQ ID NO: 11671 - DNA, 18 bp, Artificial sequence
  synthetic polynucleotide sequence
gacgcgagcctgaatcca

SEQ ID NO: 11672 - DNA, 18 bp, Artificial sequence
  synthetic polynucleotide sequence
cgtggtgagctggggcaa

SEQ ID NO: 11673 - DNA, 18 bp, Artificial sequence
  synthetic polynucleotide sequence
cccgtgaatccagaggca

SEQ ID NO: 11674 - DNA, 18 bp, Artificial sequence
  synthetic polynucleotide sequence
ccacggggttcagaagga

SEQ ID NO: 11675 - DNA, 18 bp, Artificial sequence
  synthetic polynucleotide sequence
caggcctcttcaggacca

SEQ ID NO: 11676 - DNA, 18 bp, Artificial sequence
  synthetic polynucleotide sequence
caggcctcttcaggacca

SEQ ID NO: 11677 - DNA, 18 bp, Artificial sequence
  synthetic polynucleotide sequence
agaaaacagtggccgaca

SEQ ID NO: 11678 - DNA, 18 bp, Artificial sequence
  synthetic polynucleotide sequence
tgacagtagcaacggcca

SEQ ID NO: 11679 - DNA, 18 bp, Artificial sequence
  synthetic polynucleotide sequence
acctgctctacggacaca

SEQ ID NO: 11680 - DNA, 18 bp, Artificial sequence
  synthetic polynucleotide sequence
cggagtcgccctcacaca

SEQ ID NO: 11681 - DNA, 18 bp, Artificial sequence
  synthetic polynucleotide sequence
ggtgctgacggcaggcca

SEQ ID NO: 11682 - DNA, 18 bp, Artificial sequence
  synthetic polynucleotide sequence
tggagaagggcaaggtca

SEQ ID NO: 11683 - DNA, 18 bp, Artificial sequence
  synthetic polynucleotide sequence
cagaagagcgaggcccca

SEQ ID NO: 11684 - DNA, 18 bp, Artificial sequence
  synthetic polynucleotide sequence
gcagtgggagtgccagga

SEQ ID NO: 11685 - DNA, 18 bp, Artificial sequence
  synthetic polynucleotide sequence
agccctggtgtcagagga

SEQ ID NO: 11686 - DNA, 18 bp, Artificial sequence
  synthetic polynucleotide sequence
gagctgcttcaggcccca

SEQ ID NO: 11687 - DNA, 18 bp, Artificial sequence
  synthetic polynucleotide sequence
ccagggcacgtctcacca

SEQ ID NO: 11688 - DNA, 18 bp, Artificial sequence
  synthetic polynucleotide sequence
gcttgggggacccaggaa

SEQ ID NO: 11689 - DNA, 18 bp, Artificial sequence
  synthetic polynucleotide sequence
gactcccgagactgggga

SEQ ID NO: 11690 - DNA, 18 bp, Artificial sequence
  synthetic polynucleotide sequence
tgacccagctagagggca

SEQ ID NO: 11691 - DNA, 18 bp, Artificial sequence
  synthetic polynucleotide sequence
atggggagaggaggccca

SEQ ID NO: 11692 - DNA, 18 bp, Artificial sequence
  synthetic polynucleotide sequence
caacctctgtggcagcca

SEQ ID NO: 11693 - DNA, 18 bp, Artificial sequence
  synthetic polynucleotide sequence
agtactgccagctccaca

SEQ ID NO: 11694 - DNA, 18 bp, Artificial sequence
  synthetic polynucleotide sequence
agtactgccagctccaca

SEQ ID NO: 11695 - DNA, 18 bp, Artificial sequence
  synthetic polynucleotide sequence
gctgagcagcccagccaa

SEQ ID NO: 11696 - DNA, 18 bp, Artificial sequence
  synthetic polynucleotide sequence
gccggcagaagaaggtga

SEQ ID NO: 11697 - DNA, 18 bp, Artificial sequence
  synthetic polynucleotide sequence
gccctgcacaagaccaga

SEQ ID NO: 11698 - DNA, 18 bp, Artificial sequence
  synthetic polynucleotide sequence
gaccctcacccaagccga

SEQ ID NO: 11699 - DNA, 18 bp, Artificial sequence
  synthetic polynucleotide sequence
agcccgtgctgatcgaga

SEQ ID NO: 11700 - DNA, 18 bp, Artificial sequence
  synthetic polynucleotide sequence
caagggcttatgggccga

SEQ ID NO: 11701 - DNA, 18 bp, Artificial sequence
  synthetic polynucleotide sequence
acgcggagaaccagggca

SEQ ID NO: 11702 - DNA, 18 bp, Artificial sequence
  synthetic polynucleotide sequence
tatagggcagcggcagga

SEQ ID NO: 11703 - DNA, 18 bp, Artificial sequence
  synthetic polynucleotide sequence
cccgatgtcaagggagca

SEQ ID NO: 11704 - DNA, 18 bp, Artificial sequence
  synthetic polynucleotide sequence
ccagcaggtcatcacgga

SEQ ID NO: 11705 - DNA, 18 bp, Artificial sequence
  synthetic polynucleotide sequence
accagcatacgaagtgga

SEQ ID NO: 11706 - DNA, 18 bp, Artificial sequence
  synthetic polynucleotide sequence
cttcgactccagcaggca

SEQ ID NO: 11707 - DNA, 18 bp, Artificial sequence
  synthetic polynucleotide sequence
tgacaggcacaaacagca

SEQ ID NO: 11708 - DNA, 18 bp, Artificial sequence
  synthetic polynucleotide sequence
aagccaggagaacgagga

SEQ ID NO: 11709 - DNA, 18 bp, Artificial sequence
  synthetic polynucleotide sequence
aggtagtccccaagggca

SEQ ID NO: 11710 - DNA, 18 bp, Artificial sequence
  synthetic polynucleotide sequence
gcgagtgtccaatgagga

SEQ ID NO: 11711 - DNA, 18 bp, Artificial sequence
  synthetic polynucleotide sequence
gggtcactgcggatgcca

SEQ ID NO: 11712 - DNA, 18 bp, Artificial sequence
  synthetic polynucleotide sequence
gggtcactgcggatgcca

SEQ ID NO: 11713 - DNA, 18 bp, Artificial sequence
  synthetic polynucleotide sequence
acccgggaggacgcagga

SEQ ID NO: 11714 - DNA, 18 bp, Artificial sequence
  synthetic polynucleotide sequence
gcgtccggagtctcagga

SEQ ID NO: 11715 - DNA, 18 bp, Artificial sequence
  synthetic polynucleotide sequence
taaaccccagggaggcca

SEQ ID NO: 11716 - DNA, 18 bp, Artificial sequence
  synthetic polynucleotide sequence
atagggaggctctgacca

SEQ ID NO: 11717 - DNA, 18 bp, Artificial sequence
  synthetic polynucleotide sequence
ccactgcccaagtcacga

SEQ ID NO: 11718 - DNA, 18 bp, Artificial sequence
  synthetic polynucleotide sequence
accagatgtagccagcaa

SEQ ID NO: 11719 - DNA, 18 bp, Artificial sequence
  synthetic polynucleotide sequence
aggccatggaggctgtga

SEQ ID NO: 11720 - DNA, 18 bp, Artificial sequence
  synthetic polynucleotide sequence
gacagctgcaacctgtga

SEQ ID NO: 11721 - DNA, 18 bp, Artificial sequence
  synthetic polynucleotide sequence
ctacccagtgtcacgaga

SEQ ID NO: 11722 - DNA, 18 bp, Artificial sequence
  synthetic polynucleotide sequence
gggtcactgcgcatgcca

SEQ ID NO: 11723 - DNA, 18 bp, Artificial sequence
  synthetic polynucleotide sequence
ccctcggactgaccggga

SEQ ID NO: 11724 - DNA, 18 bp, Artificial sequence
  synthetic polynucleotide sequence
ccccagggagaagaagga

SEQ ID NO: 11725 - DNA, 18 bp, Artificial sequence
  synthetic polynucleotide sequence
tggatcagcagggatgca

SEQ ID NO: 11726 - DNA, 18 bp, Artificial sequence
  synthetic polynucleotide sequence
aatcagggacctctacca

SEQ ID NO: 11727 - DNA, 18 bp, Artificial sequence
  synthetic polynucleotide sequence
gggtaactgcggatgcca

SEQ ID NO: 11728 - DNA, 18 bp, Artificial sequence
  synthetic polynucleotide sequence
acccagggagaataagga

SEQ ID NO: 11729 - DNA, 18 bp, Artificial sequence
  synthetic polynucleotide sequence
gggttactgcggaggcca

SEQ ID NO: 11730 - DNA, 18 bp, Artificial sequence
  synthetic polynucleotide sequence
gggttactgcggaggcca

SEQ ID NO: 11731 - DNA, 18 bp, Artificial sequence
  synthetic polynucleotide sequence
agtggagaagaagcgaga

SEQ ID NO: 11732 - DNA, 18 bp, Artificial sequence
  synthetic polynucleotide sequence
gtgacctgaagtgaagca

SEQ ID NO: 11733 - DNA, 18 bp, Artificial sequence
  synthetic polynucleotide sequence
gcgcaatcagagcttgca

SEQ ID NO: 11734 - DNA, 18 bp, Artificial sequence
  synthetic polynucleotide sequence
caagacgagacacaggca

SEQ ID NO: 11735 - DNA, 18 bp, Artificial sequence
  synthetic polynucleotide sequence
gagccccgtccgtgggaa

SEQ ID NO: 11736 - DNA, 18 bp, Artificial sequence
  synthetic polynucleotide sequence
accagctgagctgtagga

SEQ ID NO: 11737 - DNA, 18 bp, Artificial sequence
  synthetic polynucleotide sequence
gtgaatgacggtgcgcaa

SEQ ID NO: 11738 - DNA, 18 bp, Artificial sequence
  synthetic polynucleotide sequence
gccgatggcacagcccca

SEQ ID NO: 11739 - DNA, 18 bp, Artificial sequence
  synthetic polynucleotide sequence
agagtgaccctagtggaa

SEQ ID NO: 11740 - DNA, 18 bp, Artificial sequence
  synthetic polynucleotide sequence
gacacagctgcagcgcta

SEQ ID NO: 11741 - DNA, 18 bp, Artificial sequence
  synthetic polynucleotide sequence
aacaaccaagaggcctca

SEQ ID NO: 11742 - DNA, 18 bp, Artificial sequence
  synthetic polynucleotide sequence
ggtacagagggcacgcta

SEQ ID NO: 11743 - DNA, 18 bp, Artificial sequence
  synthetic polynucleotide sequence
tgccacctgactgaacca

SEQ ID NO: 11744 - DNA, 18 bp, Artificial sequence
  synthetic polynucleotide sequence
tgccaagtcagtgcgcga

SEQ ID NO: 11745 - DNA, 18 bp, Artificial sequence
  synthetic polynucleotide sequence
agcggaacatgctccaca

SEQ ID NO: 11746 - DNA, 18 bp, Artificial sequence
  synthetic polynucleotide sequence
gaggctcagcaagtgcca

SEQ ID NO: 11747 - DNA, 18 bp, Artificial sequence
  synthetic polynucleotide sequence
agctcagtgtccgcagca

SEQ ID NO: 11748 - DNA, 18 bp, Artificial sequence
  synthetic polynucleotide sequence
agctcagtgtccgcagca

SEQ ID NO: 11749 - DNA, 18 bp, Artificial sequence
  synthetic polynucleotide sequence
cgtgagagggcagtggaa

SEQ ID NO: 11750 - DNA, 18 bp, Artificial sequence
  synthetic polynucleotide sequence
acactgaaggttggcaga

SEQ ID NO: 11751 - DNA, 18 bp, Artificial sequence
  synthetic polynucleotide sequence
tgaaggaaggtcggcaga

SEQ ID NO: 11752 - DNA, 18 bp, Artificial sequence
  synthetic polynucleotide sequence
tcaccatggggcagccga

SEQ ID NO: 11753 - DNA, 18 bp, Artificial sequence
  synthetic polynucleotide sequence
ccgtcgagccatctacca

SEQ ID NO: 11754 - DNA, 18 bp, Artificial sequence
  synthetic polynucleotide sequence
gagactcggatccagcca

SEQ ID NO: 11755 - DNA, 18 bp, Artificial sequence
  synthetic polynucleotide sequence
aagccatcgcagctggca

SEQ ID NO: 11756 - DNA, 18 bp, Artificial sequence
  synthetic polynucleotide sequence
tcacacctgtaccggcca

SEQ ID NO: 11757 - DNA, 18 bp, Artificial sequence
  synthetic polynucleotide sequence
tagccctgaagaggccta

SEQ ID NO: 11758 - DNA, 18 bp, Artificial sequence
  synthetic polynucleotide sequence
ggtgcagcaggtcactga

SEQ ID NO: 11759 - DNA, 18 bp, Artificial sequence
  synthetic polynucleotide sequence
cgatggtccacaccggca

SEQ ID NO: 11760 - DNA, 19 bp, Artificial sequence
  synthetic polynucleotide sequence
gcagcatataagccaggca

SEQ ID NO: 11761 - DNA, 18 bp, Artificial sequence
  synthetic polynucleotide sequence
actcgaatgaagcacgca

SEQ ID NO: 11762 - DNA, 18 bp, Artificial sequence
  synthetic polynucleotide sequence
tgatgcaggtggaagaga

SEQ ID NO: 11763 - DNA, 18 bp, Artificial sequence
  synthetic polynucleotide sequence
ggttcagaagctccagca

SEQ ID NO: 11764 - DNA, 18 bp, Artificial sequence
  synthetic polynucleotide sequence
ggatgccatcggcaccaa

SEQ ID NO: 11765 - DNA, 18 bp, Artificial sequence
  synthetic polynucleotide sequence
aggacttgaaggtcagca

SEQ ID NO: 11766 - DNA, 18 bp, Artificial sequence
  synthetic polynucleotide sequence
aggacttgaaggtcagca

SEQ ID NO: 11767 - DNA, 18 bp, Artificial sequence
  synthetic polynucleotide sequence
acgcggacatcggaggca

SEQ ID NO: 11768 - DNA, 18 bp, Artificial sequence
  synthetic polynucleotide sequence
ccacagccaggtgggcca

SEQ ID NO: 11769 - DNA, 18 bp, Artificial sequence
  synthetic polynucleotide sequence
tcctaaccatgccggaga

SEQ ID NO: 11770 - DNA, 18 bp, Artificial sequence
  synthetic polynucleotide sequence
ctgccacaggttccacca

SEQ ID NO: 11771 - DNA, 18 bp, Artificial sequence
  synthetic polynucleotide sequence
catgctcaacaccccaga

SEQ ID NO: 11772 - DNA, 18 bp, Artificial sequence
  synthetic polynucleotide sequence
gctagcctgagccacgca

SEQ ID NO: 11773 - DNA, 18 bp, Artificial sequence
  synthetic polynucleotide sequence
gtccaaaaggcggagtca

SEQ ID NO: 11774 - DNA, 18 bp, Artificial sequence
  synthetic polynucleotide sequence
gtcagtcgcgcacgctca

SEQ ID NO: 11775 - DNA, 18 bp, Artificial sequence
  synthetic polynucleotide sequence
acctgggtgcagccccga

SEQ ID NO: 11776 - DNA, 18 bp, Artificial sequence
  synthetic polynucleotide sequence
gggcctggtgctccacca

SEQ ID NO: 11777 - DNA, 18 bp, Artificial sequence
  synthetic polynucleotide sequence
ggaactccagcacggcca

SEQ ID NO: 11778 - DNA, 18 bp, Artificial sequence
  synthetic polynucleotide sequence
ccaggggccacctacaga

SEQ ID NO: 11779 - DNA, 18 bp, Artificial sequence
  synthetic polynucleotide sequence
cagtgagcagtccagcca

SEQ ID NO: 11780 - DNA, 18 bp, Artificial sequence
  synthetic polynucleotide sequence
ggctgcaatgctgcgcca

SEQ ID NO: 11781 - DNA, 18 bp, Artificial sequence
  synthetic polynucleotide sequence
gagtgagcgcttgaggga

SEQ ID NO: 11782 - DNA, 18 bp, Artificial sequence
  synthetic polynucleotide sequence
aaggcccctcagcacaca

SEQ ID NO: 11783 - DNA, 18 bp, Artificial sequence
  synthetic polynucleotide sequence
gtgcagggcgaccacgga

SEQ ID NO: 11784 - DNA, 18 bp, Artificial sequence
  synthetic polynucleotide sequence
gtgcagggcgaccacgga

SEQ ID NO: 11785 - DNA, 18 bp, Artificial sequence
  synthetic polynucleotide sequence
ggctgcctgccaaggaca

SEQ ID NO: 11786 - DNA, 18 bp, Artificial sequence
  synthetic polynucleotide sequence
atgcacccagcgatctca

SEQ ID NO: 11787 - DNA, 18 bp, Artificial sequence
  synthetic polynucleotide sequence
aggcccacaaagaggcca

SEQ ID NO: 11788 - DNA, 18 bp, Artificial sequence
  synthetic polynucleotide sequence
ccgaactccacaatctca

SEQ ID NO: 11789 - DNA, 18 bp, Artificial sequence
  synthetic polynucleotide sequence
agcagccaagcagcccca

SEQ ID NO: 11790 - DNA, 18 bp, Artificial sequence
  synthetic polynucleotide sequence
ccatgaccatcagccgga

SEQ ID NO: 11791 - DNA, 18 bp, Artificial sequence
  synthetic polynucleotide sequence
aggtgctggagagggtga

SEQ ID NO: 11792 - DNA, 18 bp, Artificial sequence
  synthetic polynucleotide sequence
atgcaccaaggcccggta

SEQ ID NO: 11793 - DNA, 18 bp, Artificial sequence
  synthetic polynucleotide sequence
gctgaaaagcaaccagca

SEQ ID NO: 11794 - DNA, 18 bp, Artificial sequence
  synthetic polynucleotide sequence
aatcaggagctgtaccca

SEQ ID NO: 11795 - DNA, 18 bp, Artificial sequence
  synthetic polynucleotide sequence
caatggacaacacgccga

SEQ ID NO: 11796 - DNA, 18 bp, Artificial sequence
  synthetic polynucleotide sequence
cctcagaatccaccggca

SEQ ID NO: 11797 - DNA, 18 bp, Artificial sequence
  synthetic polynucleotide sequence
tccacctcaggggcagga

SEQ ID NO: 11798 - DNA, 18 bp, Artificial sequence
  synthetic polynucleotide sequence
tgaaccgcctagaacgga

SEQ ID NO: 11799 - DNA, 18 bp, Artificial sequence
  synthetic polynucleotide sequence
agcatcagcaggaggaca

SEQ ID NO: 11800 - DNA, 18 bp, Artificial sequence
  synthetic polynucleotide sequence
gacgcagccaacagctga

SEQ ID NO: 11801 - DNA, 18 bp, Artificial sequence
  synthetic polynucleotide sequence
gcacatgctggactcgga

SEQ ID NO: 11802 - DNA, 18 bp, Artificial sequence
  synthetic polynucleotide sequence
gcacatgctggactcgga

SEQ ID NO: 11803 - DNA, 18 bp, Artificial sequence
  synthetic polynucleotide sequence
ccatcgcagtgcaggaga

SEQ ID NO: 11804 - DNA, 18 bp, Artificial sequence
  synthetic polynucleotide sequence
cctctccacagtccacca

SEQ ID NO: 11805 - DNA, 18 bp, Artificial sequence
  synthetic polynucleotide sequence
ccaacacagtgcccgaca

SEQ ID NO: 11806 - DNA, 18 bp, Artificial sequence
  synthetic polynucleotide sequence
ccgtgcacaccatccaca

SEQ ID NO: 11807 - DNA, 18 bp, Artificial sequence
  synthetic polynucleotide sequence
caacctgcattggaccca

SEQ ID NO: 11808 - DNA, 18 bp, Artificial sequence
  synthetic polynucleotide sequence
agactccaggcataccca

SEQ ID NO: 11809 - DNA, 18 bp, Artificial sequence
  synthetic polynucleotide sequence
tggccaggtcaccactga

SEQ ID NO: 11810 - DNA, 18 bp, Artificial sequence
  synthetic polynucleotide sequence
ggaaggtgcgacggctga

SEQ ID NO: 11811 - DNA, 18 bp, Artificial sequence
  synthetic polynucleotide sequence
ccgccctgaaggaacgaa

SEQ ID NO: 11812 - DNA, 18 bp, Artificial sequence
  synthetic polynucleotide sequence
gagggctcctggtcacca

SEQ ID NO: 11813 - DNA, 18 bp, Artificial sequence
  synthetic polynucleotide sequence
ggaagacagcgcacacga

SEQ ID NO: 11814 - DNA, 18 bp, Artificial sequence
  synthetic polynucleotide sequence
ggtccacgacaaagccga

SEQ ID NO: 11815 - DNA, 18 bp, Artificial sequence
  synthetic polynucleotide sequence
ccaggatggacagcagca

SEQ ID NO: 11816 - DNA, 18 bp, Artificial sequence
  synthetic polynucleotide sequence
gatggggccatctccaca

SEQ ID NO: 11817 - DNA, 20 bp, Artificial sequence
  synthetic polynucleotide sequence
gcaagttccgccactgaaca

SEQ ID NO: 11818 - DNA, 20 bp, Artificial sequence
  synthetic polynucleotide sequence
ggggaagtaaggaccagaga

SEQ ID NO: 11819 - DNA, 18 bp, Artificial sequence
  synthetic polynucleotide sequence
cgaacttcccgaagccca

SEQ ID NO: 11820 - DNA, 18 bp, Artificial sequence
  synthetic polynucleotide sequence
cgaacttcccgaagccca

SEQ ID NO: 11821 - DNA, 18 bp, Artificial sequence
  synthetic polynucleotide sequence
gccacagcaacaccagca

SEQ ID NO: 11822 - DNA, 18 bp, Artificial sequence
  synthetic polynucleotide sequence
tgcggcagcccaccacga

SEQ ID NO: 11823 - DNA, 18 bp, Artificial sequence
  synthetic polynucleotide sequence
gctcctacagctaccgga

SEQ ID NO: 11824 - DNA, 18 bp, Artificial sequence
  synthetic polynucleotide sequence
gctgtacagcagcgcgta

SEQ ID NO: 11825 - DNA, 18 bp, Artificial sequence
  synthetic polynucleotide sequence
cgtggagatggtgggcca

SEQ ID NO: 11826 - DNA, 18 bp, Artificial sequence
  synthetic polynucleotide sequence
ggcgaagcagttggcgca

SEQ ID NO: 11827 - DNA, 18 bp, Artificial sequence
  synthetic polynucleotide sequence
aggagacggaccacctca

SEQ ID NO: 11828 - DNA, 18 bp, Artificial sequence
  synthetic polynucleotide sequence
ggaggcctaaggatggca

SEQ ID NO: 11829 - DNA, 18 bp, Artificial sequence
  synthetic polynucleotide sequence
gggccagtacaccgtcca

SEQ ID NO: 11830 - DNA, 18 bp, Artificial sequence
  synthetic polynucleotide sequence
ggtggccaggttgcagga

SEQ ID NO: 11831 - DNA, 15 bp, Artificial sequence
  synthetic polynucleotide sequence
gacagccagcccaca

SEQ ID NO: 11832 - DNA, 15 bp, Artificial sequence
  synthetic polynucleotide sequence
cggctgaacagccca

SEQ ID NO: 11833 - DNA, 18 bp, Artificial sequence
  synthetic polynucleotide sequence
tgtaggtcacggagcgga

SEQ ID NO: 11834 - DNA, 18 bp, Artificial sequence
  synthetic polynucleotide sequence
ggaacgacatggagacca

SEQ ID NO: 11835 - DNA, 18 bp, Artificial sequence
  synthetic polynucleotide sequence
gaagtcgacactaagcca

SEQ ID NO: 11836 - DNA, 18 bp, Artificial sequence
  synthetic polynucleotide sequence
ggagaatctggccagtca

SEQ ID NO: 11837 - DNA, 18 bp, Artificial sequence
  synthetic polynucleotide sequence
ggccaaaagcagaaacga

SEQ ID NO: 11838 - DNA, 18 bp, Artificial sequence
  synthetic polynucleotide sequence
ggccaaaagcagaaacga

SEQ ID NO: 11839 - DNA, 18 bp, Artificial sequence
  synthetic polynucleotide sequence
ggcagaaggaggcagaga

SEQ ID NO: 11840 - DNA, 18 bp, Artificial sequence
  synthetic polynucleotide sequence
gacaggacaggagcccga

SEQ ID NO: 11841 - DNA, 18 bp, Artificial sequence
  synthetic polynucleotide sequence
gcgcaccggagaggacga

SEQ ID NO: 11842 - DNA, 18 bp, Artificial sequence
  synthetic polynucleotide sequence
gcgtagaagcggaaggca

SEQ ID NO: 11843 - DNA, 18 bp, Artificial sequence
  synthetic polynucleotide sequence
cgaccactctcccacaga

SEQ ID NO: 11844 - DNA, 18 bp, Artificial sequence
  synthetic polynucleotide sequence
aggaggaggcggtcacca

SEQ ID NO: 11845 - DNA, 18 bp, Artificial sequence
  synthetic polynucleotide sequence
gctggacaacgcactcca

SEQ ID NO: 11846 - DNA, 18 bp, Artificial sequence
  synthetic polynucleotide sequence
tccacccttcacaccaca

SEQ ID NO: 11847 - DNA, 18 bp, Artificial sequence
  synthetic polynucleotide sequence
cggagtactggaagccga

SEQ ID NO: 11848 - DNA, 18 bp, Artificial sequence
  synthetic polynucleotide sequence
gatggtcgctccacagca

SEQ ID NO: 11849 - DNA, 18 bp, Artificial sequence
  synthetic polynucleotide sequence
atctagtccggagcggga

SEQ ID NO: 11850 - DNA, 18 bp, Artificial sequence
  synthetic polynucleotide sequence
cctactggaagccaagca

SEQ ID NO: 11851 - DNA, 18 bp, Artificial sequence
  synthetic polynucleotide sequence
ggacgccagggacacgga

SEQ ID NO: 11852 - DNA, 18 bp, Artificial sequence
  synthetic polynucleotide sequence
caacaggacgtgggccaa

SEQ ID NO: 11853 - DNA, 18 bp, Artificial sequence
  synthetic polynucleotide sequence
ccagagtctaaccaggca

SEQ ID NO: 11854 - DNA, 18 bp, Artificial sequence
  synthetic polynucleotide sequence
ggagacgtacaaagagca

SEQ ID NO: 11855 - DNA, 18 bp, Artificial sequence
  synthetic polynucleotide sequence
gagctcacccaggtcaga

SEQ ID NO: 11856 - DNA, 18 bp, Artificial sequence
  synthetic polynucleotide sequence
gagctcacccaggtcaga

SEQ ID NO: 11857 - DNA, 18 bp, Artificial sequence
  synthetic polynucleotide sequence
tacagaccccctccgcaa

SEQ ID NO: 11858 - DNA, 18 bp, Artificial sequence
  synthetic polynucleotide sequence
gctggtgagcgtaggaga

SEQ ID NO: 11859 - DNA, 18 bp, Artificial sequence
  synthetic polynucleotide sequence
agctcatggccaagggca

SEQ ID NO: 11860 - DNA, 18 bp, Artificial sequence
  synthetic polynucleotide sequence
taagcctggctaacccga

SEQ ID NO: 11861 - DNA, 18 bp, Artificial sequence
  synthetic polynucleotide sequence
ccctcagcaccaagcaga

SEQ ID NO: 11862 - DNA, 18 bp, Artificial sequence
  synthetic polynucleotide sequence
tgaggcccagggcagaca

SEQ ID NO: 11863 - DNA, 18 bp, Artificial sequence
  synthetic polynucleotide sequence
gagagctgccgaagagga

SEQ ID NO: 11864 - DNA, 17 bp, Artificial sequence
  synthetic polynucleotide sequence
agggatggggcaggaca

SEQ ID NO: 11865 - DNA, 18 bp, Artificial sequence
  synthetic polynucleotide sequence
ggagctgagtgcaagcaa

SEQ ID NO: 11866 - DNA, 18 bp, Artificial sequence
  synthetic polynucleotide sequence
ccaggcctggaactggta

SEQ ID NO: 11867 - DNA, 18 bp, Artificial sequence
  synthetic polynucleotide sequence
gccagtccacaacggtga

SEQ ID NO: 11868 - DNA, 18 bp, Artificial sequence
  synthetic polynucleotide sequence
ccaacgccacgctcagca

SEQ ID NO: 11869 - DNA, 18 bp, Artificial sequence
  synthetic polynucleotide sequence
ccgtgaggaccgtagcca

SEQ ID NO: 11870 - DNA, 18 bp, Artificial sequence
  synthetic polynucleotide sequence
gccaaaggggagccgtca

SEQ ID NO: 11871 - DNA, 18 bp, Artificial sequence
  synthetic polynucleotide sequence
ttggagtacaaggcggga

SEQ ID NO: 11872 - DNA, 18 bp, Artificial sequence
  synthetic polynucleotide sequence
caagaggaaagggcacga

SEQ ID NO: 11873 - DNA, 18 bp, Artificial sequence
  synthetic polynucleotide sequence
aagggggagaaggtgtca

SEQ ID NO: 11874 - DNA, 18 bp, Artificial sequence
  synthetic polynucleotide sequence
aagggggagaaggtgtca

SEQ ID NO: 11875 - DNA, 18 bp, Artificial sequence
  synthetic polynucleotide sequence
ggtccgtcgccataccaa

SEQ ID NO: 11876 - DNA, 18 bp, Artificial sequence
  synthetic polynucleotide sequence
gcctcagcatcatgggca

SEQ ID NO: 11877 - DNA, 18 bp, Artificial sequence
  synthetic polynucleotide sequence
aggtgctggacatcccga

SEQ ID NO: 11878 - DNA, 18 bp, Artificial sequence
  synthetic polynucleotide sequence
ggcagagagtctgcacca

SEQ ID NO: 11879 - DNA, 18 bp, Artificial sequence
  synthetic polynucleotide sequence
ggcctccaagtggtacca

SEQ ID NO: 11880 - DNA, 18 bp, Artificial sequence
  synthetic polynucleotide sequence
gaggatgttggcaacaga

SEQ ID NO: 11881 - DNA, 18 bp, Artificial sequence
  synthetic polynucleotide sequence
gcctggcctgaccatgga

SEQ ID NO: 11882 - DNA, 18 bp, Artificial sequence
  synthetic polynucleotide sequence
ccagcactgcaatggaca

SEQ ID NO: 11883 - DNA, 18 bp, Artificial sequence
  synthetic polynucleotide sequence
tgtgaccaactgcgggga

SEQ ID NO: 11884 - DNA, 18 bp, Artificial sequence
  synthetic polynucleotide sequence
aagctgaggacaccccca

SEQ ID NO: 11885 - DNA, 18 bp, Artificial sequence
  synthetic polynucleotide sequence
gcaccaccttgtagcaga

SEQ ID NO: 11886 - DNA, 18 bp, Artificial sequence
  synthetic polynucleotide sequence
agtcagggaaccacccca

SEQ ID NO: 11887 - DNA, 18 bp, Artificial sequence
  synthetic polynucleotide sequence
ccacgtgatggccaagga

SEQ ID NO: 11888 - DNA, 18 bp, Artificial sequence
  synthetic polynucleotide sequence
gtcacagcggagagcaga

SEQ ID NO: 11889 - DNA, 18 bp, Artificial sequence
  synthetic polynucleotide sequence
gtgcgcccaacaccagca

SEQ ID NO: 11890 - DNA, 18 bp, Artificial sequence
  synthetic polynucleotide sequence
caccagctggccagacca

SEQ ID NO: 11891 - DNA, 18 bp, Artificial sequence
  synthetic polynucleotide sequence
gctggacgcctctccaca

SEQ ID NO: 11892 - DNA, 18 bp, Artificial sequence
  synthetic polynucleotide sequence
gctggacgcctctccaca

SEQ ID NO: 11893 - DNA, 18 bp, Artificial sequence
  synthetic polynucleotide sequence
ggagcatggagaggagca

SEQ ID NO: 11894 - DNA, 18 bp, Artificial sequence
  synthetic polynucleotide sequence
acccaggccttgagggga

SEQ ID NO: 11895 - DNA, 18 bp, Artificial sequence
  synthetic polynucleotide sequence
aggccagggtcatccaga

SEQ ID NO: 11896 - DNA, 18 bp, Artificial sequence
  synthetic polynucleotide sequence
cctccgtcagcatcacga

SEQ ID NO: 11897 - DNA, 18 bp, Artificial sequence
  synthetic polynucleotide sequence
ggagctcaccaaggagga

SEQ ID NO: 11898 - DNA, 18 bp, Artificial sequence
  synthetic polynucleotide sequence
agcgaggagatggccaca

SEQ ID NO: 11899 - DNA, 18 bp, Artificial sequence
  synthetic polynucleotide sequence
gatcccaagaggcccgaa

SEQ ID NO: 11900 - DNA, 18 bp, Artificial sequence
  synthetic polynucleotide sequence
gaaggatgaggcacacga

SEQ ID NO: 11901 - DNA, 18 bp, Artificial sequence
  synthetic polynucleotide sequence
gcgaatggcacagaagga

SEQ ID NO: 11902 - DNA, 18 bp, Artificial sequence
  synthetic polynucleotide sequence
atgacagcgcgaggctca

SEQ ID NO: 11903 - DNA, 18 bp, Artificial sequence
  synthetic polynucleotide sequence
cccacagtgaacggggca

SEQ ID NO: 11904 - DNA, 18 bp, Artificial sequence
  synthetic polynucleotide sequence
agagagaagccggagcca

SEQ ID NO: 11905 - DNA, 18 bp, Artificial sequence
  synthetic polynucleotide sequence
ggacacaactgggcagga

SEQ ID NO: 11906 - DNA, 18 bp, Artificial sequence
  synthetic polynucleotide sequence
cgatggggagagcagcaa

SEQ ID NO: 11907 - DNA, 18 bp, Artificial sequence
  synthetic polynucleotide sequence
gggcatggtcatagggca

SEQ ID NO: 11908 - DNA, 18 bp, Artificial sequence
  synthetic polynucleotide sequence
gcctaccaagcagagcca

SEQ ID NO: 11909 - DNA, 18 bp, Artificial sequence
  synthetic polynucleotide sequence
tcccacgccagcactgca

SEQ ID NO: 11910 - DNA, 18 bp, Artificial sequence
  synthetic polynucleotide sequence
tcccacgccagcactgca

SEQ ID NO: 11911 - DNA, 18 bp, Artificial sequence
  synthetic polynucleotide sequence
tccactgcagtgcaggaa

SEQ ID NO: 11912 - DNA, 18 bp, Artificial sequence
  synthetic polynucleotide sequence
tcatacaggcacagagca

SEQ ID NO: 11913 - DNA, 18 bp, Artificial sequence
  synthetic polynucleotide sequence
gttcacagactggccgga

SEQ ID NO: 11914 - DNA, 18 bp, Artificial sequence
  synthetic polynucleotide sequence
ccacgccttcataccgca

SEQ ID NO: 11915 - DNA, 18 bp, Artificial sequence
  synthetic polynucleotide sequence
ctgccgacaaacccacca

SEQ ID NO: 11916 - DNA, 18 bp, Artificial sequence
  synthetic polynucleotide sequence
gctgcagcaagtcagcca

SEQ ID NO: 11917 - DNA, 18 bp, Artificial sequence
  synthetic polynucleotide sequence
gtgtcagccgctacacca

SEQ ID NO: 11918 - DNA, 18 bp, Artificial sequence
  synthetic polynucleotide sequence
ctgcaatcccactgggca

SEQ ID NO: 11919 - DNA, 18 bp, Artificial sequence
  synthetic polynucleotide sequence
gaggagtgacggcaggaa

SEQ ID NO: 11920 - DNA, 18 bp, Artificial sequence
  synthetic polynucleotide sequence
tcaggcaatgctgcacca

SEQ ID NO: 11921 - DNA, 18 bp, Artificial sequence
  synthetic polynucleotide sequence
ccacctggccctcgcgga

SEQ ID NO: 11922 - DNA, 18 bp, Artificial sequence
  synthetic polynucleotide sequence
gcgggacaagttgcgcaa

SEQ ID NO: 11923 - DNA, 18 bp, Artificial sequence
  synthetic polynucleotide sequence
gcatgagagcactgggca

SEQ ID NO: 11924 - DNA, 18 bp, Artificial sequence
  synthetic polynucleotide sequence
gagcaagacacacacaga

SEQ ID NO: 11925 - DNA, 18 bp, Artificial sequence
  synthetic polynucleotide sequence
cccatggtggagagggca

SEQ ID NO: 11926 - DNA, 18 bp, Artificial sequence
  synthetic polynucleotide sequence
ccttgacgaggagagaga

SEQ ID NO: 11927 - DNA, 18 bp, Artificial sequence
  synthetic polynucleotide sequence
aactccccagcgtgcaga

SEQ ID NO: 11928 - DNA, 18 bp, Artificial sequence
  synthetic polynucleotide sequence
aactccccagcgtgcaga

SEQ ID NO: 11929 - DNA, 18 bp, Artificial sequence
  synthetic polynucleotide sequence
gtgaactggcggctacca

SEQ ID NO: 11930 - DNA, 18 bp, Artificial sequence
  synthetic polynucleotide sequence
gccaccacccacacagca

SEQ ID NO: 11931 - DNA, 18 bp, Artificial sequence
  synthetic polynucleotide sequence
caaacgcctccaccagga

SEQ ID NO: 11932 - DNA, 18 bp, Artificial sequence
  synthetic polynucleotide sequence
actggccgtccagcagca

SEQ ID NO: 11933 - DNA, 18 bp, Artificial sequence
  synthetic polynucleotide sequence
ccgtgacgctctggccaa

SEQ ID NO: 11934 - DNA, 18 bp, Artificial sequence
  synthetic polynucleotide sequence
gtagggcacggtgatgga

SEQ ID NO: 11935 - DNA, 18 bp, Artificial sequence
  synthetic polynucleotide sequence
caccatcatcggcaccga

SEQ ID NO: 11936 - DNA, 18 bp, Artificial sequence
  synthetic polynucleotide sequence
tgagagcggtggcactga

SEQ ID NO: 11937 - DNA, 18 bp, Artificial sequence
  synthetic polynucleotide sequence
gaggaggatgagctggga

SEQ ID NO: 11938 - DNA, 18 bp, Artificial sequence
  synthetic polynucleotide sequence
ctccagcagccatcagca

SEQ ID NO: 11939 - DNA, 18 bp, Artificial sequence
  synthetic polynucleotide sequence
tggcgagctcctagggca

SEQ ID NO: 11940 - DNA, 18 bp, Artificial sequence
  synthetic polynucleotide sequence
agcaacccagagcccaca

SEQ ID NO: 11941 - DNA, 18 bp, Artificial sequence
  synthetic polynucleotide sequence
ccgggaccagtgtgagga

SEQ ID NO: 11942 - DNA, 18 bp, Artificial sequence
  synthetic polynucleotide sequence
ccccacccacgctgcaca

SEQ ID NO: 11943 - DNA, 18 bp, Artificial sequence
  synthetic polynucleotide sequence
cctccacacccttgggga

SEQ ID NO: 11944 - DNA, 18 bp, Artificial sequence
  synthetic polynucleotide sequence
actggtacctgcagcgga

SEQ ID NO: 11945 - DNA, 18 bp, Artificial sequence
  synthetic polynucleotide sequence
ccgccgtgagatgaggga

SEQ ID NO: 11946 - DNA, 18 bp, Artificial sequence
  synthetic polynucleotide sequence
ccgccgtgagatgaggga

SEQ ID NO: 11947 - DNA, 20 bp, Artificial sequence
  synthetic polynucleotide sequence
gatttgctagaggaaggcga

SEQ ID NO: 11948 - DNA, 19 bp, Artificial sequence
  synthetic polynucleotide sequence
ccaacctgctccacacaga

SEQ ID NO: 11949 - DNA, 18 bp, Artificial sequence
  synthetic polynucleotide sequence
ccgcagcatgaatgggca

SEQ ID NO: 11950 - DNA, 18 bp, Artificial sequence
  synthetic polynucleotide sequence
ctcacagaggcctcagca

SEQ ID NO: 11951 - DNA, 18 bp, Artificial sequence
  synthetic polynucleotide sequence
ggcgattcagtgggcaga

SEQ ID NO: 11952 - DNA, 18 bp, Artificial sequence
  synthetic polynucleotide sequence
cagctgaagcagtcacga

SEQ ID NO: 11953 - DNA, 18 bp, Artificial sequence
  synthetic polynucleotide sequence
ccacggtgtcgcaactga

SEQ ID NO: 11954 - DNA, 18 bp, Artificial sequence
  synthetic polynucleotide sequence
atccatgaggaccccgga

SEQ ID NO: 11955 - DNA, 18 bp, Artificial sequence
  synthetic polynucleotide sequence
ctgtccccagggtccaca

SEQ ID NO: 11956 - DNA, 18 bp, Artificial sequence
  synthetic polynucleotide sequence
cgccgactcactggcaca

SEQ ID NO: 11957 - DNA, 18 bp, Artificial sequence
  synthetic polynucleotide sequence
cagtcaggtgggccacga

SEQ ID NO: 11958 - DNA, 18 bp, Artificial sequence
  synthetic polynucleotide sequence
gtgacgcctcaggacaga

SEQ ID NO: 11959 - DNA, 18 bp, Artificial sequence
  synthetic polynucleotide sequence
tcaggactgggacaggga

SEQ ID NO: 11960 - DNA, 18 bp, Artificial sequence
  synthetic polynucleotide sequence
tccaaggaaggccgagga

SEQ ID NO: 11961 - DNA, 18 bp, Artificial sequence
  synthetic polynucleotide sequence
tggcgaagagcacccgga

SEQ ID NO: 11962 - DNA, 18 bp, Artificial sequence
  synthetic polynucleotide sequence
gaggggaaagacgcctca

SEQ ID NO: 11963 - DNA, 18 bp, Artificial sequence
  synthetic polynucleotide sequence
cttgaggcagaaggcaca

SEQ ID NO: 11964 - DNA, 18 bp, Artificial sequence
  synthetic polynucleotide sequence
cttgaggcagaaggcaca

SEQ ID NO: 11965 - DNA, 18 bp, Artificial sequence
  synthetic polynucleotide sequence
ccttggacctcaccgaca

SEQ ID NO: 11966 - DNA, 18 bp, Artificial sequence
  synthetic polynucleotide sequence
cgtacagagcatccagca

SEQ ID NO: 11967 - DNA, 18 bp, Artificial sequence
  synthetic polynucleotide sequence
agaacagcacccaggcca

SEQ ID NO: 11968 - DNA, 18 bp, Artificial sequence
  synthetic polynucleotide sequence
gcagctcccgtgtgcgga

SEQ ID NO: 11969 - DNA, 18 bp, Artificial sequence
  synthetic polynucleotide sequence
ccccaaggagtggaccaa

SEQ ID NO: 11970 - DNA, 18 bp, Artificial sequence
  synthetic polynucleotide sequence
aggtcggagggctccaca

SEQ ID NO: 11971 - DNA, 18 bp, Artificial sequence
  synthetic polynucleotide sequence
gaagctgctccctcgaca

SEQ ID NO: 11972 - DNA, 18 bp, Artificial sequence
  synthetic polynucleotide sequence
gccacgccattcacagca

SEQ ID NO: 11973 - DNA, 18 bp, Artificial sequence
  synthetic polynucleotide sequence
caagagagtggacgcgga

SEQ ID NO: 11974 - DNA, 18 bp, Artificial sequence
  synthetic polynucleotide sequence
ggaaggctccacacccca

SEQ ID NO: 11975 - DNA, 18 bp, Artificial sequence
  synthetic polynucleotide sequence
gcctcacataagatggca

SEQ ID NO: 11976 - DNA, 18 bp, Artificial sequence
  synthetic polynucleotide sequence
gcagaataagccacgaca

SEQ ID NO: 11977 - DNA, 18 bp, Artificial sequence
  synthetic polynucleotide sequence
gcagagatcgcaggccca

SEQ ID NO: 11978 - DNA, 18 bp, Artificial sequence
  synthetic polynucleotide sequence
accgtgagtgcacaggca

SEQ ID NO: 11979 - DNA, 18 bp, Artificial sequence
  synthetic polynucleotide sequence
gaggtagtggcgcaggga

SEQ ID NO: 11980 - DNA, 18 bp, Artificial sequence
  synthetic polynucleotide sequence
ctaccccatcaaacccga

SEQ ID NO: 11981 - DNA, 18 bp, Artificial sequence
  synthetic polynucleotide sequence
gggccgtgagataagcga

SEQ ID NO: 11982 - DNA, 18 bp, Artificial sequence
  synthetic polynucleotide sequence
gggccgtgagataagcga

SEQ ID NO: 11983 - DNA, 18 bp, Artificial sequence
  synthetic polynucleotide sequence
aaggaggagccagagcca

SEQ ID NO: 11984 - DNA, 18 bp, Artificial sequence
  synthetic polynucleotide sequence
ctgcaggtcacctccaga

SEQ ID NO: 11985 - DNA, 18 bp, Artificial sequence
  synthetic polynucleotide sequence
atcgaccatctccagcca

SEQ ID NO: 11986 - DNA, 18 bp, Artificial sequence
  synthetic polynucleotide sequence
tggccatgccgtacccga

SEQ ID NO: 11987 - DNA, 18 bp, Artificial sequence
  synthetic polynucleotide sequence
tcagcaccctcaatccca

SEQ ID NO: 11988 - DNA, 18 bp, Artificial sequence
  synthetic polynucleotide sequence
aggcacgagcaagttcca

SEQ ID NO: 11989 - DNA, 18 bp, Artificial sequence
  synthetic polynucleotide sequence
acgaggaagaccacgcca

SEQ ID NO: 11990 - DNA, 18 bp, Artificial sequence
  synthetic polynucleotide sequence
accgccttctccacgcca

SEQ ID NO: 11991 - DNA, 18 bp, Artificial sequence
  synthetic polynucleotide sequence
acgaaggcagtgaggcca

SEQ ID NO: 11992 - DNA, 18 bp, Artificial sequence
  synthetic polynucleotide sequence
gaccgaagcggaagctga

SEQ ID NO: 11993 - DNA, 18 bp, Artificial sequence
  synthetic polynucleotide sequence
ccggtcacatgagaggca

SEQ ID NO: 11994 - DNA, 18 bp, Artificial sequence
  synthetic polynucleotide sequence
ggacaggctgctcacaga

SEQ ID NO: 11995 - DNA, 18 bp, Artificial sequence
  synthetic polynucleotide sequence
acgtcccacacgggcaca

SEQ ID NO: 11996 - DNA, 18 bp, Artificial sequence
  synthetic polynucleotide sequence
cgctagccacttcgagca

SEQ ID NO: 11997 - DNA, 18 bp, Artificial sequence
  synthetic polynucleotide sequence
cttggcagcctcaaggaa

SEQ ID NO: 11998 - DNA, 18 bp, Artificial sequence
  synthetic polynucleotide sequence
ggttgacagatgcaagga

SEQ ID NO: 11999 - DNA, 18 bp, Artificial sequence
  synthetic polynucleotide sequence
ttcagagccacagctgca

SEQ ID NO: 12000 - DNA, 18 bp, Artificial sequence
  synthetic polynucleotide sequence
ttcagagccacagctgca

SEQ ID NO: 12001 - DNA, 21 bp, Artificial sequence
  synthetic polynucleotide sequence
acagaaagctacatcagcaca

SEQ ID NO: 12002 - DNA, 21 bp, Artificial sequence
  synthetic polynucleotide sequence
ggaattccaagggaatcagca

SEQ ID NO: 12003 - DNA, 18 bp, Artificial sequence
  synthetic polynucleotide sequence
aacccaacaataggggca

SEQ ID NO: 12004 - DNA, 18 bp, Artificial sequence
  synthetic polynucleotide sequence
gctgcagccgaccctcga

SEQ ID NO: 12005 - DNA, 18 bp, Artificial sequence
  synthetic polynucleotide sequence
ggatccagaactaacgca

SEQ ID NO: 12006 - DNA, 18 bp, Artificial sequence
  synthetic polynucleotide sequence
ccggagtgacttccacca

SEQ ID NO: 12007 - DNA, 18 bp, Artificial sequence
  synthetic polynucleotide sequence
actgcgcagcctagagga

SEQ ID NO: 12008 - DNA, 18 bp, Artificial sequence
  synthetic polynucleotide sequence
tggaagtccacacgtcga

SEQ ID NO: 12009 - DNA, 18 bp, Artificial sequence
  synthetic polynucleotide sequence
agccctggactctaccaa

SEQ ID NO: 12010 - DNA, 18 bp, Artificial sequence
  synthetic polynucleotide sequence
ctgcccagagtgatggca

SEQ ID NO: 12011 - DNA, 18 bp, Artificial sequence
  synthetic polynucleotide sequence
gctcatgggcagagtcca

SEQ ID NO: 12012 - DNA, 18 bp, Artificial sequence
  synthetic polynucleotide sequence
gctgaccgagatccacga

SEQ ID NO: 12013 - DNA, 18 bp, Artificial sequence
  synthetic polynucleotide sequence
tccgtagaggcatgacca

SEQ ID NO: 12014 - DNA, 18 bp, Artificial sequence
  synthetic polynucleotide sequence
agccatagcactcgcaga

SEQ ID NO: 12015 - DNA, 18 bp, Artificial sequence
  synthetic polynucleotide sequence
gcagcatgctgagggcca

SEQ ID NO: 12016 - DNA, 18 bp, Artificial sequence
  synthetic polynucleotide sequence
cacgagaacatggactca

SEQ ID NO: 12017 - DNA, 18 bp, Artificial sequence
  synthetic polynucleotide sequence
gctgcagctgagcctcga

SEQ ID NO: 12018 - DNA, 18 bp, Artificial sequence
  synthetic polynucleotide sequence
gctgcagctgagcctcga

SEQ ID NO: 12019 - DNA, 18 bp, Artificial sequence
  synthetic polynucleotide sequence
ggagaaagacgccctcca

SEQ ID NO: 12020 - DNA, 18 bp, Artificial sequence
  synthetic polynucleotide sequence
aaggtcagtgctgccaca

SEQ ID NO: 12021 - DNA, 18 bp, Artificial sequence
  synthetic polynucleotide sequence
ctgagggagaacgaggca

SEQ ID NO: 12022 - DNA, 18 bp, Artificial sequence
  synthetic polynucleotide sequence
cttggccgacactgacca

SEQ ID NO: 12023 - DNA, 18 bp, Artificial sequence
  synthetic polynucleotide sequence
gcagctatgactccacca

SEQ ID NO: 12024 - DNA, 18 bp, Artificial sequence
  synthetic polynucleotide sequence
ggggtgggaagtctgaca

SEQ ID NO: 12025 - DNA, 18 bp, Artificial sequence
  synthetic polynucleotide sequence
cgtcaccatcaagagcca

SEQ ID NO: 12026 - DNA, 18 bp, Artificial sequence
  synthetic polynucleotide sequence
ctggccagggagtaggaa

SEQ ID NO: 12027 - DNA, 18 bp, Artificial sequence
  synthetic polynucleotide sequence
acggcaggtcaggagcga

SEQ ID NO: 12028 - DNA, 18 bp, Artificial sequence
  synthetic polynucleotide sequence
gtaagcaggcagcagtca

SEQ ID NO: 12029 - DNA, 18 bp, Artificial sequence
  synthetic polynucleotide sequence
ctaggggacacataggca

SEQ ID NO: 12030 - DNA, 18 bp, Artificial sequence
  synthetic polynucleotide sequence
ggtcactccagatgccaa

SEQ ID NO: 12031 - DNA, 18 bp, Artificial sequence
  synthetic polynucleotide sequence
tggagaaggagcacagca

SEQ ID NO: 12032 - DNA, 18 bp, Artificial sequence
  synthetic polynucleotide sequence
cagtgctatcacccggga

SEQ ID NO: 12033 - DNA, 18 bp, Artificial sequence
  synthetic polynucleotide sequence
acaccatgcagagtggga

SEQ ID NO: 12034 - DNA, 18 bp, Artificial sequence
  synthetic polynucleotide sequence
accggacctgcatagcca

SEQ ID NO: 12035 - DNA, 18 bp, Artificial sequence
  synthetic polynucleotide sequence
gccagccaattggtccaa

SEQ ID NO: 12036 - DNA, 18 bp, Artificial sequence
  synthetic polynucleotide sequence
gccagccaattggtccaa

SEQ ID NO: 12037 - DNA, 18 bp, Artificial sequence
  synthetic polynucleotide sequence
agaagaagctgactccca

SEQ ID NO: 12038 - DNA, 18 bp, Artificial sequence
  synthetic polynucleotide sequence
tgagcgccgagcactcca

SEQ ID NO: 12039 - DNA, 18 bp, Artificial sequence
  synthetic polynucleotide sequence
ggtgggcaccaagctgga

SEQ ID NO: 12040 - DNA, 18 bp, Artificial sequence
  synthetic polynucleotide sequence
ggtaggtgatgggagcca

SEQ ID NO: 12041 - DNA, 18 bp, Artificial sequence
  synthetic polynucleotide sequence
caggccaacagggacaca

SEQ ID NO: 12042 - DNA, 18 bp, Artificial sequence
  synthetic polynucleotide sequence
tgggcacagcatgggcca

SEQ ID NO: 12043 - DNA, 18 bp, Artificial sequence
  synthetic polynucleotide sequence
cacaggaacctgaggaga

SEQ ID NO: 12044 - DNA, 18 bp, Artificial sequence
  synthetic polynucleotide sequence
ggagcccctctgactgca

SEQ ID NO: 12045 - DNA, 18 bp, Artificial sequence
  synthetic polynucleotide sequence
gtgaacccactcaagcca

SEQ ID NO: 12046 - DNA, 18 bp, Artificial sequence
  synthetic polynucleotide sequence
gcaggcagttcactggca

SEQ ID NO: 12047 - DNA, 18 bp, Artificial sequence
  synthetic polynucleotide sequence
ttagcaagagcacgctga

SEQ ID NO: 12048 - DNA, 18 bp, Artificial sequence
  synthetic polynucleotide sequence
gggcgatcaagatcagga

SEQ ID NO: 12049 - DNA, 18 bp, Artificial sequence
  synthetic polynucleotide sequence
ggaggaagttggcagcca

SEQ ID NO: 12050 - DNA, 18 bp, Artificial sequence
  synthetic polynucleotide sequence
ccctgggcttcccagaga

SEQ ID NO: 12051 - DNA, 18 bp, Artificial sequence
  synthetic polynucleotide sequence
gaagactgaggagcccca

SEQ ID NO: 12052 - DNA, 18 bp, Artificial sequence
  synthetic polynucleotide sequence
ccctgacagagcagtgga

SEQ ID NO: 12053 - DNA, 18 bp, Artificial sequence
  synthetic polynucleotide sequence
ctgtggctccagccagca

SEQ ID NO: 12054 - DNA, 18 bp, Artificial sequence
  synthetic polynucleotide sequence
ctgtggctccagccagca

SEQ ID NO: 12055 - DNA, 18 bp, Artificial sequence
  synthetic polynucleotide sequence
gaactgggaagacccaga

SEQ ID NO: 12056 - DNA, 18 bp, Artificial sequence
  synthetic polynucleotide sequence
gaccatacctctcagcca

SEQ ID NO: 12057 - DNA, 18 bp, Artificial sequence
  synthetic polynucleotide sequence
agaagtagcagcagccca

SEQ ID NO: 12058 - DNA, 18 bp, Artificial sequence
  synthetic polynucleotide sequence
tggacaagccaaggcgga

SEQ ID NO: 12059 - DNA, 18 bp, Artificial sequence
  synthetic polynucleotide sequence
ctcctgtgacgcacagca

SEQ ID NO: 12060 - DNA, 18 bp, Artificial sequence
  synthetic polynucleotide sequence
tagacgagggcttgacca

SEQ ID NO: 12061 - DNA, 18 bp, Artificial sequence
  synthetic polynucleotide sequence
gaccaggagcactacaga

SEQ ID NO: 12062 - DNA, 18 bp, Artificial sequence
  synthetic polynucleotide sequence
ggcaggggtgattgcaca

SEQ ID NO: 12063 - DNA, 18 bp, Artificial sequence
  synthetic polynucleotide sequence
agctgtgccgtgcccgaa

SEQ ID NO: 12064 - DNA, 18 bp, Artificial sequence
  synthetic polynucleotide sequence
accagccggttagcccca

SEQ ID NO: 12065 - DNA, 18 bp, Artificial sequence
  synthetic polynucleotide sequence
atgggggtggactgcaca

SEQ ID NO: 12066 - DNA, 18 bp, Artificial sequence
  synthetic polynucleotide sequence
gcgatcagagcctgacca

SEQ ID NO: 12067 - DNA, 18 bp, Artificial sequence
  synthetic polynucleotide sequence
cgtggtagctgcgcagga

SEQ ID NO: 12068 - DNA, 18 bp, Artificial sequence
  synthetic polynucleotide sequence
caggccgtcttcgaccca

SEQ ID NO: 12069 - DNA, 18 bp, Artificial sequence
  synthetic polynucleotide sequence
gctggaaggcgtacagca

SEQ ID NO: 12070 - DNA, 18 bp, Artificial sequence
  synthetic polynucleotide sequence
gcagagcatggaggagca

SEQ ID NO: 12071 - DNA, 18 bp, Artificial sequence
  synthetic polynucleotide sequence
cagttgccaccacagcca

SEQ ID NO: 12072 - DNA, 18 bp, Artificial sequence
  synthetic polynucleotide sequence
cagttgccaccacagcca

SEQ ID NO: 12073 - DNA, 18 bp, Artificial sequence
  synthetic polynucleotide sequence
ctggcagttcgccaccaa

SEQ ID NO: 12074 - DNA, 18 bp, Artificial sequence
  synthetic polynucleotide sequence
cctgagccagtgatcgca

SEQ ID NO: 12075 - DNA, 18 bp, Artificial sequence
  synthetic polynucleotide sequence
ccaccctcagtccctgca

SEQ ID NO: 12076 - DNA, 18 bp, Artificial sequence
  synthetic polynucleotide sequence
agtcacgtgtccaccaga

SEQ ID NO: 12077 - DNA, 18 bp, Artificial sequence
  synthetic polynucleotide sequence
tcctcaggcacaacccaa

SEQ ID NO: 12078 - DNA, 18 bp, Artificial sequence
  synthetic polynucleotide sequence
ggaggatgaagcagggga

SEQ ID NO: 12079 - DNA, 18 bp, Artificial sequence
  synthetic polynucleotide sequence
caaagagagcgggcacca

SEQ ID NO: 12080 - DNA, 18 bp, Artificial sequence
  synthetic polynucleotide sequence
acccaatccgagtggaca

SEQ ID NO: 12081 - DNA, 18 bp, Artificial sequence
  synthetic polynucleotide sequence
ttccgaggagaggcacga

SEQ ID NO: 12082 - DNA, 18 bp, Artificial sequence
  synthetic polynucleotide sequence
actgtactggcagaggga

SEQ ID NO: 12083 - DNA, 18 bp, Artificial sequence
  synthetic polynucleotide sequence
tcaagctgatagccacca

SEQ ID NO: 12084 - DNA, 18 bp, Artificial sequence
  synthetic polynucleotide sequence
cagtcttgccaggaggaa

SEQ ID NO: 12085 - DNA, 18 bp, Artificial sequence
  synthetic polynucleotide sequence
cggctgcatccaaggaga

SEQ ID NO: 12086 - DNA, 18 bp, Artificial sequence
  synthetic polynucleotide sequence
gagacgcgttcaccacca

SEQ ID NO: 12087 - DNA, 18 bp, Artificial sequence
  synthetic polynucleotide sequence
ccctgcacagcatacaga

SEQ ID NO: 12088 - DNA, 18 bp, Artificial sequence
  synthetic polynucleotide sequence
cagaaccagctggcggaa

SEQ ID NO: 12089 - DNA, 18 bp, Artificial sequence
  synthetic polynucleotide sequence
cccacgacgagcagtgga

SEQ ID NO: 12090 - DNA, 18 bp, Artificial sequence
  synthetic polynucleotide sequence
cccacgacgagcagtgga

SEQ ID NO: 12091 - DNA, 18 bp, Artificial sequence
  synthetic polynucleotide sequence
cgagagcgagagtgagga

SEQ ID NO: 12092 - DNA, 18 bp, Artificial sequence
  synthetic polynucleotide sequence
gcatctggagcagccgca

SEQ ID NO: 12093 - DNA, 18 bp, Artificial sequence
  synthetic polynucleotide sequence
ctcacagtcatccccgga

SEQ ID NO: 12094 - DNA, 18 bp, Artificial sequence
  synthetic polynucleotide sequence
gcagagccctgagacaga

SEQ ID NO: 12095 - DNA, 18 bp, Artificial sequence
  synthetic polynucleotide sequence
acccatcaactggcagca

SEQ ID NO: 12096 - DNA, 18 bp, Artificial sequence
  synthetic polynucleotide sequence
acatgaggcaacatggga

SEQ ID NO: 12097 - DNA, 18 bp, Artificial sequence
  synthetic polynucleotide sequence
acttcaggagctgcccca

SEQ ID NO: 12098 - DNA, 18 bp, Artificial sequence
  synthetic polynucleotide sequence
gggtcaccgtgatgggga

SEQ ID NO: 12099 - DNA, 18 bp, Artificial sequence
  synthetic polynucleotide sequence
tgagactcaccagatcca

SEQ ID NO: 12100 - DNA, 18 bp, Artificial sequence
  synthetic polynucleotide sequence
tgaggcagatgggggcta

SEQ ID NO: 12101 - DNA, 18 bp, Artificial sequence
  synthetic polynucleotide sequence
ccaggccagccatggcga

SEQ ID NO: 12102 - DNA, 18 bp, Artificial sequence
  synthetic polynucleotide sequence
caccggcatccacaggca

SEQ ID NO: 12103 - DNA, 18 bp, Artificial sequence
  synthetic polynucleotide sequence
tcctcatccgggagagca

SEQ ID NO: 12104 - DNA, 18 bp, Artificial sequence
  synthetic polynucleotide sequence
ccccaccagaagttgtca

SEQ ID NO: 12105 - DNA, 18 bp, Artificial sequence
  synthetic polynucleotide sequence
tccgcatgaggaggcgga

SEQ ID NO: 12106 - DNA, 18 bp, Artificial sequence
  synthetic polynucleotide sequence
aatggaaggagcgaggca

SEQ ID NO: 12107 - DNA, 18 bp, Artificial sequence
  synthetic polynucleotide sequence
ggccatgagccggagaca

SEQ ID NO: 12108 - DNA, 18 bp, Artificial sequence
  synthetic polynucleotide sequence
ggccatgagccggagaca

SEQ ID NO: 12109 - DNA, 18 bp, Artificial sequence
  synthetic polynucleotide sequence
cagatgtcctgcagcaga

SEQ ID NO: 12110 - DNA, 18 bp, Artificial sequence
  synthetic polynucleotide sequence
tgagcaggatgagcccca

SEQ ID NO: 12111 - DNA, 18 bp, Artificial sequence
  synthetic polynucleotide sequence
gccatggccagacagaca

SEQ ID NO: 12112 - DNA, 18 bp, Artificial sequence
  synthetic polynucleotide sequence
gccatgacacccaggcca

SEQ ID NO: 12113 - DNA, 18 bp, Artificial sequence
  synthetic polynucleotide sequence
cggagatcgagaaggaga

SEQ ID NO: 12114 - DNA, 18 bp, Artificial sequence
  synthetic polynucleotide sequence
gctgtggcacagtaccca

SEQ ID NO: 12115 - DNA, 18 bp, Artificial sequence
  synthetic polynucleotide sequence
gaagcggcacatcgggaa

SEQ ID NO: 12116 - DNA, 18 bp, Artificial sequence
  synthetic polynucleotide sequence
cctcagcctgcaccacga

SEQ ID NO: 12117 - DNA, 18 bp, Artificial sequence
  synthetic polynucleotide sequence
gagtggtggcatcaagca

SEQ ID NO: 12118 - DNA, 18 bp, Artificial sequence
  synthetic polynucleotide sequence
gagcacatatcaggacca

SEQ ID NO: 12119 - DNA, 18 bp, Artificial sequence
  synthetic polynucleotide sequence
cgtctccatgaaggggca

SEQ ID NO: 12120 - DNA, 18 bp, Artificial sequence
  synthetic polynucleotide sequence
ggtgggcaacaaggtgga

SEQ ID NO: 12121 - DNA, 18 bp, Artificial sequence
  synthetic polynucleotide sequence
gtggtgacatcccgcaga

SEQ ID NO: 12122 - DNA, 18 bp, Artificial sequence
  synthetic polynucleotide sequence
gatcccacaccctgacca

SEQ ID NO: 12123 - DNA, 18 bp, Artificial sequence
  synthetic polynucleotide sequence
ggagctgcttgaacacga

SEQ ID NO: 12124 - DNA, 18 bp, Artificial sequence
  synthetic polynucleotide sequence
catggccctgggtggaca

SEQ ID NO: 12125 - DNA, 18 bp, Artificial sequence
  synthetic polynucleotide sequence
aggagagctcgaagagga

SEQ ID NO: 12126 - DNA, 18 bp, Artificial sequence
  synthetic polynucleotide sequence
aggagagctcgaagagga

SEQ ID NO: 12127 - DNA, 18 bp, Artificial sequence
  synthetic polynucleotide sequence
ggccacagttgtgccaca

SEQ ID NO: 12128 - DNA, 18 bp, Artificial sequence
  synthetic polynucleotide sequence
gagagtgagccgtgccga

SEQ ID NO: 12129 - DNA, 18 bp, Artificial sequence
  synthetic polynucleotide sequence
gaccctgaaccggaccca

SEQ ID NO: 12130 - DNA, 18 bp, Artificial sequence
  synthetic polynucleotide sequence
gtctccgcagatgaggca

SEQ ID NO: 12131 - DNA, 18 bp, Artificial sequence
  synthetic polynucleotide sequence
cgccaggaccttgaggaa

SEQ ID NO: 12132 - DNA, 18 bp, Artificial sequence
  synthetic polynucleotide sequence
gcactgatgctacggaga

SEQ ID NO: 12133 - DNA, 18 bp, Artificial sequence
  synthetic polynucleotide sequence
agggagctgaaagggcca

SEQ ID NO: 12134 - DNA, 18 bp, Artificial sequence
  synthetic polynucleotide sequence
gaggcattggggtgggga

SEQ ID NO: 12135 - DNA, 18 bp, Artificial sequence
  synthetic polynucleotide sequence
ccctgggcagcctcagga

SEQ ID NO: 12136 - DNA, 18 bp, Artificial sequence
  synthetic polynucleotide sequence
tgggcgagccggaccgga

SEQ ID NO: 12137 - DNA, 18 bp, Artificial sequence
  synthetic polynucleotide sequence
ggggcagggccttggaga

SEQ ID NO: 12138 - DNA, 18 bp, Artificial sequence
  synthetic polynucleotide sequence
ggagcaccaggagaccca

SEQ ID NO: 12139 - DNA, 19 bp, Artificial sequence
  synthetic polynucleotide sequence
gagcatccagcaacaacca

SEQ ID NO: 12140 - DNA, 19 bp, Artificial sequence
  synthetic polynucleotide sequence
ggaccatgagtaccaacca

SEQ ID NO: 12141 - DNA, 18 bp, Artificial sequence
  synthetic polynucleotide sequence
aaccccttggccatgaca

SEQ ID NO: 12142 - DNA, 18 bp, Artificial sequence
  synthetic polynucleotide sequence
ggaaactaggccggtgca

SEQ ID NO: 12143 - DNA, 18 bp, Artificial sequence
  synthetic polynucleotide sequence
ggctcaactggcagcgca

SEQ ID NO: 12144 - DNA, 18 bp, Artificial sequence
  synthetic polynucleotide sequence
ggctcaactggcagcgca

SEQ ID NO: 12145 - DNA, 18 bp, Artificial sequence
  synthetic polynucleotide sequence
ccacaaacagccaggcaa

SEQ ID NO: 12146 - DNA, 18 bp, Artificial sequence
  synthetic polynucleotide sequence
atcggctcaccctgcaga

SEQ ID NO: 12147 - DNA, 18 bp, Artificial sequence
  synthetic polynucleotide sequence
cgctgtacatccaggcca

SEQ ID NO: 12148 - DNA, 18 bp, Artificial sequence
  synthetic polynucleotide sequence
acgggtggtagacggtga

SEQ ID NO: 12149 - DNA, 18 bp, Artificial sequence
  synthetic polynucleotide sequence
gctcagtggacccagcaa

SEQ ID NO: 12150 - DNA, 18 bp, Artificial sequence
  synthetic polynucleotide sequence
gctcgggcacctaaccca

SEQ ID NO: 12151 - DNA, 18 bp, Artificial sequence
  synthetic polynucleotide sequence
tgctgctacagagggaca

SEQ ID NO: 12152 - DNA, 18 bp, Artificial sequence
  synthetic polynucleotide sequence
tctcgagcaaggtgcaga

SEQ ID NO: 12153 - DNA, 18 bp, Artificial sequence
  synthetic polynucleotide sequence
ggcccatcctcaagacca

SEQ ID NO: 12154 - DNA, 18 bp, Artificial sequence
  synthetic polynucleotide sequence
gctcaggcagttgaacca

SEQ ID NO: 12155 - DNA, 18 bp, Artificial sequence
  synthetic polynucleotide sequence
cgatagcggaggtgccga

SEQ ID NO: 12156 - DNA, 18 bp, Artificial sequence
  synthetic polynucleotide sequence
agagtctgcaccagcgga

SEQ ID NO: 12157 - DNA, 18 bp, Artificial sequence
  synthetic polynucleotide sequence
ggacatggagaggtggga

SEQ ID NO: 12158 - DNA, 18 bp, Artificial sequence
  synthetic polynucleotide sequence
cccacaaggccacccaga

SEQ ID NO: 12159 - DNA, 18 bp, Artificial sequence
  synthetic polynucleotide sequence
cactcaactgacaggcga

SEQ ID NO: 12160 - DNA, 18 bp, Artificial sequence
  synthetic polynucleotide sequence
cctcgaccagaaccagga

SEQ ID NO: 12161 - DNA, 18 bp, Artificial sequence
  synthetic polynucleotide sequence
acaacatccacaccagca

SEQ ID NO: 12162 - DNA, 18 bp, Artificial sequence
  synthetic polynucleotide sequence
acaacatccacaccagca

SEQ ID NO: 12163 - DNA, 18 bp, Artificial sequence
  synthetic polynucleotide sequence
ctgtcaccaacgtccgca

SEQ ID NO: 12164 - DNA, 18 bp, Artificial sequence
  synthetic polynucleotide sequence
tcgggcaatcagcgggta

SEQ ID NO: 12165 - DNA, 18 bp, Artificial sequence
  synthetic polynucleotide sequence
accgtgaggaagaaggga

SEQ ID NO: 12166 - DNA, 18 bp, Artificial sequence
  synthetic polynucleotide sequence
tccatgaggtggagggga

SEQ ID NO: 12167 - DNA, 18 bp, Artificial sequence
  synthetic polynucleotide sequence
agtcacaacttgccagga

SEQ ID NO: 12168 - DNA, 18 bp, Artificial sequence
  synthetic polynucleotide sequence
tcaggaattcgagccaca

SEQ ID NO: 12169 - DNA, 18 bp, Artificial sequence
  synthetic polynucleotide sequence
cagccttccagacccaga

SEQ ID NO: 12170 - DNA, 18 bp, Artificial sequence
  synthetic polynucleotide sequence
agacagaaggcgttcaca

SEQ ID NO: 12171 - DNA, 18 bp, Artificial sequence
  synthetic polynucleotide sequence
cccaaatctcagtgggca

SEQ ID NO: 12172 - DNA, 18 bp, Artificial sequence
  synthetic polynucleotide sequence
tcatcagcaactgaccca

SEQ ID NO: 12173 - DNA, 18 bp, Artificial sequence
  synthetic polynucleotide sequence
tgcggcatgtaacgagca

SEQ ID NO: 12174 - DNA, 18 bp, Artificial sequence
  synthetic polynucleotide sequence
tgacagtgacaagggtga

SEQ ID NO: 12175 - DNA, 18 bp, Artificial sequence
  synthetic polynucleotide sequence
ggctcatgagaaccagca

SEQ ID NO: 12176 - DNA, 18 bp, Artificial sequence
  synthetic polynucleotide sequence
gagccctgttcacaggaa

SEQ ID NO: 12177 - DNA, 18 bp, Artificial sequence
  synthetic polynucleotide sequence
ctccatgaagggcagcca

SEQ ID NO: 12178 - DNA, 18 bp, Artificial sequence
  synthetic polynucleotide sequence
ggtgaaaaaggagctgga

SEQ ID NO: 12179 - DNA, 18 bp, Artificial sequence
  synthetic polynucleotide sequence
cagcttgggtggcaagga

SEQ ID NO: 12180 - DNA, 18 bp, Artificial sequence
  synthetic polynucleotide sequence
cagcttgggtggcaagga

SEQ ID NO: 12181 - DNA, 18 bp, Artificial sequence
  synthetic polynucleotide sequence
cacttgctccagccccca

SEQ ID NO: 12182 - DNA, 18 bp, Artificial sequence
  synthetic polynucleotide sequence
agacccacatcatcagca

SEQ ID NO: 12183 - DNA, 18 bp, Artificial sequence
  synthetic polynucleotide sequence
caacagccaggctcacca

SEQ ID NO: 12184 - DNA, 18 bp, Artificial sequence
  synthetic polynucleotide sequence
ggtgtaaggcctgaccca

SEQ ID NO: 12185 - DNA, 18 bp, Artificial sequence
  synthetic polynucleotide sequence
cgccactgtcacagccaa

SEQ ID NO: 12186 - DNA, 18 bp, Artificial sequence
  synthetic polynucleotide sequence
tggccacttgaccaggga

SEQ ID NO: 12187 - DNA, 18 bp, Artificial sequence
  synthetic polynucleotide sequence
aatcagccgaggcgagca

SEQ ID NO: 12188 - DNA, 18 bp, Artificial sequence
  synthetic polynucleotide sequence
ctggtagccggtgggaga

SEQ ID NO: 12189 - DNA, 18 bp, Artificial sequence
  synthetic polynucleotide sequence
aatgcccagtctgcccca

SEQ ID NO: 12190 - DNA, 18 bp, Artificial sequence
  synthetic polynucleotide sequence
tggctggcataggcagca

SEQ ID NO: 12191 - DNA, 18 bp, Artificial sequence
  synthetic polynucleotide sequence
gtcaggagaaggagcgca

SEQ ID NO: 12192 - DNA, 18 bp, Artificial sequence
  synthetic polynucleotide sequence
gaccagcctaggaagcga

SEQ ID NO: 12193 - DNA, 18 bp, Artificial sequence
  synthetic polynucleotide sequence
gtgctggagaagacgcca

SEQ ID NO: 12194 - DNA, 18 bp, Artificial sequence
  synthetic polynucleotide sequence
ttcagccaggctgcagca

SEQ ID NO: 12195 - DNA, 18 bp, Artificial sequence
  synthetic polynucleotide sequence
cgccatgagcgagactca

SEQ ID NO: 12196 - DNA, 18 bp, Artificial sequence
  synthetic polynucleotide sequence
ccgcaaaccaagggccaa

SEQ ID NO: 12197 - DNA, 18 bp, Artificial sequence
  synthetic polynucleotide sequence
ctgcatgatccacacgga

SEQ ID NO: 12198 - DNA, 18 bp, Artificial sequence
  synthetic polynucleotide sequence
ctgcatgatccacacgga

SEQ ID NO: 12199 - DNA, 18 bp, Artificial sequence
  synthetic polynucleotide sequence
accggccacctatgacca

SEQ ID NO: 12200 - DNA, 18 bp, Artificial sequence
  synthetic polynucleotide sequence
gcgcctggtactgcacga

SEQ ID NO: 12201 - DNA, 18 bp, Artificial sequence
  synthetic polynucleotide sequence
tcaggagctgctgccaca

SEQ ID NO: 12202 - DNA, 18 bp, Artificial sequence
  synthetic polynucleotide sequence
cctctccaacagtgggga

SEQ ID NO: 12203 - DNA, 18 bp, Artificial sequence
  synthetic polynucleotide sequence
acagccacgatcgccaca

SEQ ID NO: 12204 - DNA, 18 bp, Artificial sequence
  synthetic polynucleotide sequence
gggacctgaatggcagca

SEQ ID NO: 12205 - DNA, 18 bp, Artificial sequence
  synthetic polynucleotide sequence
gcccaagcgcaagaagca

SEQ ID NO: 12206 - DNA, 18 bp, Artificial sequence
  synthetic polynucleotide sequence
gcctcaatgggagccgta

SEQ ID NO: 12207 - DNA, 18 bp, Artificial sequence
  synthetic polynucleotide sequence
gcggagctcagatgcaca

SEQ ID NO: 12208 - DNA, 18 bp, Artificial sequence
  synthetic polynucleotide sequence
cgccaacggtcactggga

SEQ ID NO: 12209 - DNA, 18 bp, Artificial sequence
  synthetic polynucleotide sequence
ggtcaccgtcctgcacga

SEQ ID NO: 12210 - DNA, 18 bp, Artificial sequence
  synthetic polynucleotide sequence
ccccgaaatgccagtcga

SEQ ID NO: 12211 - DNA, 18 bp, Artificial sequence
  synthetic polynucleotide sequence
tggagacctgggtgagca

SEQ ID NO: 12212 - DNA, 18 bp, Artificial sequence
  synthetic polynucleotide sequence
gcagatgctctccggaga

SEQ ID NO: 12213 - DNA, 18 bp, Artificial sequence
  synthetic polynucleotide sequence
caggagtactgcacggca

SEQ ID NO: 12214 - DNA, 18 bp, Artificial sequence
  synthetic polynucleotide sequence
gatgagcgccacagccaa

SEQ ID NO: 12215 - DNA, 18 bp, Artificial sequence
  synthetic polynucleotide sequence
gactggttgccggaccca

SEQ ID NO: 12216 - DNA, 18 bp, Artificial sequence
  synthetic polynucleotide sequence
gactggttgccggaccca

SEQ ID NO: 12217 - DNA, 18 bp, Artificial sequence
  synthetic polynucleotide sequence
gcccaacactgtacctca

SEQ ID NO: 12218 - DNA, 18 bp, Artificial sequence
  synthetic polynucleotide sequence
gcatgcagtgaagcggga

SEQ ID NO: 12219 - DNA, 18 bp, Artificial sequence
  synthetic polynucleotide sequence
ccatctgcaggaaccaca

SEQ ID NO: 12220 - DNA, 18 bp, Artificial sequence
  synthetic polynucleotide sequence
agcgagagatgcagtgga

SEQ ID NO: 12221 - DNA, 18 bp, Artificial sequence
  synthetic polynucleotide sequence
agcagatgccaggctcca

SEQ ID NO: 12222 - DNA, 18 bp, Artificial sequence
  synthetic polynucleotide sequence
ccatcccactggcggaga

SEQ ID NO: 12223 - DNA, 18 bp, Artificial sequence
  synthetic polynucleotide sequence
gcacgtgtgcgacagtga

SEQ ID NO: 12224 - DNA, 18 bp, Artificial sequence
  synthetic polynucleotide sequence
ggcaggccaggacgccga

SEQ ID NO: 12225 - DNA, 18 bp, Artificial sequence
  synthetic polynucleotide sequence
gcgaatagaactccacga

SEQ ID NO: 12226 - DNA, 18 bp, Artificial sequence
  synthetic polynucleotide sequence
gtcccgcacttcgccgga

SEQ ID NO: 12227 - DNA, 18 bp, Artificial sequence
  synthetic polynucleotide sequence
gtgaggggctggagcaga

SEQ ID NO: 12228 - DNA, 18 bp, Artificial sequence
  synthetic polynucleotide sequence
ccttggagcacccacaga

SEQ ID NO: 12229 - DNA, 18 bp, Artificial sequence
  synthetic polynucleotide sequence
atcatgacacaagcggca

SEQ ID NO: 12230 - DNA, 18 bp, Artificial sequence
  synthetic polynucleotide sequence
tgcgagcactatgacaga

SEQ ID NO: 12231 - DNA, 18 bp, Artificial sequence
  synthetic polynucleotide sequence
caacacaggtcatcagca

SEQ ID NO: 12232 - DNA, 18 bp, Artificial sequence
  synthetic polynucleotide sequence
gacccttggacagcagga

SEQ ID NO: 12233 - DNA, 18 bp, Artificial sequence
  synthetic polynucleotide sequence
gatcccggaagtcccgga

SEQ ID NO: 12234 - DNA, 18 bp, Artificial sequence
  synthetic polynucleotide sequence
gatcccggaagtcccgga

SEQ ID NO: 12235 - DNA, 18 bp, Artificial sequence
  synthetic polynucleotide sequence
actcctgggaggaaggca

SEQ ID NO: 12236 - DNA, 18 bp, Artificial sequence
  synthetic polynucleotide sequence
cggggtcgaagtcgggca

SEQ ID NO: 12237 - DNA, 18 bp, Artificial sequence
  synthetic polynucleotide sequence
gagacagagagcgggaca

SEQ ID NO: 12238 - DNA, 18 bp, Artificial sequence
  synthetic polynucleotide sequence
gagagaaggccccacgga

SEQ ID NO: 12239 - DNA, 18 bp, Artificial sequence
  synthetic polynucleotide sequence
caccctggcacagtccaa

SEQ ID NO: 12240 - DNA, 18 bp, Artificial sequence
  synthetic polynucleotide sequence
tacgagcttgggcagaga

SEQ ID NO: 12241 - DNA, 18 bp, Artificial sequence
  synthetic polynucleotide sequence
acctacgcagtgcaccca

SEQ ID NO: 12242 - DNA, 18 bp, Artificial sequence
  synthetic polynucleotide sequence
gctccaggccctcagcca

SEQ ID NO: 12243 - DNA, 18 bp, Artificial sequence
  synthetic polynucleotide sequence
atacctggccgtggcgga

SEQ ID NO: 12244 - DNA, 18 bp, Artificial sequence
  synthetic polynucleotide sequence
gcgggcactttcagccca

SEQ ID NO: 12245 - DNA, 18 bp, Artificial sequence
  synthetic polynucleotide sequence
cgggcttggagagaccca

SEQ ID NO: 12246 - DNA, 18 bp, Artificial sequence
  synthetic polynucleotide sequence
agctggctgggatgccaa

SEQ ID NO: 12247 - DNA, 18 bp, Artificial sequence
  synthetic polynucleotide sequence
aggcttgggaaggaccca

SEQ ID NO: 12248 - DNA, 18 bp, Artificial sequence
  synthetic polynucleotide sequence
cccaggttgggatgccaa

SEQ ID NO: 12249 - DNA, 18 bp, Artificial sequence
  synthetic polynucleotide sequence
cgcacatacaggctgcca

SEQ ID NO: 12250 - DNA, 18 bp, Artificial sequence
  synthetic polynucleotide sequence
atcagctcgactcgacca

SEQ ID NO: 12251 - DNA, 17 bp, Artificial sequence
  synthetic polynucleotide sequence
gcagtttctggcgggca

SEQ ID NO: 12252 - DNA, 17 bp, Artificial sequence
  synthetic polynucleotide sequence
gcagtttctggcgggca

SEQ ID NO: 12253 - DNA, 18 bp, Artificial sequence
  synthetic polynucleotide sequence
cagcctcatcccaccaga

SEQ ID NO: 12254 - DNA, 18 bp, Artificial sequence
  synthetic polynucleotide sequence
ccatgggcacctcaggga

SEQ ID NO: 12255 - DNA, 18 bp, Artificial sequence
  synthetic polynucleotide sequence
cctacacaaaaggctcca

SEQ ID NO: 12256 - DNA, 18 bp, Artificial sequence
  synthetic polynucleotide sequence
ccgaagtgcacaagggca

SEQ ID NO: 12257 - DNA, 18 bp, Artificial sequence
  synthetic polynucleotide sequence
catgagggagaggttcga

SEQ ID NO: 12258 - DNA, 18 bp, Artificial sequence
  synthetic polynucleotide sequence
gagaggctccataaccga

SEQ ID NO: 12259 - DNA, 18 bp, Artificial sequence
  synthetic polynucleotide sequence
caagcaaggacgacgaca

SEQ ID NO: 12260 - DNA, 18 bp, Artificial sequence
  synthetic polynucleotide sequence
tgccttaggaacagcgga

SEQ ID NO: 12261 - DNA, 18 bp, Artificial sequence
  synthetic polynucleotide sequence
gccgctggcactggagca

SEQ ID NO: 12262 - DNA, 18 bp, Artificial sequence
  synthetic polynucleotide sequence
tgaggtcaggctcacaca

SEQ ID NO: 12263 - DNA, 18 bp, Artificial sequence
  synthetic polynucleotide sequence
cccactactccagtgcca

SEQ ID NO: 12264 - DNA, 18 bp, Artificial sequence
  synthetic polynucleotide sequence
ctgcccagaaggcaccaa

SEQ ID NO: 12265 - DNA, 18 bp, Artificial sequence
  synthetic polynucleotide sequence
cactgagcacagacacca

SEQ ID NO: 12266 - DNA, 18 bp, Artificial sequence
  synthetic polynucleotide sequence
aactgccctctgcacgga

SEQ ID NO: 12267 - DNA, 18 bp, Artificial sequence
  synthetic polynucleotide sequence
gccgcttctggcaagcca

SEQ ID NO: 12268 - DNA, 18 bp, Artificial sequence
  synthetic polynucleotide sequence
aactgccctctccacgga

SEQ ID NO: 12269 - DNA, 18 bp, Artificial sequence
  synthetic polynucleotide sequence
ggagctcatctcagcaca

SEQ ID NO: 12270 - DNA, 18 bp, Artificial sequence
  synthetic polynucleotide sequence
ggagctcatctcagcaca

SEQ ID NO: 12271 - DNA, 18 bp, Artificial sequence
  synthetic polynucleotide sequence
gacggctactatgaagca

SEQ ID NO: 12272 - DNA, 18 bp, Artificial sequence
  synthetic polynucleotide sequence
gggttcgagacaacagga

SEQ ID NO: 12273 - DNA, 18 bp, Artificial sequence
  synthetic polynucleotide sequence
acctggcatccgtcgaca

SEQ ID NO: 12274 - DNA, 18 bp, Artificial sequence
  synthetic polynucleotide sequence
cagggtactccatcagca

SEQ ID NO: 12275 - DNA, 18 bp, Artificial sequence
  synthetic polynucleotide sequence
cctacgaggacctggaga

SEQ ID NO: 12276 - DNA, 18 bp, Artificial sequence
  synthetic polynucleotide sequence
atggtcgcgaggcaggta

SEQ ID NO: 12277 - DNA, 18 bp, Artificial sequence
  synthetic polynucleotide sequence
gcctgacagcagagagga

SEQ ID NO: 12278 - DNA, 18 bp, Artificial sequence
  synthetic polynucleotide sequence
gcagctggaagctccaga

SEQ ID NO: 12279 - DNA, 18 bp, Artificial sequence
  synthetic polynucleotide sequence
cccgaccagggttcccaa

SEQ ID NO: 12280 - DNA, 18 bp, Artificial sequence
  synthetic polynucleotide sequence
gtcagggagatcacccca

SEQ ID NO: 12281 - DNA, 18 bp, Artificial sequence
  synthetic polynucleotide sequence
ctggaggaatccgaagca

SEQ ID NO: 12282 - DNA, 18 bp, Artificial sequence
  synthetic polynucleotide sequence
ccgagtggagccaaccca

SEQ ID NO: 12283 - DNA, 18 bp, Artificial sequence
  synthetic polynucleotide sequence
ctcgcacatggctaggca

SEQ ID NO: 12284 - DNA, 18 bp, Artificial sequence
  synthetic polynucleotide sequence
tggctacctgagccgaga

SEQ ID NO: 12285 - DNA, 18 bp, Artificial sequence
  synthetic polynucleotide sequence
agctggtcccactgggca

SEQ ID NO: 12286 - DNA, 18 bp, Artificial sequence
  synthetic polynucleotide sequence
gacgcttctggcgacgaa

SEQ ID NO: 12287 - DNA, 18 bp, Artificial sequence
  synthetic polynucleotide sequence
gaccacactgcatcacca

SEQ ID NO: 12288 - DNA, 18 bp, Artificial sequence
  synthetic polynucleotide sequence
gaccacactgcatcacca

SEQ ID NO: 12289 - DNA, 18 bp, Artificial sequence
  synthetic polynucleotide sequence
ctgagtcactgccggcaa

SEQ ID NO: 12290 - DNA, 18 bp, Artificial sequence
  synthetic polynucleotide sequence
ggacaggaaggtcagcca

SEQ ID NO: 12291 - DNA, 18 bp, Artificial sequence
  synthetic polynucleotide sequence
tggctagacaagtccaca

SEQ ID NO: 12292 - DNA, 18 bp, Artificial sequence
  synthetic polynucleotide sequence
tggtagatccccaaggca

SEQ ID NO: 12293 - DNA, 18 bp, Artificial sequence
  synthetic polynucleotide sequence
gtatccacgcagagcgca

SEQ ID NO: 12294 - DNA, 18 bp, Artificial sequence
  synthetic polynucleotide sequence
ggtaggggaagcgagcca

SEQ ID NO: 12295 - DNA, 18 bp, Artificial sequence
  synthetic polynucleotide sequence
gcaggtggtccagaagga

SEQ ID NO: 12296 - DNA, 18 bp, Artificial sequence
  synthetic polynucleotide sequence
ccttctgaaccaccccca

SEQ ID NO: 12297 - DNA, 18 bp, Artificial sequence
  synthetic polynucleotide sequence
gccagagcgtcacctcca

SEQ ID NO: 12298 - DNA, 18 bp, Artificial sequence
  synthetic polynucleotide sequence
gtggtctcggcgcgcaca

SEQ ID NO: 12299 - DNA, 18 bp, Artificial sequence
  synthetic polynucleotide sequence
aggtggcagcagcgggca

SEQ ID NO: 12300 - DNA, 18 bp, Artificial sequence
  synthetic polynucleotide sequence
gtcaaaagccaaggcaga

SEQ ID NO: 12301 - DNA, 18 bp, Artificial sequence
  synthetic polynucleotide sequence
tggtgcctcgcaggcaga

SEQ ID NO: 12302 - DNA, 18 bp, Artificial sequence
  synthetic polynucleotide sequence
gccaggtgtgaagcagca

SEQ ID NO: 12303 - DNA, 18 bp, Artificial sequence
  synthetic polynucleotide sequence
ggatcacttgcagaggca

SEQ ID NO: 12304 - DNA, 18 bp, Artificial sequence
  synthetic polynucleotide sequence
caagcaccaaccacggga

SEQ ID NO: 12305 - DNA, 18 bp, Artificial sequence
  synthetic polynucleotide sequence
cgagtgcttccccagcca

SEQ ID NO: 12306 - DNA, 18 bp, Artificial sequence
  synthetic polynucleotide sequence
cgagtgcttccccagcca

SEQ ID NO: 12307 - DNA, 18 bp, Artificial sequence
  synthetic polynucleotide sequence
ggcgctgaacaacctgca

SEQ ID NO: 12308 - DNA, 18 bp, Artificial sequence
  synthetic polynucleotide sequence
tgagtagcccagatgcca

SEQ ID NO: 12309 - DNA, 18 bp, Artificial sequence
  synthetic polynucleotide sequence
caccaaagatgctcagca

SEQ ID NO: 12310 - DNA, 18 bp, Artificial sequence
  synthetic polynucleotide sequence
caatgctgggagcaggca

SEQ ID NO: 12311 - DNA, 18 bp, Artificial sequence
  synthetic polynucleotide sequence
gagtcgaaaaccacccga

SEQ ID NO: 12312 - DNA, 18 bp, Artificial sequence
  synthetic polynucleotide sequence
acagaggcttgaagcgga

SEQ ID NO: 12313 - DNA, 18 bp, Artificial sequence
  synthetic polynucleotide sequence
gaaggggttggcactgca

SEQ ID NO: 12314 - DNA, 18 bp, Artificial sequence
  synthetic polynucleotide sequence
cagcaatgagggagctca

SEQ ID NO: 12315 - DNA, 18 bp, Artificial sequence
  synthetic polynucleotide sequence
ctgccggatgactgcaca

SEQ ID NO: 12316 - DNA, 18 bp, Artificial sequence
  synthetic polynucleotide sequence
gggttctcaggaccccca

SEQ ID NO: 12317 - DNA, 18 bp, Artificial sequence
  synthetic polynucleotide sequence
agactgcgttcaccagca

SEQ ID NO: 12318 - DNA, 18 bp, Artificial sequence
  synthetic polynucleotide sequence
ccatcagaagtgccggca

SEQ ID NO: 12319 - DNA, 18 bp, Artificial sequence
  synthetic polynucleotide sequence
agcagatggggcatacga

SEQ ID NO: 12320 - DNA, 18 bp, Artificial sequence
  synthetic polynucleotide sequence
agcggcagcaggaagcga

SEQ ID NO: 12321 - DNA, 18 bp, Artificial sequence
  synthetic polynucleotide sequence
tcaggtcccggatcacca

SEQ ID NO: 12322 - DNA, 18 bp, Artificial sequence
  synthetic polynucleotide sequence
caagctgaccctgcagca

SEQ ID NO: 12323 - DNA, 18 bp, Artificial sequence
  synthetic polynucleotide sequence
ccttgaggactgggcaga

SEQ ID NO: 12324 - DNA, 18 bp, Artificial sequence
  synthetic polynucleotide sequence
ccttgaggactgggcaga

SEQ ID NO: 12325 - DNA, 18 bp, Artificial sequence
  synthetic polynucleotide sequence
tggagcgtgacgtggaca

SEQ ID NO: 12326 - DNA, 18 bp, Artificial sequence
  synthetic polynucleotide sequence
catcggggtgtagccaga

SEQ ID NO: 12327 - DNA, 18 bp, Artificial sequence
  synthetic polynucleotide sequence
ccaagcctcggaagagca

SEQ ID NO: 12328 - DNA, 18 bp, Artificial sequence
  synthetic polynucleotide sequence
cgcaggatgacacgctga

SEQ ID NO: 12329 - DNA, 18 bp, Artificial sequence
  synthetic polynucleotide sequence
ggacgacctggatggcaa

SEQ ID NO: 12330 - DNA, 18 bp, Artificial sequence
  synthetic polynucleotide sequence
gctccagctggcaggaca

SEQ ID NO: 12331 - DNA, 18 bp, Artificial sequence
  synthetic polynucleotide sequence
cgtggagatccaggccaa

SEQ ID NO: 12332 - DNA, 18 bp, Artificial sequence
  synthetic polynucleotide sequence
tcccagtcctccacagca

SEQ ID NO: 12333 - DNA, 18 bp, Artificial sequence
  synthetic polynucleotide sequence
ggccatgtcctacgagga

SEQ ID NO: 12334 - DNA, 18 bp, Artificial sequence
  synthetic polynucleotide sequence
cagtgtgtagccaggcca

SEQ ID NO: 12335 - DNA, 18 bp, Artificial sequence
  synthetic polynucleotide sequence
acccagagcttcccctca

SEQ ID NO: 12336 - DNA, 18 bp, Artificial sequence
  synthetic polynucleotide sequence
acctgcagacaggacaga

SEQ ID NO: 12337 - DNA, 18 bp, Artificial sequence
  synthetic polynucleotide sequence
cccttcagccagggacca

SEQ ID NO: 12338 - DNA, 18 bp, Artificial sequence
  synthetic polynucleotide sequence
gacttccgcactcgagaa

SEQ ID NO: 12339 - DNA, 18 bp, Artificial sequence
  synthetic polynucleotide sequence
tcccagcctctgccagga

SEQ ID NO: 12340 - DNA, 18 bp, Artificial sequence
  synthetic polynucleotide sequence
atgacgcccagctgcaca

SEQ ID NO: 12341 - DNA, 18 bp, Artificial sequence
  synthetic polynucleotide sequence
gctcacagagtccggaca

SEQ ID NO: 12342 - DNA, 18 bp, Artificial sequence
  synthetic polynucleotide sequence
gctcacagagtccggaca

SEQ ID NO: 12343 - DNA, 18 bp, Artificial sequence
  synthetic polynucleotide sequence
cgaggatgaacctgcaga

SEQ ID NO: 12344 - DNA, 18 bp, Artificial sequence
  synthetic polynucleotide sequence
gcggctgaggcttgggca

SEQ ID NO: 12345 - DNA, 18 bp, Artificial sequence
  synthetic polynucleotide sequence
accccctctacctccaga

SEQ ID NO: 12346 - DNA, 18 bp, Artificial sequence
  synthetic polynucleotide sequence
gttctccgacaggcacca

SEQ ID NO: 12347 - DNA, 18 bp, Artificial sequence
  synthetic polynucleotide sequence
gggaagagacaagccgga

SEQ ID NO: 12348 - DNA, 18 bp, Artificial sequence
  synthetic polynucleotide sequence
agctggacgggttgacca

SEQ ID NO: 12349 - DNA, 18 bp, Artificial sequence
  synthetic polynucleotide sequence
gccacccttgctggagga

SEQ ID NO: 12350 - DNA, 18 bp, Artificial sequence
  synthetic polynucleotide sequence
tgcctgcaaggcctccca

SEQ ID NO: 12351 - DNA, 18 bp, Artificial sequence
  synthetic polynucleotide sequence
ccagcttctccccaggga

SEQ ID NO: 12352 - DNA, 18 bp, Artificial sequence
  synthetic polynucleotide sequence
tggcccgtcaagaagcga

SEQ ID NO: 12353 - DNA, 18 bp, Artificial sequence
  synthetic polynucleotide sequence
agccgaagatgtgggcga

SEQ ID NO: 12354 - DNA, 18 bp, Artificial sequence
  synthetic polynucleotide sequence
tcacaggcaacctcgcca

SEQ ID NO: 12355 - DNA, 18 bp, Artificial sequence
  synthetic polynucleotide sequence
accttccccaagacagca

SEQ ID NO: 12356 - DNA, 18 bp, Artificial sequence
  synthetic polynucleotide sequence
aagtcggccaagatctga

SEQ ID NO: 12357 - DNA, 18 bp, Artificial sequence
  synthetic polynucleotide sequence
agggtaccgaggaagcca

SEQ ID NO: 12358 - DNA, 18 bp, Artificial sequence
  synthetic polynucleotide sequence
acatccctgaggacccca

SEQ ID NO: 12359 - DNA, 18 bp, Artificial sequence
  synthetic polynucleotide sequence
ccgacggagatcagccca

SEQ ID NO: 12360 - DNA, 18 bp, Artificial sequence
  synthetic polynucleotide sequence
ccgacggagatcagccca

SEQ ID NO: 12361 - DNA, 18 bp, Artificial sequence
  synthetic polynucleotide sequence
catctggtggacacagca

SEQ ID NO: 12362 - DNA, 18 bp, Artificial sequence
  synthetic polynucleotide sequence
agctatgcagagaggtga

SEQ ID NO: 12363 - DNA, 18 bp, Artificial sequence
  synthetic polynucleotide sequence
gccaccacacagaaggca

SEQ ID NO: 12364 - DNA, 17 bp, Artificial sequence
  synthetic polynucleotide sequence
ggcaaagaacgctggga

SEQ ID NO: 12365 - DNA, 18 bp, Artificial sequence
  synthetic polynucleotide sequence
gacacagctgggcaggaa

SEQ ID NO: 12366 - DNA, 18 bp, Artificial sequence
  synthetic polynucleotide sequence
gatgggcacgttgggaca

SEQ ID NO: 12367 - DNA, 18 bp, Artificial sequence
  synthetic polynucleotide sequence
gcccgcatgaagcaggaa

SEQ ID NO: 12368 - DNA, 18 bp, Artificial sequence
  synthetic polynucleotide sequence
ggcagagcactcgaggta

SEQ ID NO: 12369 - DNA, 18 bp, Artificial sequence
  synthetic polynucleotide sequence
cgacagtgccagcccaca

SEQ ID NO: 12370 - DNA, 18 bp, Artificial sequence
  synthetic polynucleotide sequence
ggagacacatggcctgga

SEQ ID NO: 12371 - DNA, 17 bp, Artificial sequence
  synthetic polynucleotide sequence
tgcggacctggaggcca

SEQ ID NO: 12372 - DNA, 18 bp, Artificial sequence
  synthetic polynucleotide sequence
ggccaagatgaagcagga

SEQ ID NO: 12373 - DNA, 18 bp, Artificial sequence
  synthetic polynucleotide sequence
cctggaagacggcgtgga

SEQ ID NO: 12374 - DNA, 18 bp, Artificial sequence
  synthetic polynucleotide sequence
accacaggggccaggaga

SEQ ID NO: 12375 - DNA, 18 bp, Artificial sequence
  synthetic polynucleotide sequence
tcagagcgctgagagcca

SEQ ID NO: 12376 - DNA, 18 bp, Artificial sequence
  synthetic polynucleotide sequence
gcctgcgaacagatccga

SEQ ID NO: 12377 - DNA, 18 bp, Artificial sequence
  synthetic polynucleotide sequence
ggttgagcacagcccgga

SEQ ID NO: 12378 - DNA, 18 bp, Artificial sequence
  synthetic polynucleotide sequence
ggttgagcacagcccgga

SEQ ID NO: 12379 - DNA, 18 bp, Artificial sequence
  synthetic polynucleotide sequence
agcccacagtgtacgaga

SEQ ID NO: 12380 - DNA, 18 bp, Artificial sequence
  synthetic polynucleotide sequence
gcacaggggtacagggca

SEQ ID NO: 12381 - DNA, 18 bp, Artificial sequence
  synthetic polynucleotide sequence
gcaagacgtgcctactca

SEQ ID NO: 12382 - DNA, 18 bp, Artificial sequence
  synthetic polynucleotide sequence
ggtcgaagacggtgggca

SEQ ID NO: 12383 - DNA, 18 bp, Artificial sequence
  synthetic polynucleotide sequence
gcccagaggagaaggaga

SEQ ID NO: 12384 - DNA, 18 bp, Artificial sequence
  synthetic polynucleotide sequence
cgtcgaagcacagtccaa

SEQ ID NO: 12385 - DNA, 18 bp, Artificial sequence
  synthetic polynucleotide sequence
tcacccagctcgccacca

SEQ ID NO: 12386 - DNA, 18 bp, Artificial sequence
  synthetic polynucleotide sequence
agctgaggactgcggcca

SEQ ID NO: 12387 - DNA, 18 bp, Artificial sequence
  synthetic polynucleotide sequence
ctgacacccttggccaca

SEQ ID NO: 12388 - DNA, 18 bp, Artificial sequence
  synthetic polynucleotide sequence
cctgtgcggcacacagca

SEQ ID NO: 12389 - DNA, 18 bp, Artificial sequence
  synthetic polynucleotide sequence
gcgggttctcggagagca

SEQ ID NO: 12390 - DNA, 18 bp, Artificial sequence
  synthetic polynucleotide sequence
tcaacaagagccaggcca

SEQ ID NO: 12391 - DNA, 18 bp, Artificial sequence
  synthetic polynucleotide sequence
ggcctggatctggcacga

SEQ ID NO: 12392 - DNA, 18 bp, Artificial sequence
  synthetic polynucleotide sequence
cagggaggttccaagaca

SEQ ID NO: 12393 - DNA, 18 bp, Artificial sequence
  synthetic polynucleotide sequence
gggagctcttcggcacca

SEQ ID NO: 12394 - DNA, 18 bp, Artificial sequence
  synthetic polynucleotide sequence
cgacgattacgggcgaga

SEQ ID NO: 12395 - DNA, 18 bp, Artificial sequence
  synthetic polynucleotide sequence
gctccaactgtacccaca

SEQ ID NO: 12396 - DNA, 18 bp, Artificial sequence
  synthetic polynucleotide sequence
gctccaactgtacccaca

SEQ ID NO: 12397 - DNA, 18 bp, Artificial sequence
  synthetic polynucleotide sequence
tcgacaggcaagccgaga

SEQ ID NO: 12398 - DNA, 18 bp, Artificial sequence
  synthetic polynucleotide sequence
cgtcccactagctgagca

SEQ ID NO: 12399 - DNA, 18 bp, Artificial sequence
  synthetic polynucleotide sequence
ctgacagcaaacccccga

SEQ ID NO: 12400 - DNA, 18 bp, Artificial sequence
  synthetic polynucleotide sequence
tgacgcagggaggcagga

SEQ ID NO: 12401 - DNA, 18 bp, Artificial sequence
  synthetic polynucleotide sequence
ggcctggggacccagcaa

SEQ ID NO: 12402 - DNA, 18 bp, Artificial sequence
  synthetic polynucleotide sequence
cagcataaggtcactgga

SEQ ID NO: 12403 - DNA, 18 bp, Artificial sequence
  synthetic polynucleotide sequence
cccagtgcctgagaccaa

SEQ ID NO: 12404 - DNA, 18 bp, Artificial sequence
  synthetic polynucleotide sequence
gatgaactcgtcccacca

SEQ ID NO: 12405 - DNA, 18 bp, Artificial sequence
  synthetic polynucleotide sequence
agaagcctgccttaacca

SEQ ID NO: 12406 - DNA, 18 bp, Artificial sequence
  synthetic polynucleotide sequence
ggtaaggctgaagaccca

SEQ ID NO: 12407 - DNA, 18 bp, Artificial sequence
  synthetic polynucleotide sequence
agacagccagggcctcca

SEQ ID NO: 12408 - DNA, 18 bp, Artificial sequence
  synthetic polynucleotide sequence
gacctagcacaagcccca

SEQ ID NO: 12409 - DNA, 18 bp, Artificial sequence
  synthetic polynucleotide sequence
gtagcggtatgcagcaga

SEQ ID NO: 12410 - DNA, 18 bp, Artificial sequence
  synthetic polynucleotide sequence
agtccgacgtactgacga

SEQ ID NO: 12411 - DNA, 18 bp, Artificial sequence
  synthetic polynucleotide sequence
tgttacccaccagcacca

SEQ ID NO: 12412 - DNA, 18 bp, Artificial sequence
  synthetic polynucleotide sequence
cgggagcagtacatgcga

SEQ ID NO: 12413 - DNA, 18 bp, Artificial sequence
  synthetic polynucleotide sequence
acatctcggctgccccga

SEQ ID NO: 12414 - DNA, 18 bp, Artificial sequence
  synthetic polynucleotide sequence
acatctcggctgccccga

SEQ ID NO: 12415 - DNA, 18 bp, Artificial sequence
  synthetic polynucleotide sequence
gcccgaaggagagacaca

SEQ ID NO: 12416 - DNA, 18 bp, Artificial sequence
  synthetic polynucleotide sequence
gagtcctccacagaagca

SEQ ID NO: 12417 - DNA, 18 bp, Artificial sequence
  synthetic polynucleotide sequence
taggcttgaccagacaga

SEQ ID NO: 12418 - DNA, 18 bp, Artificial sequence
  synthetic polynucleotide sequence
cccttgagctcacaggca

SEQ ID NO: 12419 - DNA, 18 bp, Artificial sequence
  synthetic polynucleotide sequence
caattccccaggtgccaa

SEQ ID NO: 12420 - DNA, 18 bp, Artificial sequence
  synthetic polynucleotide sequence
gagaatgacctgtcagca

SEQ ID NO: 12421 - DNA, 18 bp, Artificial sequence
  synthetic polynucleotide sequence
tcagggaacctgaccaca

SEQ ID NO: 12422 - DNA, 18 bp, Artificial sequence
  synthetic polynucleotide sequence
gtacctgcaggcagggta

SEQ ID NO: 12423 - DNA, 18 bp, Artificial sequence
  synthetic polynucleotide sequence
atgcgcagacaccagcaa

SEQ ID NO: 12424 - DNA, 18 bp, Artificial sequence
  synthetic polynucleotide sequence
ccaggtgaactggaacca

SEQ ID NO: 12425 - DNA, 18 bp, Artificial sequence
  synthetic polynucleotide sequence
acccggaatctactccga

SEQ ID NO: 12426 - DNA, 18 bp, Artificial sequence
  synthetic polynucleotide sequence
ccattgcaatgcgggcaa

SEQ ID NO: 12427 - DNA, 18 bp, Artificial sequence
  synthetic polynucleotide sequence
gggttaccctcacaggca

SEQ ID NO: 12428 - DNA, 18 bp, Artificial sequence
  synthetic polynucleotide sequence
agggcacccaactgcaga

SEQ ID NO: 12429 - DNA, 18 bp, Artificial sequence
  synthetic polynucleotide sequence
ctatagcggcactgggga

SEQ ID NO: 12430 - DNA, 18 bp, Artificial sequence
  synthetic polynucleotide sequence
aactgccaccagagctca

SEQ ID NO: 12431 - DNA, 18 bp, Artificial sequence
  synthetic polynucleotide sequence
ggggaggcttacaggcca

SEQ ID NO: 12432 - DNA, 18 bp, Artificial sequence
  synthetic polynucleotide sequence
ggggaggcttacaggcca

SEQ ID NO: 12433 - DNA, 18 bp, Artificial sequence
  synthetic polynucleotide sequence
ccagccctcaagcatgca

SEQ ID NO: 12434 - DNA, 18 bp, Artificial sequence
  synthetic polynucleotide sequence
ggtgatggccacactgga

SEQ ID NO: 12435 - DNA, 18 bp, Artificial sequence
  synthetic polynucleotide sequence
gacaaaccaaagagcgga

SEQ ID NO: 12436 - DNA, 18 bp, Artificial sequence
  synthetic polynucleotide sequence
agcctctccagtgccaca

SEQ ID NO: 12437 - DNA, 18 bp, Artificial sequence
  synthetic polynucleotide sequence
tggctcaggctaccccaa

SEQ ID NO: 12438 - DNA, 18 bp, Artificial sequence
  synthetic polynucleotide sequence
tgcgccagctgaaccgga

SEQ ID NO: 12439 - DNA, 18 bp, Artificial sequence
  synthetic polynucleotide sequence
ccacgtgcacagcgggaa

SEQ ID NO: 12440 - DNA, 18 bp, Artificial sequence
  synthetic polynucleotide sequence
ctcacagagggtgacaca

SEQ ID NO: 12441 - DNA, 18 bp, Artificial sequence
  synthetic polynucleotide sequence
cagcactggcctgagaca

SEQ ID NO: 12442 - DNA, 18 bp, Artificial sequence
  synthetic polynucleotide sequence
caggccagtatgccctca

SEQ ID NO: 12443 - DNA, 18 bp, Artificial sequence
  synthetic polynucleotide sequence
atcagcacagcatccgaa

SEQ ID NO: 12444 - DNA, 18 bp, Artificial sequence
  synthetic polynucleotide sequence
aggactgcttccccgaga

SEQ ID NO: 12445 - DNA, 18 bp, Artificial sequence
  synthetic polynucleotide sequence
ataagaaggccaccggca

SEQ ID NO: 12446 - DNA, 18 bp, Artificial sequence
  synthetic polynucleotide sequence
catgtgaaaggaagggga

SEQ ID NO: 12447 - DNA, 18 bp, Artificial sequence
  synthetic polynucleotide sequence
ggcacgtgaaggatctca

SEQ ID NO: 12448 - DNA, 18 bp, Artificial sequence
  synthetic polynucleotide sequence
gactcggctagcaactca

SEQ ID NO: 12449 - DNA, 18 bp, Artificial sequence
  synthetic polynucleotide sequence
ccaggaggttcctcacca

SEQ ID NO: 12450 - DNA, 18 bp, Artificial sequence
  synthetic polynucleotide sequence
ccaggaggttcctcacca

SEQ ID NO: 12451 - DNA, 18 bp, Artificial sequence
  synthetic polynucleotide sequence
agcaggaagcagaggcaa

SEQ ID NO: 12452 - DNA, 18 bp, Artificial sequence
  synthetic polynucleotide sequence
cagccatgggtcaacaca

SEQ ID NO: 12453 - DNA, 18 bp, Artificial sequence
  synthetic polynucleotide sequence
aagatcagccctcggcga

SEQ ID NO: 12454 - DNA, 18 bp, Artificial sequence
  synthetic polynucleotide sequence
agggcactgaggaggcca

SEQ ID NO: 12455 - DNA, 19 bp, Artificial sequence
  synthetic polynucleotide sequence
acttggccactcaagagca

SEQ ID NO: 12456 - DNA, 19 bp, Artificial sequence
  synthetic polynucleotide sequence
ccgacaggacttgcagaca

SEQ ID NO: 12457 - DNA, 18 bp, Artificial sequence
  synthetic polynucleotide sequence
gaagaactcaaggcagca

SEQ ID NO: 12458 - DNA, 18 bp, Artificial sequence
  synthetic polynucleotide sequence
tcgtactgccaccaccca

SEQ ID NO: 12459 - DNA, 18 bp, Artificial sequence
  synthetic polynucleotide sequence
ggggagaatgcacatgca

SEQ ID NO: 12460 - DNA, 18 bp, Artificial sequence
  synthetic polynucleotide sequence
aggcaattgtggcagcca

SEQ ID NO: 12461 - DNA, 18 bp, Artificial sequence
  synthetic polynucleotide sequence
gacgagccatgcgaggga

SEQ ID NO: 12462 - DNA, 18 bp, Artificial sequence
  synthetic polynucleotide sequence
caccatcggaacccggaa

SEQ ID NO: 12463 - DNA, 18 bp, Artificial sequence
  synthetic polynucleotide sequence
gggagctggggctaagga

SEQ ID NO: 12464 - DNA, 18 bp, Artificial sequence
  synthetic polynucleotide sequence
accctgcctcagaaagga

SEQ ID NO: 12465 - DNA, 18 bp, Artificial sequence
  synthetic polynucleotide sequence
ctgccagtcagcccacca

SEQ ID NO: 12466 - DNA, 18 bp, Artificial sequence
  synthetic polynucleotide sequence
tggagtctcagcaggcaa

SEQ ID NO: 12467 - DNA, 18 bp, Artificial sequence
  synthetic polynucleotide sequence
tcactgcctccgccacca

SEQ ID NO: 12468 - DNA, 18 bp, Artificial sequence
  synthetic polynucleotide sequence
tcactgcctccgccacca

SEQ ID NO: 12469 - DNA, 18 bp, Artificial sequence
  synthetic polynucleotide sequence
atcaggaagcaggcccta

SEQ ID NO: 12470 - DNA, 18 bp, Artificial sequence
  synthetic polynucleotide sequence
aacagtggcgttaccaga

SEQ ID NO: 12471 - DNA, 18 bp, Artificial sequence
  synthetic polynucleotide sequence
caggctggcagagaggaa

SEQ ID NO: 12472 - DNA, 18 bp, Artificial sequence
  synthetic polynucleotide sequence
ggccaagctgaggaagga

SEQ ID NO: 12473 - DNA, 18 bp, Artificial sequence
  synthetic polynucleotide sequence
gccatctgcagcagcaca

SEQ ID NO: 12474 - DNA, 18 bp, Artificial sequence
  synthetic polynucleotide sequence
gtcctgcagaatccacca

SEQ ID NO: 12475 - DNA, 18 bp, Artificial sequence
  synthetic polynucleotide sequence
agcagcctggctcatcca

SEQ ID NO: 12476 - DNA, 18 bp, Artificial sequence
  synthetic polynucleotide sequence
cagaactggtgtcacaca

SEQ ID NO: 12477 - DNA, 18 bp, Artificial sequence
  synthetic polynucleotide sequence
gaaggctcgggtcagaga

SEQ ID NO: 12478 - DNA, 18 bp, Artificial sequence
  synthetic polynucleotide sequence
agcactcctcgcagtgca

SEQ ID NO: 12479 - DNA, 18 bp, Artificial sequence
  synthetic polynucleotide sequence
cacactcctgggcaagca

SEQ ID NO: 12480 - DNA, 18 bp, Artificial sequence
  synthetic polynucleotide sequence
cagtctacgcactcccca

SEQ ID NO: 12481 - DNA, 18 bp, Artificial sequence
  synthetic polynucleotide sequence
caccacatactgccggca

SEQ ID NO: 12482 - DNA, 18 bp, Artificial sequence
  synthetic polynucleotide sequence
gcaggatgaggaagacga

SEQ ID NO: 12483 - DNA, 18 bp, Artificial sequence
  synthetic polynucleotide sequence
aggcctgtagcgccctca

SEQ ID NO: 12484 - DNA, 18 bp, Artificial sequence
  synthetic polynucleotide sequence
cccaggaccatgctgaca

SEQ ID NO: 12485 - DNA, 18 bp, Artificial sequence
  synthetic polynucleotide sequence
gaggcgtcaactgggcca

SEQ ID NO: 12486 - DNA, 18 bp, Artificial sequence
  synthetic polynucleotide sequence
gaggcgtcaactgggcca

SEQ ID NO: 12487 - DNA, 18 bp, Artificial sequence
  synthetic polynucleotide sequence
actcccacagtgaagcaa

SEQ ID NO: 12488 - DNA, 18 bp, Artificial sequence
  synthetic polynucleotide sequence
gcggaattctgagaagga

SEQ ID NO: 12489 - DNA, 18 bp, Artificial sequence
  synthetic polynucleotide sequence
tcctcagggccaaggaga

SEQ ID NO: 12490 - DNA, 18 bp, Artificial sequence
  synthetic polynucleotide sequence
gctgaagtgggagcagca

SEQ ID NO: 12491 - DNA, 18 bp, Artificial sequence
  synthetic polynucleotide sequence
ccaaaggcagcaactgga

SEQ ID NO: 12492 - DNA, 18 bp, Artificial sequence
  synthetic polynucleotide sequence
ggagacgaagcgtatgca

SEQ ID NO: 12493 - DNA, 18 bp, Artificial sequence
  synthetic polynucleotide sequence
ggaaagacactccatcca

SEQ ID NO: 12494 - DNA, 18 bp, Artificial sequence
  synthetic polynucleotide sequence
gccttcagcatcaccaca

SEQ ID NO: 12495 - DNA, 18 bp, Artificial sequence
  synthetic polynucleotide sequence
cgactcggactggacaga

SEQ ID NO: 12496 - DNA, 18 bp, Artificial sequence
  synthetic polynucleotide sequence
ggctgtccacaccaggca

SEQ ID NO: 12497 - DNA, 18 bp, Artificial sequence
  synthetic polynucleotide sequence
gccacgatctgctggaca

SEQ ID NO: 12498 - DNA, 18 bp, Artificial sequence
  synthetic polynucleotide sequence
agaccctcgccaaggaga

SEQ ID NO: 12499 - DNA, 18 bp, Artificial sequence
  synthetic polynucleotide sequence
tgtctgcgccgagaagga

SEQ ID NO: 12500 - DNA, 18 bp, Artificial sequence
  synthetic polynucleotide sequence
gctcaggaagctccagca

SEQ ID NO: 12501 - DNA, 18 bp, Artificial sequence
  synthetic polynucleotide sequence
catggaccccgtgacaga

SEQ ID NO: 12502 - DNA, 18 bp, Artificial sequence
  synthetic polynucleotide sequence
ggatacggatgcgccaga

SEQ ID NO: 12503 - DNA, 18 bp, Artificial sequence
  synthetic polynucleotide sequence
gacggtgagtgtagcaga

SEQ ID NO: 12504 - DNA, 18 bp, Artificial sequence
  synthetic polynucleotide sequence
gacggtgagtgtagcaga

SEQ ID NO: 12505 - DNA, 18 bp, Artificial sequence
  synthetic polynucleotide sequence
ggagctgcagcatgccaa

SEQ ID NO: 12506 - DNA, 18 bp, Artificial sequence
  synthetic polynucleotide sequence
gctggagggagatgacga

SEQ ID NO: 12507 - DNA, 18 bp, Artificial sequence
  synthetic polynucleotide sequence
gaagtgaggttagggcga

SEQ ID NO: 12508 - DNA, 18 bp, Artificial sequence
  synthetic polynucleotide sequence
gagcgtttcccaagccca

SEQ ID NO: 12509 - DNA, 18 bp, Artificial sequence
  synthetic polynucleotide sequence
ggtgagagagcggtctga

SEQ ID NO: 12510 - DNA, 18 bp, Artificial sequence
  synthetic polynucleotide sequence
tccgtgaagcgacccaca

SEQ ID NO: 12511 - DNA, 18 bp, Artificial sequence
  synthetic polynucleotide sequence
gaagactgcccacccaga

SEQ ID NO: 12512 - DNA, 18 bp, Artificial sequence
  synthetic polynucleotide sequence
tgggctggcactgaggga

SEQ ID NO: 12513 - DNA, 18 bp, Artificial sequence
  synthetic polynucleotide sequence
cgggaggtgatgtggcaa

SEQ ID NO: 12514 - DNA, 18 bp, Artificial sequence
  synthetic polynucleotide sequence
aggcacggcacattctga

SEQ ID NO: 12515 - DNA, 18 bp, Artificial sequence
  synthetic polynucleotide sequence
ccggtggcacagtcagga

SEQ ID NO: 12516 - DNA, 19 bp, Artificial sequence
  synthetic polynucleotide sequence
gataccaaccatcacggca

SEQ ID NO: 12517 - DNA, 18 bp, Artificial sequence
  synthetic polynucleotide sequence
aagcggcttggaccacga

SEQ ID NO: 12518 - DNA, 18 bp, Artificial sequence
  synthetic polynucleotide sequence
gagcctgtgtagccagca

SEQ ID NO: 12519 - DNA, 18 bp, Artificial sequence
  synthetic polynucleotide sequence
aggcttgccagaagggca

SEQ ID NO: 12520 - DNA, 18 bp, Artificial sequence
  synthetic polynucleotide sequence
cctctaggctcccaggaa

SEQ ID NO: 12521 - DNA, 18 bp, Artificial sequence
  synthetic polynucleotide sequence
cgccaccacagctccaga

SEQ ID NO: 12522 - DNA, 18 bp, Artificial sequence
  synthetic polynucleotide sequence
cgccaccacagctccaga

SEQ ID NO: 12523 - DNA, 19 bp, Artificial sequence
  synthetic polynucleotide sequence
aagagctatgaagacgcca

SEQ ID NO: 12524 - DNA, 19 bp, Artificial sequence
  synthetic polynucleotide sequence
cacagtgtagcagtcacca

SEQ ID NO: 12525 - DNA, 18 bp, Artificial sequence
  synthetic polynucleotide sequence
gagcccgagcccagcaca

SEQ ID NO: 12526 - DNA, 18 bp, Artificial sequence
  synthetic polynucleotide sequence
cccactggcgaacgtcca

SEQ ID NO: 12527 - DNA, 18 bp, Artificial sequence
  synthetic polynucleotide sequence
taaccgccaaggccacca

SEQ ID NO: 12528 - DNA, 18 bp, Artificial sequence
  synthetic polynucleotide sequence
actgagggaagtcatgga

SEQ ID NO: 12529 - DNA, 18 bp, Artificial sequence
  synthetic polynucleotide sequence
caccatgggctaatcaga

SEQ ID NO: 12530 - DNA, 18 bp, Artificial sequence
  synthetic polynucleotide sequence
atagcactgccagacaca

SEQ ID NO: 12531 - DNA, 18 bp, Artificial sequence
  synthetic polynucleotide sequence
cagccatcagcaagccaa

SEQ ID NO: 12532 - DNA, 18 bp, Artificial sequence
  synthetic polynucleotide sequence
cggaattgtcaccccaca

SEQ ID NO: 12533 - DNA, 18 bp, Artificial sequence
  synthetic polynucleotide sequence
actccaggatctgccaca

SEQ ID NO: 12534 - DNA, 18 bp, Artificial sequence
  synthetic polynucleotide sequence
gacccacaggagcagcaa

SEQ ID NO: 12535 - DNA, 18 bp, Artificial sequence
  synthetic polynucleotide sequence
gaacttggtgaagcccca

SEQ ID NO: 12536 - DNA, 18 bp, Artificial sequence
  synthetic polynucleotide sequence
ggccctgcgcagggccaa

SEQ ID NO: 12537 - DNA, 18 bp, Artificial sequence
  synthetic polynucleotide sequence
aaggggccatgactggga

SEQ ID NO: 12538 - DNA, 18 bp, Artificial sequence
  synthetic polynucleotide sequence
agaacgaggagcatgtga

SEQ ID NO: 12539 - DNA, 18 bp, Artificial sequence
  synthetic polynucleotide sequence
ggtgggcactgtgcggaa

SEQ ID NO: 12540 - DNA, 18 bp, Artificial sequence
  synthetic polynucleotide sequence
ggtgggcactgtgcggaa

SEQ ID NO: 12541 - DNA, 18 bp, Artificial sequence
  synthetic polynucleotide sequence
ccgagaggtgtaccggca

SEQ ID NO: 12542 - DNA, 18 bp, Artificial sequence
  synthetic polynucleotide sequence
gcccttggagcggacgta

SEQ ID NO: 12543 - DNA, 16 bp, Artificial sequence
  synthetic polynucleotide sequence
gcccgaatgccagaga

SEQ ID NO: 12544 - DNA, 16 bp, Artificial sequence
  synthetic polynucleotide sequence
gcctggtcagccagga

SEQ ID NO: 12545 - DNA, 18 bp, Artificial sequence
  synthetic polynucleotide sequence
gctacaaaggggtcacca

SEQ ID NO: 12546 - DNA, 18 bp, Artificial sequence
  synthetic polynucleotide sequence
cagcgcgtgccacagaga

SEQ ID NO: 12547 - DNA, 18 bp, Artificial sequence
  synthetic polynucleotide sequence
ggtgtgtgcccaggcaga

SEQ ID NO: 12548 - DNA, 18 bp, Artificial sequence
  synthetic polynucleotide sequence
gcacacatggaaccacca

SEQ ID NO: 12549 - DNA, 18 bp, Artificial sequence
  synthetic polynucleotide sequence
tgagcaagcccaggcaca

SEQ ID NO: 12550 - DNA, 18 bp, Artificial sequence
  synthetic polynucleotide sequence
cccgaatcatgtcccgca

SEQ ID NO: 12551 - DNA, 21 bp, Artificial sequence
  synthetic polynucleotide sequence
ccaccctactagcacagagca

SEQ ID NO: 12552 - DNA, 20 bp, Artificial sequence
  synthetic polynucleotide sequence
ccaaaaggaggcattggaga

SEQ ID NO: 12553 - DNA, 18 bp, Artificial sequence
  synthetic polynucleotide sequence
acccagcggtgtgatgga

SEQ ID NO: 12554 - DNA, 18 bp, Artificial sequence
  synthetic polynucleotide sequence
ctatcaccaccgcacgga

SEQ ID NO: 12555 - DNA, 18 bp, Artificial sequence
  synthetic polynucleotide sequence
tggcaaggcctgcatcca

SEQ ID NO: 12556 - DNA, 18 bp, Artificial sequence
  synthetic polynucleotide sequence
ctatgaaggccaagtgga

SEQ ID NO: 12557 - DNA, 18 bp, Artificial sequence
  synthetic polynucleotide sequence
aggtagccctggagctga

SEQ ID NO: 12558 - DNA, 18 bp, Artificial sequence
  synthetic polynucleotide sequence
aggtagccctggagctga

SEQ ID NO: 12559 - DNA, 18 bp, Artificial sequence
  synthetic polynucleotide sequence
gtggggtaacagaaagga

SEQ ID NO: 12560 - DNA, 18 bp, Artificial sequence
  synthetic polynucleotide sequence
aagcaacacctggtctca

SEQ ID NO: 12561 - DNA, 18 bp, Artificial sequence
  synthetic polynucleotide sequence
ggggcaactcctccccca

SEQ ID NO: 12562 - DNA, 18 bp, Artificial sequence
  synthetic polynucleotide sequence
ccagcaggtacactggca

SEQ ID NO: 12563 - DNA, 18 bp, Artificial sequence
  synthetic polynucleotide sequence
cagccgcagaagccagga

SEQ ID NO: 12564 - DNA, 18 bp, Artificial sequence
  synthetic polynucleotide sequence
ggtggagatgtcccggga

SEQ ID NO: 12565 - DNA, 18 bp, Artificial sequence
  synthetic polynucleotide sequence
ccagaagactggccagga

SEQ ID NO: 12566 - DNA, 18 bp, Artificial sequence
  synthetic polynucleotide sequence
gtgtaggtgccagaggca

SEQ ID NO: 12567 - DNA, 18 bp, Artificial sequence
  synthetic polynucleotide sequence
cgaggctacgtgaaggaa

SEQ ID NO: 12568 - DNA, 18 bp, Artificial sequence
  synthetic polynucleotide sequence
caggtcgctcaccctcca

SEQ ID NO: 12569 - DNA, 18 bp, Artificial sequence
  synthetic polynucleotide sequence
cacagttggatgcaagca

SEQ ID NO: 12570 - DNA, 18 bp, Artificial sequence
  synthetic polynucleotide sequence
gcacgtggaattcgcgaa

SEQ ID NO: 12571 - DNA, 18 bp, Artificial sequence
  synthetic polynucleotide sequence
aagggctctgagggccga

SEQ ID NO: 12572 - DNA, 18 bp, Artificial sequence
  synthetic polynucleotide sequence
ggcccagaggtgcaagga

SEQ ID NO: 12573 - DNA, 18 bp, Artificial sequence
  synthetic polynucleotide sequence
ccccagcgccaccccgga

SEQ ID NO: 12574 - DNA, 18 bp, Artificial sequence
  synthetic polynucleotide sequence
gaagctgaaagtccccga

SEQ ID NO: 12575 - DNA, 18 bp, Artificial sequence
  synthetic polynucleotide sequence
ctgagtccgctgcacgga

SEQ ID NO: 12576 - DNA, 18 bp, Artificial sequence
  synthetic polynucleotide sequence
ctgagtccgctgcacgga

SEQ ID NO: 12577 - DNA, 18 bp, Artificial sequence
  synthetic polynucleotide sequence
tgccattgcccaggcaga

SEQ ID NO: 12578 - DNA, 18 bp, Artificial sequence
  synthetic polynucleotide sequence
atcatcaggccatccaca

SEQ ID NO: 12579 - DNA, 18 bp, Artificial sequence
  synthetic polynucleotide sequence
cctgcgccgtgtgaacca

SEQ ID NO: 12580 - DNA, 18 bp, Artificial sequence
  synthetic polynucleotide sequence
gagctcatctgccaggca

SEQ ID NO: 12581 - DNA, 18 bp, Artificial sequence
  synthetic polynucleotide sequence
agctagcagaatccgcaa

SEQ ID NO: 12582 - DNA, 18 bp, Artificial sequence
  synthetic polynucleotide sequence
ggagtaacaagacgctga

SEQ ID NO: 12583 - DNA, 18 bp, Artificial sequence
  synthetic polynucleotide sequence
ggacctgaagcccagcaa

SEQ ID NO: 12584 - DNA, 18 bp, Artificial sequence
  synthetic polynucleotide sequence
agccctggcgcttcagca

SEQ ID NO: 12585 - DNA, 18 bp, Artificial sequence
  synthetic polynucleotide sequence
ccgtgggtggtcaacaga

SEQ ID NO: 12586 - DNA, 18 bp, Artificial sequence
  synthetic polynucleotide sequence
atgacagcacgggctcca

SEQ ID NO: 12587 - DNA, 19 bp, Artificial sequence
  synthetic polynucleotide sequence
tccgctgagcaagagtaga

SEQ ID NO: 12588 - DNA, 19 bp, Artificial sequence
  synthetic polynucleotide sequence
acagacaggatgcaccaca

SEQ ID NO: 12589 - DNA, 18 bp, Artificial sequence
  synthetic polynucleotide sequence
ggagatgttcgagggcaa

SEQ ID NO: 12590 - DNA, 18 bp, Artificial sequence
  synthetic polynucleotide sequence
cacattaggcagtcgcca

SEQ ID NO: 12591 - DNA, 18 bp, Artificial sequence
  synthetic polynucleotide sequence
gtgtgaggtagggaggca

SEQ ID NO: 12592 - DNA, 18 bp, Artificial sequence
  synthetic polynucleotide sequence
ctgactggagcaccccca

SEQ ID NO: 12593 - DNA, 18 bp, Artificial sequence
  synthetic polynucleotide sequence
tctgggaatccaggcgga

SEQ ID NO: 12594 - DNA, 18 bp, Artificial sequence
  synthetic polynucleotide sequence
tctgggaatccaggcgga

SEQ ID NO: 12595 - DNA, 18 bp, Artificial sequence
  synthetic polynucleotide sequence
ccatgcaacaacaaggga

SEQ ID NO: 12596 - DNA, 18 bp, Artificial sequence
  synthetic polynucleotide sequence
gtgaactcaggagcggga

SEQ ID NO: 12597 - DNA, 18 bp, Artificial sequence
  synthetic polynucleotide sequence
gtccggatctgggacaca

SEQ ID NO: 12598 - DNA, 18 bp, Artificial sequence
  synthetic polynucleotide sequence
gtacgtcatgacgcggca

SEQ ID NO: 12599 - DNA, 18 bp, Artificial sequence
  synthetic polynucleotide sequence
gcacaccagtctaacaga

SEQ ID NO: 12600 - DNA, 18 bp, Artificial sequence
  synthetic polynucleotide sequence
caaggctggtgagccgga

SEQ ID NO: 12601 - DNA, 18 bp, Artificial sequence
  synthetic polynucleotide sequence
gtggacggagaagaggca

SEQ ID NO: 12602 - DNA, 18 bp, Artificial sequence
  synthetic polynucleotide sequence
ccacgaggatgatgggca

SEQ ID NO: 12603 - DNA, 18 bp, Artificial sequence
  synthetic polynucleotide sequence
tggagcaggaacccccta

SEQ ID NO: 12604 - DNA, 18 bp, Artificial sequence
  synthetic polynucleotide sequence
aatggccttccggaagca

SEQ ID NO: 12605 - DNA, 18 bp, Artificial sequence
  synthetic polynucleotide sequence
tgggagggctcggtggga

SEQ ID NO: 12606 - DNA, 18 bp, Artificial sequence
  synthetic polynucleotide sequence
gcgtctcaacgtggacga

SEQ ID NO: 12607 - DNA, 18 bp, Artificial sequence
  synthetic polynucleotide sequence
cggcgatgtagtcgcaga

SEQ ID NO: 12608 - DNA, 18 bp, Artificial sequence
  synthetic polynucleotide sequence
ggagatcacagaggggga

SEQ ID NO: 12609 - DNA, 18 bp, Artificial sequence
  synthetic polynucleotide sequence
gctgtaggcatcggggca

SEQ ID NO: 12610 - DNA, 18 bp, Artificial sequence
  synthetic polynucleotide sequence
tgaccttgccaaggagca

SEQ ID NO: 12611 - DNA, 18 bp, Artificial sequence
  synthetic polynucleotide sequence
ggacgcgggtcccgctca

SEQ ID NO: 12612 - DNA, 18 bp, Artificial sequence
  synthetic polynucleotide sequence
ggacgcgggtcccgctca

SEQ ID NO: 12613 - DNA, 18 bp, Artificial sequence
  synthetic polynucleotide sequence
ggaggtgcaggttccaga

SEQ ID NO: 12614 - DNA, 18 bp, Artificial sequence
  synthetic polynucleotide sequence
tatccatcgcaaggccca

SEQ ID NO: 12615 - DNA, 18 bp, Artificial sequence
  synthetic polynucleotide sequence
cactgccctcatcccaga

SEQ ID NO: 12616 - DNA, 18 bp, Artificial sequence
  synthetic polynucleotide sequence
aggccagaagcaggcaca

SEQ ID NO: 12617 - DNA, 18 bp, Artificial sequence
  synthetic polynucleotide sequence
aagtggccactgcagcca

SEQ ID NO: 12618 - DNA, 18 bp, Artificial sequence
  synthetic polynucleotide sequence
cctgggccatgtcacaca

SEQ ID NO: 12619 - DNA, 18 bp, Artificial sequence
  synthetic polynucleotide sequence
cttcacaggacaccggga

SEQ ID NO: 12620 - DNA, 18 bp, Artificial sequence
  synthetic polynucleotide sequence
cccagccgtcacacagca

SEQ ID NO: 12621 - DNA, 18 bp, Artificial sequence
  synthetic polynucleotide sequence
actcggaccgcacctcca

SEQ ID NO: 12622 - DNA, 18 bp, Artificial sequence
  synthetic polynucleotide sequence
cgcactccagcagctcca

SEQ ID NO: 12623 - DNA, 18 bp, Artificial sequence
  synthetic polynucleotide sequence
agattcaggcaccaagca

SEQ ID NO: 12624 - DNA, 18 bp, Artificial sequence
  synthetic polynucleotide sequence
aggacatgacggaacaga

SEQ ID NO: 12625 - DNA, 18 bp, Artificial sequence
  synthetic polynucleotide sequence
gcattcccaccaactcga

SEQ ID NO: 12626 - DNA, 18 bp, Artificial sequence
  synthetic polynucleotide sequence
caggcctgaaaccagaga

SEQ ID NO: 12627 - DNA, 18 bp, Artificial sequence
  synthetic polynucleotide sequence
tctgagggcaggacccta

SEQ ID NO: 12628 - DNA, 18 bp, Artificial sequence
  synthetic polynucleotide sequence
gcaaacggctacaccgga

SEQ ID NO: 12629 - DNA, 18 bp, Artificial sequence
  synthetic polynucleotide sequence
gcgtcaagagagcgtcca

SEQ ID NO: 12630 - DNA, 18 bp, Artificial sequence
  synthetic polynucleotide sequence
gcgtcaagagagcgtcca

SEQ ID NO: 12631 - DNA, 18 bp, Artificial sequence
  synthetic polynucleotide sequence
gccctgctccaagaagca

SEQ ID NO: 12632 - DNA, 18 bp, Artificial sequence
  synthetic polynucleotide sequence
gcccctcaggacacggca

SEQ ID NO: 12633 - DNA, 18 bp, Artificial sequence
  synthetic polynucleotide sequence
gcaaccgatggagacgca

SEQ ID NO: 12634 - DNA, 18 bp, Artificial sequence
  synthetic polynucleotide sequence
tgacatcggctacaccca

SEQ ID NO: 12635 - DNA, 18 bp, Artificial sequence
  synthetic polynucleotide sequence
cggcaagtgcctgcacga

SEQ ID NO: 12636 - DNA, 18 bp, Artificial sequence
  synthetic polynucleotide sequence
gctgaagcagctctcaca

SEQ ID NO: 12637 - DNA, 18 bp, Artificial sequence
  synthetic polynucleotide sequence
gaagatccactgggacca

SEQ ID NO: 12638 - DNA, 18 bp, Artificial sequence
  synthetic polynucleotide sequence
tctcggccaagcagccta

SEQ ID NO: 12639 - DNA, 18 bp, Artificial sequence
  synthetic polynucleotide sequence
aggagctgcccacacaga

SEQ ID NO: 12640 - DNA, 18 bp, Artificial sequence
  synthetic polynucleotide sequence
caatatctggcggcagga

SEQ ID NO: 12641 - DNA, 18 bp, Artificial sequence
  synthetic polynucleotide sequence
cgaaccaggcctggcaga

SEQ ID NO: 12642 - DNA, 18 bp, Artificial sequence
  synthetic polynucleotide sequence
ccgagccctgaatgcgaa

SEQ ID NO: 12643 - DNA, 18 bp, Artificial sequence
  synthetic polynucleotide sequence
ccacagccatgagcagca

SEQ ID NO: 12644 - DNA, 18 bp, Artificial sequence
  synthetic polynucleotide sequence
gaaaaccgacgaaggcca

SEQ ID NO: 12645 - DNA, 18 bp, Artificial sequence
  synthetic polynucleotide sequence
cataggtcatcagccaca

SEQ ID NO: 12646 - DNA, 18 bp, Artificial sequence
  synthetic polynucleotide sequence
tcagaagaaggccatcca

SEQ ID NO: 12647 - DNA, 18 bp, Artificial sequence
  synthetic polynucleotide sequence
acccacatcaacactgca

SEQ ID NO: 12648 - DNA, 18 bp, Artificial sequence
  synthetic polynucleotide sequence
acccacatcaacactgca

SEQ ID NO: 12649 - DNA, 18 bp, Artificial sequence
  synthetic polynucleotide sequence
cctccgcctcaacggcaa

SEQ ID NO: 12650 - DNA, 18 bp, Artificial sequence
  synthetic polynucleotide sequence
agtcctcggccctcagca

SEQ ID NO: 12651 - DNA, 18 bp, Artificial sequence
  synthetic polynucleotide sequence
gcggctgctcacagagca

SEQ ID NO: 12652 - DNA, 18 bp, Artificial sequence
  synthetic polynucleotide sequence
tagcgttgagccgcagga

SEQ ID NO: 12653 - DNA, 18 bp, Artificial sequence
  synthetic polynucleotide sequence
gatcccatgacacagcca

SEQ ID NO: 12654 - DNA, 18 bp, Artificial sequence
  synthetic polynucleotide sequence
gcgaggtacacagcacca

SEQ ID NO: 12655 - DNA, 18 bp, Artificial sequence
  synthetic polynucleotide sequence
ggccatgctcctgaggaa

SEQ ID NO: 12656 - DNA, 18 bp, Artificial sequence
  synthetic polynucleotide sequence
ggcagacaagcctgcaca

SEQ ID NO: 12657 - DNA, 18 bp, Artificial sequence
  synthetic polynucleotide sequence
gccggaactgtggccaca

SEQ ID NO: 12658 - DNA, 18 bp, Artificial sequence
  synthetic polynucleotide sequence
agctgtcgcacactcgca

SEQ ID NO: 12659 - DNA, 18 bp, Artificial sequence
  synthetic polynucleotide sequence
gtggtagcgcgtggccga

SEQ ID NO: 12660 - DNA, 18 bp, Artificial sequence
  synthetic polynucleotide sequence
actctcaacggcacccga

SEQ ID NO: 12661 - DNA, 18 bp, Artificial sequence
  synthetic polynucleotide sequence
tccgctccgcctcagaca

SEQ ID NO: 12662 - DNA, 18 bp, Artificial sequence
  synthetic polynucleotide sequence
ctagacgcgcatcgggaa

SEQ ID NO: 12663 - DNA, 18 bp, Artificial sequence
  synthetic polynucleotide sequence
gtaggggaaggcagctga

SEQ ID NO: 12664 - DNA, 18 bp, Artificial sequence
  synthetic polynucleotide sequence
ccttccccacgctgccaa

SEQ ID NO: 12665 - DNA, 18 bp, Artificial sequence
  synthetic polynucleotide sequence
gctggcccatcatggaca

SEQ ID NO: 12666 - DNA, 18 bp, Artificial sequence
  synthetic polynucleotide sequence
gctggcccatcatggaca

SEQ ID NO: 12667 - DNA, 18 bp, Artificial sequence
  synthetic polynucleotide sequence
cgtcactgcgctacgcca

SEQ ID NO: 12668 - DNA, 18 bp, Artificial sequence
  synthetic polynucleotide sequence
agcgggactcgtccagga

SEQ ID NO: 12669 - DNA, 18 bp, Artificial sequence
  synthetic polynucleotide sequence
cgctcaccacctggagca

SEQ ID NO: 12670 - DNA, 18 bp, Artificial sequence
  synthetic polynucleotide sequence
gaggacggggttgaggca

SEQ ID NO: 12671 - DNA, 18 bp, Artificial sequence
  synthetic polynucleotide sequence
ggaggcctactgcaagca

SEQ ID NO: 12672 - DNA, 18 bp, Artificial sequence
  synthetic polynucleotide sequence
tgagcccgatggagcgca

SEQ ID NO: 12673 - DNA, 18 bp, Artificial sequence
  synthetic polynucleotide sequence
taccctgagcagcaggga

SEQ ID NO: 12674 - DNA, 18 bp, Artificial sequence
  synthetic polynucleotide sequence
gatggggagcctcaagca

SEQ ID NO: 12675 - DNA, 18 bp, Artificial sequence
  synthetic polynucleotide sequence
tgggatgcctgcgagcca

SEQ ID NO: 12676 - DNA, 18 bp, Artificial sequence
  synthetic polynucleotide sequence
gcagcagcagcttggcaa

SEQ ID NO: 12677 - DNA, 18 bp, Artificial sequence
  synthetic polynucleotide sequence
tgggatgactccacgcca

SEQ ID NO: 12678 - DNA, 18 bp, Artificial sequence
  synthetic polynucleotide sequence
ccactagcaacgcgcaga

SEQ ID NO: 12679 - DNA, 18 bp, Artificial sequence
  synthetic polynucleotide sequence
ggcagcagctagcaacca

SEQ ID NO: 12680 - DNA, 18 bp, Artificial sequence
  synthetic polynucleotide sequence
tcctgggcatgcacgaga

SEQ ID NO: 12681 - DNA, 18 bp, Artificial sequence
  synthetic polynucleotide sequence
caggccactgtgagagca

SEQ ID NO: 12682 - DNA, 18 bp, Artificial sequence
  synthetic polynucleotide sequence
tgaaggagctagacgaga

SEQ ID NO: 12683 - DNA, 18 bp, Artificial sequence
  synthetic polynucleotide sequence
caagccatagctaggcca

SEQ ID NO: 12684 - DNA, 18 bp, Artificial sequence
  synthetic polynucleotide sequence
caagccatagctaggcca

SEQ ID NO: 12685 - DNA, 18 bp, Artificial sequence
  synthetic polynucleotide sequence
aggagcttgcaaacacca

SEQ ID NO: 12686 - DNA, 18 bp, Artificial sequence
  synthetic polynucleotide sequence
tgggcagccttcagcgca

SEQ ID NO: 12687 - DNA, 18 bp, Artificial sequence
  synthetic polynucleotide sequence
gccggaaggatagcctca

SEQ ID NO: 12688 - DNA, 18 bp, Artificial sequence
  synthetic polynucleotide sequence
tcatcaagagagcccaca

SEQ ID NO: 12689 - DNA, 18 bp, Artificial sequence
  synthetic polynucleotide sequence
ggacacagggaaccggaa

SEQ ID NO: 12690 - DNA, 18 bp, Artificial sequence
  synthetic polynucleotide sequence
gccgcctatcaaggtcca

SEQ ID NO: 12691 - DNA, 18 bp, Artificial sequence
  synthetic polynucleotide sequence
gcaggtggacttccagga

SEQ ID NO: 12692 - DNA, 18 bp, Artificial sequence
  synthetic polynucleotide sequence
gtctgggcagccctggaa

SEQ ID NO: 12693 - DNA, 17 bp, Artificial sequence
  synthetic polynucleotide sequence
gggcaaagagggtgaca

SEQ ID NO: 12694 - DNA, 18 bp, Artificial sequence
  synthetic polynucleotide sequence
gcaggacaggaagacaca

SEQ ID NO: 12695 - DNA, 17 bp, Artificial sequence
  synthetic polynucleotide sequence
atggtcaggaacaccga

SEQ ID NO: 12696 - DNA, 17 bp, Artificial sequence
  synthetic polynucleotide sequence
ggggagagagggtagca

SEQ ID NO: 12697 - DNA, 16 bp, Artificial sequence
  synthetic polynucleotide sequence
ccccaggaaggtgaca

SEQ ID NO: 12698 - DNA, 17 bp, Artificial sequence
  synthetic polynucleotide sequence
caagcacaccctgagca

SEQ ID NO: 12699 - DNA, 20 bp, Artificial sequence
  synthetic polynucleotide sequence
ggcactaaggaagttgggga

SEQ ID NO: 12700 - DNA, 20 bp, Artificial sequence
  synthetic polynucleotide sequence
gagcaacactcaagctgaga

SEQ ID NO: 12701 - DNA, 21 bp, Artificial sequence
  synthetic polynucleotide sequence
ccagaatgaggaactcctgga

SEQ ID NO: 12702 - DNA, 21 bp, Artificial sequence
  synthetic polynucleotide sequence
ccagaatgaggaactcctgga

SEQ ID NO: 12703 - DNA, 18 bp, Artificial sequence
  synthetic polynucleotide sequence
gtcgcagctggaacgcaa

SEQ ID NO: 12704 - DNA, 18 bp, Artificial sequence
  synthetic polynucleotide sequence
gggtgccccagcttcaca

SEQ ID NO: 12705 - DNA, 18 bp, Artificial sequence
  synthetic polynucleotide sequence
caatgatggagacggcga

SEQ ID NO: 12706 - DNA, 18 bp, Artificial sequence
  synthetic polynucleotide sequence
ggcaggcagtagtaacca

SEQ ID NO: 12707 - DNA, 21 bp, Artificial sequence
  synthetic polynucleotide sequence
caaagaaggtgatccagacca

SEQ ID NO: 12708 - DNA, 22 bp, Artificial sequence
  synthetic polynucleotide sequence
cataggataagaccacagcaca

SEQ ID NO: 12709 - DNA, 18 bp, Artificial sequence
  synthetic polynucleotide sequence
gcgagggcagcacgcaga

SEQ ID NO: 12710 - DNA, 17 bp, Artificial sequence
  synthetic polynucleotide sequence
gattgcagccacgaaca

SEQ ID NO: 12711 - DNA, 19 bp, Artificial sequence
  synthetic polynucleotide sequence
cgtgccaaaaggaaaccca

SEQ ID NO: 12712 - DNA, 18 bp, Artificial sequence
  synthetic polynucleotide sequence
caactgtcagagctgcca

SEQ ID NO: 12713 - DNA, 18 bp, Artificial sequence
  synthetic polynucleotide sequence
agagtctccgctcgggca

SEQ ID NO: 12714 - DNA, 18 bp, Artificial sequence
  synthetic polynucleotide sequence
actccggcaccaacccca

SEQ ID NO: 12715 - DNA, 18 bp, Artificial sequence
  synthetic polynucleotide sequence
cgtggcttgagcggacca

SEQ ID NO: 12716 - DNA, 18 bp, Artificial sequence
  synthetic polynucleotide sequence
gcctctctacgccaagca

SEQ ID NO: 12717 - DNA, 18 bp, Artificial sequence
  synthetic polynucleotide sequence
gccagtcccaggaaggga

SEQ ID NO: 12718 - DNA, 18 bp, Artificial sequence
  synthetic polynucleotide sequence
ctgcggggaccacctcga

SEQ ID NO: 12719 - DNA, 18 bp, Artificial sequence
  synthetic polynucleotide sequence
agttcccccgagcatgga

SEQ ID NO: 12720 - DNA, 18 bp, Artificial sequence
  synthetic polynucleotide sequence
agttcccccgagcatgga

SEQ ID NO: 12721 - DNA, 18 bp, Artificial sequence
  synthetic polynucleotide sequence
ggagagcctactctgaca

SEQ ID NO: 12722 - DNA, 18 bp, Artificial sequence
  synthetic polynucleotide sequence
gcagcccaggcaccccca

SEQ ID NO: 12723 - DNA, 18 bp, Artificial sequence
  synthetic polynucleotide sequence
gcagagcctattgggaca

SEQ ID NO: 12724 - DNA, 18 bp, Artificial sequence
  synthetic polynucleotide sequence
agaccctggaacggctga

SEQ ID NO: 12725 - DNA, 18 bp, Artificial sequence
  synthetic polynucleotide sequence
ccctgccctacctgccaa

SEQ ID NO: 12726 - DNA, 18 bp, Artificial sequence
  synthetic polynucleotide sequence
gggccaagaggttgacca

SEQ ID NO: 12727 - DNA, 18 bp, Artificial sequence
  synthetic polynucleotide sequence
tggccaacaggcacctga

SEQ ID NO: 12728 - DNA, 18 bp, Artificial sequence
  synthetic polynucleotide sequence
gacaggaagccatcagga

SEQ ID NO: 12729 - DNA, 18 bp, Artificial sequence
  synthetic polynucleotide sequence
gcctcaagtccgtggaga

SEQ ID NO: 12730 - DNA, 18 bp, Artificial sequence
  synthetic polynucleotide sequence
aggacgaggactcggaca

SEQ ID NO: 12731 - DNA, 18 bp, Artificial sequence
  synthetic polynucleotide sequence
taagcaagtgggcctcca

SEQ ID NO: 12732 - DNA, 18 bp, Artificial sequence
  synthetic polynucleotide sequence
gatgtgtggaaggaggaa

SEQ ID NO: 12733 - DNA, 18 bp, Artificial sequence
  synthetic polynucleotide sequence
cagagggccttcaatgga

SEQ ID NO: 12734 - DNA, 18 bp, Artificial sequence
  synthetic polynucleotide sequence
tggtcaggctgaaggcaa

SEQ ID NO: 12735 - DNA, 18 bp, Artificial sequence
  synthetic polynucleotide sequence
gcgcctgaggaaggagca

SEQ ID NO: 12736 - DNA, 18 bp, Artificial sequence
  synthetic polynucleotide sequence
agcccgagaaccccctca

SEQ ID NO: 12737 - DNA, 18 bp, Artificial sequence
  synthetic polynucleotide sequence
gcatgctgaatccgcgga

SEQ ID NO: 12738 - DNA, 18 bp, Artificial sequence
  synthetic polynucleotide sequence
gcatgctgaatccgcgga

SEQ ID NO: 12739 - DNA, 18 bp, Artificial sequence
  synthetic polynucleotide sequence
agagctcatcaagtggca

SEQ ID NO: 12740 - DNA, 18 bp, Artificial sequence
  synthetic polynucleotide sequence
ggtcctgaataggggcca

SEQ ID NO: 12741 - DNA, 18 bp, Artificial sequence
  synthetic polynucleotide sequence
ggataagagcgcaaggca

SEQ ID NO: 12742 - DNA, 18 bp, Artificial sequence
  synthetic polynucleotide sequence
acaggtgaatcacctcca

SEQ ID NO: 12743 - DNA, 18 bp, Artificial sequence
  synthetic polynucleotide sequence
ggtgggcacgagcaagca

SEQ ID NO: 12744 - DNA, 18 bp, Artificial sequence
  synthetic polynucleotide sequence
ggattccacgaggcgaga

SEQ ID NO: 12745 - DNA, 18 bp, Artificial sequence
  synthetic polynucleotide sequence
gggcgcaacatgaggaga

SEQ ID NO: 12746 - DNA, 18 bp, Artificial sequence
  synthetic polynucleotide sequence
tcgtactcgaggaccgga

SEQ ID NO: 12747 - DNA, 18 bp, Artificial sequence
  synthetic polynucleotide sequence
cattccagcagcaacaca

SEQ ID NO: 12748 - DNA, 18 bp, Artificial sequence
  synthetic polynucleotide sequence
gaaccagggtggctggta

SEQ ID NO: 12749 - DNA, 18 bp, Artificial sequence
  synthetic polynucleotide sequence
cacttctgcaaccaggca

SEQ ID NO: 12750 - DNA, 18 bp, Artificial sequence
  synthetic polynucleotide sequence
actgcggctgatcaagga

SEQ ID NO: 12751 - DNA, 18 bp, Artificial sequence
  synthetic polynucleotide sequence
ggcaggacccatggccga

SEQ ID NO: 12752 - DNA, 18 bp, Artificial sequence
  synthetic polynucleotide sequence
ctaccagtgggtacgcga

SEQ ID NO: 12753 - DNA, 18 bp, Artificial sequence
  synthetic polynucleotide sequence
ggaaggttcaggaagcga

SEQ ID NO: 12754 - DNA, 18 bp, Artificial sequence
  synthetic polynucleotide sequence
cgctggaaggagaaccca

SEQ ID NO: 12755 - DNA, 18 bp, Artificial sequence
  synthetic polynucleotide sequence
ccaggtcagccagctgga

SEQ ID NO: 12756 - DNA, 18 bp, Artificial sequence
  synthetic polynucleotide sequence
ccaggtcagccagctgga

SEQ ID NO: 12757 - DNA, 18 bp, Artificial sequence
  synthetic polynucleotide sequence
agagaccatacaccgtga

SEQ ID NO: 12758 - DNA, 18 bp, Artificial sequence
  synthetic polynucleotide sequence
ggatgaaccgaagcctca

SEQ ID NO: 12759 - DNA, 18 bp, Artificial sequence
  synthetic polynucleotide sequence
cctggacgtggagaagga

SEQ ID NO: 12760 - DNA, 18 bp, Artificial sequence
  synthetic polynucleotide sequence
tcctcgataccgggagca

SEQ ID NO: 12761 - DNA, 18 bp, Artificial sequence
  synthetic polynucleotide sequence
atcaagtccgtcgagaga

SEQ ID NO: 12762 - DNA, 18 bp, Artificial sequence
  synthetic polynucleotide sequence
tccagcaagaacagtgca

SEQ ID NO: 12763 - DNA, 18 bp, Artificial sequence
  synthetic polynucleotide sequence
gaaggggtctcgtcggaa

SEQ ID NO: 12764 - DNA, 18 bp, Artificial sequence
  synthetic polynucleotide sequence
ccgggaagaacaggagga

SEQ ID NO: 12765 - DNA, 18 bp, Artificial sequence
  synthetic polynucleotide sequence
cgcagaggcctatgggaa

SEQ ID NO: 12766 - DNA, 18 bp, Artificial sequence
  synthetic polynucleotide sequence
cttgtgaggagcaagcga

SEQ ID NO: 12767 - DNA, 18 bp, Artificial sequence
  synthetic polynucleotide sequence
gcaccgcagggttggaga

SEQ ID NO: 12768 - DNA, 18 bp, Artificial sequence
  synthetic polynucleotide sequence
ccgaagggcaacacagca

SEQ ID NO: 12769 - DNA, 18 bp, Artificial sequence
  synthetic polynucleotide sequence
ggcagatgacagggacca

SEQ ID NO: 12770 - DNA, 18 bp, Artificial sequence
  synthetic polynucleotide sequence
cggtcacgggaatcccca

SEQ ID NO: 12771 - DNA, 18 bp, Artificial sequence
  synthetic polynucleotide sequence
gagagatatcgggcctga

SEQ ID NO: 12772 - DNA, 18 bp, Artificial sequence
  synthetic polynucleotide sequence
gactcacacagttgacga

SEQ ID NO: 12773 - DNA, 18 bp, Artificial sequence
  synthetic polynucleotide sequence
cggaagacagagcggaca

SEQ ID NO: 12774 - DNA, 18 bp, Artificial sequence
  synthetic polynucleotide sequence
cggaagacagagcggaca

SEQ ID NO: 12775 - DNA, 18 bp, Artificial sequence
  synthetic polynucleotide sequence
cttgtgcgcaaacaccca

SEQ ID NO: 12776 - DNA, 18 bp, Artificial sequence
  synthetic polynucleotide sequence
gggcagcactgttcacca

SEQ ID NO: 12777 - DNA, 18 bp, Artificial sequence
  synthetic polynucleotide sequence
cacacggaagcagcagga

SEQ ID NO: 12778 - DNA, 18 bp, Artificial sequence
  synthetic polynucleotide sequence
cggttgagcaccacccta

SEQ ID NO: 12779 - DNA, 18 bp, Artificial sequence
  synthetic polynucleotide sequence
ggccagatatcacagaca

SEQ ID NO: 12780 - DNA, 18 bp, Artificial sequence
  synthetic polynucleotide sequence
agggcctctggaagctga

SEQ ID NO: 12781 - DNA, 18 bp, Artificial sequence
  synthetic polynucleotide sequence
gactgaggccctaccaga

SEQ ID NO: 12782 - DNA, 18 bp, Artificial sequence
  synthetic polynucleotide sequence
acatgtggaatccaggca

SEQ ID NO: 12783 - DNA, 21 bp, Artificial sequence
  synthetic polynucleotide sequence
cagtgaagacaactttgagga

SEQ ID NO: 12784 - DNA, 21 bp, Artificial sequence
  synthetic polynucleotide sequence
ggaaacaccttcttctggaga

SEQ ID NO: 12785 - DNA, 18 bp, Artificial sequence
  synthetic polynucleotide sequence
cacttgcccaagcctgga

SEQ ID NO: 12786 - DNA, 18 bp, Artificial sequence
  synthetic polynucleotide sequence
cacccctgacactgcaga

SEQ ID NO: 12787 - DNA, 18 bp, Artificial sequence
  synthetic polynucleotide sequence
gcaccagcagcttgacca

SEQ ID NO: 12788 - DNA, 18 bp, Artificial sequence
  synthetic polynucleotide sequence
aagatgccaaggcagcaa

SEQ ID NO: 12789 - DNA, 18 bp, Artificial sequence
  synthetic polynucleotide sequence
ggccatcgtatccacgca

SEQ ID NO: 12790 - DNA, 18 bp, Artificial sequence
  synthetic polynucleotide sequence
tgctaccgggcaaatgca

SEQ ID NO: 12791 - DNA, 18 bp, Artificial sequence
  synthetic polynucleotide sequence
acagcttccggaggggca

SEQ ID NO: 12792 - DNA, 18 bp, Artificial sequence
  synthetic polynucleotide sequence
acagcttccggaggggca

SEQ ID NO: 12793 - DNA, 18 bp, Artificial sequence
  synthetic polynucleotide sequence
agctgagctcacagccga

SEQ ID NO: 12794 - DNA, 18 bp, Artificial sequence
  synthetic polynucleotide sequence
agaagcaacagctgggca

SEQ ID NO: 12795 - DNA, 18 bp, Artificial sequence
  synthetic polynucleotide sequence
cccgcgactgaacaccga

SEQ ID NO: 12796 - DNA, 18 bp, Artificial sequence
  synthetic polynucleotide sequence
caataaggggcagccaga

SEQ ID NO: 12797 - DNA, 18 bp, Artificial sequence
  synthetic polynucleotide sequence
tgctgagcagcctgggca

SEQ ID NO: 12798 - DNA, 18 bp, Artificial sequence
  synthetic polynucleotide sequence
gcctggggacccagctca

SEQ ID NO: 12799 - DNA, 18 bp, Artificial sequence
  synthetic polynucleotide sequence
actggacagcagcgtgga

SEQ ID NO: 12800 - DNA, 18 bp, Artificial sequence
  synthetic polynucleotide sequence
ctcggaggaagttgcgga

SEQ ID NO: 12801 - DNA, 18 bp, Artificial sequence
  synthetic polynucleotide sequence
ccaccgacctgagagaca

SEQ ID NO: 12802 - DNA, 18 bp, Artificial sequence
  synthetic polynucleotide sequence
atgtccaccagcatggca

SEQ ID NO: 12803 - DNA, 18 bp, Artificial sequence
  synthetic polynucleotide sequence
cagagttccacagcctga

SEQ ID NO: 12804 - DNA, 18 bp, Artificial sequence
  synthetic polynucleotide sequence
tgggcacagaggtaggaa

SEQ ID NO: 12805 - DNA, 18 bp, Artificial sequence
  synthetic polynucleotide sequence
tccgaccctggggaacga

SEQ ID NO: 12806 - DNA, 18 bp, Artificial sequence
  synthetic polynucleotide sequence
cagcacctcccaaaggca

SEQ ID NO: 12807 - DNA, 18 bp, Artificial sequence
  synthetic polynucleotide sequence
gcctgaagaggtcggcga

SEQ ID NO: 12808 - DNA, 18 bp, Artificial sequence
  synthetic polynucleotide sequence
ccccaagagcagtcccca

SEQ ID NO: 12809 - DNA, 18 bp, Artificial sequence
  synthetic polynucleotide sequence
tcagcagggacctgagga

SEQ ID NO: 12810 - DNA, 18 bp, Artificial sequence
  synthetic polynucleotide sequence
tcagcagggacctgagga

SEQ ID NO: 12811 - DNA, 18 bp, Artificial sequence
  synthetic polynucleotide sequence
tgcgtgtcgcaaagccaa

SEQ ID NO: 12812 - DNA, 18 bp, Artificial sequence
  synthetic polynucleotide sequence
ggccatcagagccaccga

SEQ ID NO: 12813 - DNA, 18 bp, Artificial sequence
  synthetic polynucleotide sequence
gacacggagagagacgca

SEQ ID NO: 12814 - DNA, 18 bp, Artificial sequence
  synthetic polynucleotide sequence
aggtccaccaaccaagga

SEQ ID NO: 12815 - DNA, 18 bp, Artificial sequence
  synthetic polynucleotide sequence
ggacaaagccaacagaga

SEQ ID NO: 12816 - DNA, 18 bp, Artificial sequence
  synthetic polynucleotide sequence
gccaggtattccgaggca

SEQ ID NO: 12817 - DNA, 18 bp, Artificial sequence
  synthetic polynucleotide sequence
gagcaaaggggatccgca

SEQ ID NO: 12818 - DNA, 18 bp, Artificial sequence
  synthetic polynucleotide sequence
tccatcccagccagcaga

SEQ ID NO: 12819 - DNA, 18 bp, Artificial sequence
  synthetic polynucleotide sequence
ccatacctcgcccagcaa

SEQ ID NO: 12820 - DNA, 18 bp, Artificial sequence
  synthetic polynucleotide sequence
gggagacgagcttcagca

SEQ ID NO: 12821 - DNA, 18 bp, Artificial sequence
  synthetic polynucleotide sequence
gggatggcaaggtagtca

SEQ ID NO: 12822 - DNA, 18 bp, Artificial sequence
  synthetic polynucleotide sequence
cgaggaggctggagagga

SEQ ID NO: 12823 - DNA, 18 bp, Artificial sequence
  synthetic polynucleotide sequence
ggttgcccacagtgagca

SEQ ID NO: 12824 - DNA, 18 bp, Artificial sequence
  synthetic polynucleotide sequence
tggacctgggcatcacca

SEQ ID NO: 12825 - DNA, 18 bp, Artificial sequence
  synthetic polynucleotide sequence
tagtagtggcgcagggca

SEQ ID NO: 12826 - DNA, 18 bp, Artificial sequence
  synthetic polynucleotide sequence
gctccaagaagccccaga

SEQ ID NO: 12827 - DNA, 18 bp, Artificial sequence
  synthetic polynucleotide sequence
acccgcttggtgaaggca

SEQ ID NO: 12828 - DNA, 18 bp, Artificial sequence
  synthetic polynucleotide sequence
acccgcttggtgaaggca

SEQ ID NO: 12829 - DNA, 18 bp, Artificial sequence
  synthetic polynucleotide sequence
gagcaaaggggatccgca

SEQ ID NO: 12830 - DNA, 18 bp, Artificial sequence
  synthetic polynucleotide sequence
agcaatccatcccagcca

SEQ ID NO: 12831 - DNA, 18 bp, Artificial sequence
  synthetic polynucleotide sequence
agccatgcagcgtgacca

SEQ ID NO: 12832 - DNA, 18 bp, Artificial sequence
  synthetic polynucleotide sequence
acaacaccgaggagccga

SEQ ID NO: 12833 - DNA, 18 bp, Artificial sequence
  synthetic polynucleotide sequence
caaccgggacttcccaga

SEQ ID NO: 12834 - DNA, 18 bp, Artificial sequence
  synthetic polynucleotide sequence
cagaaggccagtcagcca

SEQ ID NO: 12835 - DNA, 18 bp, Artificial sequence
  synthetic polynucleotide sequence
ggaaccgcctcaagacga

SEQ ID NO: 12836 - DNA, 18 bp, Artificial sequence
  synthetic polynucleotide sequence
cgtcacacagggtgacca

SEQ ID NO: 12837 - DNA, 18 bp, Artificial sequence
  synthetic polynucleotide sequence
catggagagcccagccaa

SEQ ID NO: 12838 - DNA, 18 bp, Artificial sequence
  synthetic polynucleotide sequence
ggcgggcaatgatagaga

SEQ ID NO: 12839 - DNA, 18 bp, Artificial sequence
  synthetic polynucleotide sequence
agggtccagtggctcgga

SEQ ID NO: 12840 - DNA, 18 bp, Artificial sequence
  synthetic polynucleotide sequence
gcaagctgaggagcacca

SEQ ID NO: 12841 - DNA, 18 bp, Artificial sequence
  synthetic polynucleotide sequence
cttgccgcagtgcgcgca

SEQ ID NO: 12842 - DNA, 18 bp, Artificial sequence
  synthetic polynucleotide sequence
atgcccgacgtgcggcaa

SEQ ID NO: 12843 - DNA, 18 bp, Artificial sequence
  synthetic polynucleotide sequence
ccttctgcagcagcgcca

SEQ ID NO: 12844 - DNA, 18 bp, Artificial sequence
  synthetic polynucleotide sequence
ggatgcccctggacggga

SEQ ID NO: 12845 - DNA, 18 bp, Artificial sequence
  synthetic polynucleotide sequence
tggacagggcacgaagga

SEQ ID NO: 12846 - DNA, 18 bp, Artificial sequence
  synthetic polynucleotide sequence
tggacagggcacgaagga

SEQ ID NO: 12847 - DNA, 18 bp, Artificial sequence
  synthetic polynucleotide sequence
gctacatcgagtccccca

SEQ ID NO: 12848 - DNA, 18 bp, Artificial sequence
  synthetic polynucleotide sequence
catcctcgatgggcagga

SEQ ID NO: 12849 - DNA, 18 bp, Artificial sequence
  synthetic polynucleotide sequence
aggaggccttgccaccaa

SEQ ID NO: 12850 - DNA, 18 bp, Artificial sequence
  synthetic polynucleotide sequence
gttcccactgggcaacga

SEQ ID NO: 12851 - DNA, 18 bp, Artificial sequence
  synthetic polynucleotide sequence
ccaagcatgaaggggcca

SEQ ID NO: 12852 - DNA, 18 bp, Artificial sequence
  synthetic polynucleotide sequence
tccccaccacactgacga

SEQ ID NO: 12853 - DNA, 18 bp, Artificial sequence
  synthetic polynucleotide sequence
gggcctcctggacaggaa

SEQ ID NO: 12854 - DNA, 18 bp, Artificial sequence
  synthetic polynucleotide sequence
cccaccaggcacacagca

SEQ ID NO: 12855 - DNA, 18 bp, Artificial sequence
  synthetic polynucleotide sequence
accttgacaacagctcca

SEQ ID NO: 12856 - DNA, 18 bp, Artificial sequence
  synthetic polynucleotide sequence
tcatcagctcccgagcca

SEQ ID NO: 12857 - DNA, 18 bp, Artificial sequence
  synthetic polynucleotide sequence
agatgagcagtgtgacca

SEQ ID NO: 12858 - DNA, 18 bp, Artificial sequence
  synthetic polynucleotide sequence
atgccatcgactcgggca

SEQ ID NO: 12859 - DNA, 18 bp, Artificial sequence
  synthetic polynucleotide sequence
aggatcaggaagacggca

SEQ ID NO: 12860 - DNA, 18 bp, Artificial sequence
  synthetic polynucleotide sequence
cactgtgcagggcagcaa

SEQ ID NO: 12861 - DNA, 18 bp, Artificial sequence
  synthetic polynucleotide sequence
taccagttacaggagcca

SEQ ID NO: 12862 - DNA, 18 bp, Artificial sequence
  synthetic polynucleotide sequence
accctgccaatccagcaa

SEQ ID NO: 12863 - DNA, 18 bp, Artificial sequence
  synthetic polynucleotide sequence
gggcctccagttgggcaa

SEQ ID NO: 12864 - DNA, 18 bp, Artificial sequence
  synthetic polynucleotide sequence
gggcctccagttgggcaa

SEQ ID NO: 12865 - DNA, 18 bp, Artificial sequence
  synthetic polynucleotide sequence
cagtgtgtgagaggggaa

SEQ ID NO: 12866 - DNA, 18 bp, Artificial sequence
  synthetic polynucleotide sequence
ctcacccagtagggtcca

SEQ ID NO: 12867 - DNA, 18 bp, Artificial sequence
  synthetic polynucleotide sequence
acagcactgggagcgtga

SEQ ID NO: 12868 - DNA, 18 bp, Artificial sequence
  synthetic polynucleotide sequence
cctcatgctgcccacgga

SEQ ID NO: 12869 - DNA, 18 bp, Artificial sequence
  synthetic polynucleotide sequence
cgccatcaggctcaacga

SEQ ID NO: 12870 - DNA, 18 bp, Artificial sequence
  synthetic polynucleotide sequence
cctcctccgtcagcagca

SEQ ID NO: 12871 - DNA, 19 bp, Artificial sequence
  synthetic polynucleotide sequence
gggaagcgtgttgcaagaa

SEQ ID NO: 12872 - DNA, 16 bp, Artificial sequence
  synthetic polynucleotide sequence
gatggtctgcagcgca

SEQ ID NO: 12873 - DNA, 18 bp, Artificial sequence
  synthetic polynucleotide sequence
ctgtcaaggcacagccta

SEQ ID NO: 12874 - DNA, 18 bp, Artificial sequence
  synthetic polynucleotide sequence
ctcctgccatggaggcaa

SEQ ID NO: 12875 - DNA, 18 bp, Artificial sequence
  synthetic polynucleotide sequence
tccagcgataggcctgca

SEQ ID NO: 12876 - DNA, 18 bp, Artificial sequence
  synthetic polynucleotide sequence
actggacgggctctacga

SEQ ID NO: 12877 - DNA, 18 bp, Artificial sequence
  synthetic polynucleotide sequence
aacagggccgacatgcca

SEQ ID NO: 12878 - DNA, 18 bp, Artificial sequence
  synthetic polynucleotide sequence
ggccaaagaagagatgga

SEQ ID NO: 12879 - DNA, 18 bp, Artificial sequence
  synthetic polynucleotide sequence
gagtgagggctgcagcca

SEQ ID NO: 12880 - DNA, 18 bp, Artificial sequence
  synthetic polynucleotide sequence
cttgtcaccgagccacca

SEQ ID NO: 12881 - DNA, 18 bp, Artificial sequence
  synthetic polynucleotide sequence
ccaccagagcgctggcga

SEQ ID NO: 12882 - DNA, 18 bp, Artificial sequence
  synthetic polynucleotide sequence
ccaccagagcgctggcga

SEQ ID NO: 12883 - DNA, 18 bp, Artificial sequence
  synthetic polynucleotide sequence
gcggatgaacaagcggca

SEQ ID NO: 12884 - DNA, 18 bp, Artificial sequence
  synthetic polynucleotide sequence
tgctgccactgagcacca

SEQ ID NO: 12885 - DNA, 18 bp, Artificial sequence
  synthetic polynucleotide sequence
ctgcagaggagctggaga

SEQ ID NO: 12886 - DNA, 18 bp, Artificial sequence
  synthetic polynucleotide sequence
actgacgaggcatccaca

SEQ ID NO: 12887 - DNA, 19 bp, Artificial sequence
  synthetic polynucleotide sequence
ccaagatgggagagaggca

SEQ ID NO: 12888 - DNA, 19 bp, Artificial sequence
  synthetic polynucleotide sequence
ccgcaggacatagatgcca

SEQ ID NO: 12889 - DNA, 18 bp, Artificial sequence
  synthetic polynucleotide sequence
catgtacgtgcgggacca

SEQ ID NO: 12890 - DNA, 18 bp, Artificial sequence
  synthetic polynucleotide sequence
aagccgatgtccgcacca

SEQ ID NO: 12891 - DNA, 18 bp, Artificial sequence
  synthetic polynucleotide sequence
tgagccagggagagagca

SEQ ID NO: 12892 - DNA, 18 bp, Artificial sequence
  synthetic polynucleotide sequence
ccgaagttgcgctagcca

SEQ ID NO: 12893 - DNA, 18 bp, Artificial sequence
  synthetic polynucleotide sequence
gtcgggacacagtgggca

SEQ ID NO: 12894 - DNA, 18 bp, Artificial sequence
  synthetic polynucleotide sequence
gaacagtcccctaccaga

SEQ ID NO: 12895 - DNA, 18 bp, Artificial sequence
  synthetic polynucleotide sequence
gagcaggctccaagtgca

SEQ ID NO: 12896 - DNA, 18 bp, Artificial sequence
  synthetic polynucleotide sequence
cactctggaggacacaga

SEQ ID NO: 12897 - DNA, 18 bp, Artificial sequence
  synthetic polynucleotide sequence
tagtgaccaggggaggga

SEQ ID NO: 12898 - DNA, 18 bp, Artificial sequence
  synthetic polynucleotide sequence
ccagatggcaggcgcaca

SEQ ID NO: 12899 - DNA, 18 bp, Artificial sequence
  synthetic polynucleotide sequence
ggcagctcactggcagca

SEQ ID NO: 12900 - DNA, 18 bp, Artificial sequence
  synthetic polynucleotide sequence
ggcagctcactggcagca

SEQ ID NO: 12901 - DNA, 18 bp, Artificial sequence
  synthetic polynucleotide sequence
agggtcccaggacacaga

SEQ ID NO: 12902 - DNA, 18 bp, Artificial sequence
  synthetic polynucleotide sequence
aggagtctcaggcaggga

SEQ ID NO: 12903 - DNA, 18 bp, Artificial sequence
  synthetic polynucleotide sequence
agctgaaggagcagcaga

SEQ ID NO: 12904 - DNA, 18 bp, Artificial sequence
  synthetic polynucleotide sequence
cgcctaggaagtcagcca

SEQ ID NO: 12905 - DNA, 19 bp, Artificial sequence
  synthetic polynucleotide sequence
ctgtgggacaaggagtgca

SEQ ID NO: 12906 - DNA, 17 bp, Artificial sequence
  synthetic polynucleotide sequence
ggccaactttgagccca

SEQ ID NO: 12907 - DNA, 19 bp, Artificial sequence
  synthetic polynucleotide sequence
gattgccatggcaacagca

SEQ ID NO: 12908 - DNA, 19 bp, Artificial sequence
  synthetic polynucleotide sequence
ccctcacacttgttcacca

SEQ ID NO: 12909 - DNA, 18 bp, Artificial sequence
  synthetic polynucleotide sequence
ggagatccccaaggccaa

SEQ ID NO: 12910 - DNA, 18 bp, Artificial sequence
  synthetic polynucleotide sequence
aactggtcatcaccacca

SEQ ID NO: 12911 - DNA, 18 bp, Artificial sequence
  synthetic polynucleotide sequence
acagcggcacctgtacca

SEQ ID NO: 12912 - DNA, 18 bp, Artificial sequence
  synthetic polynucleotide sequence
cagctccaggttcaggga

SEQ ID NO: 12913 - DNA, 18 bp, Artificial sequence
  synthetic polynucleotide sequence
gttcccaacagcagcgca

SEQ ID NO: 12914 - DNA, 18 bp, Artificial sequence
  synthetic polynucleotide sequence
agctgaagccagcccaga

SEQ ID NO: 12915 - DNA, 18 bp, Artificial sequence
  synthetic polynucleotide sequence
ccaggaacaatgaggcca

SEQ ID NO: 12916 - DNA, 18 bp, Artificial sequence
  synthetic polynucleotide sequence
cgagtccagatgcccaca

SEQ ID NO: 12917 - DNA, 18 bp, Artificial sequence
  synthetic polynucleotide sequence
ttccgaagccagaggaga

SEQ ID NO: 12918 - DNA, 18 bp, Artificial sequence
  synthetic polynucleotide sequence
ttccgaagccagaggaga

SEQ ID NO: 12919 - DNA, 18 bp, Artificial sequence
  synthetic polynucleotide sequence
cagtgcctgggacaagca

SEQ ID NO: 12920 - DNA, 18 bp, Artificial sequence
  synthetic polynucleotide sequence
tagcggagctcatgggca

SEQ ID NO: 12921 - DNA, 18 bp, Artificial sequence
  synthetic polynucleotide sequence
atgcagtggccatggaga

SEQ ID NO: 12922 - DNA, 18 bp, Artificial sequence
  synthetic polynucleotide sequence
tcagagcagctgaaggca

SEQ ID NO: 12923 - DNA, 18 bp, Artificial sequence
  synthetic polynucleotide sequence
gctgcagagcaggaacca

SEQ ID NO: 12924 - DNA, 18 bp, Artificial sequence
  synthetic polynucleotide sequence
tggcgtgcatcacgcgca

SEQ ID NO: 12925 - DNA, 19 bp, Artificial sequence
  synthetic polynucleotide sequence
ctgcacaaacagcatgcca

SEQ ID NO: 12926 - DNA, 18 bp, Artificial sequence
  synthetic polynucleotide sequence
gtagaagccaccgctcca

SEQ ID NO: 12927 - DNA, 18 bp, Artificial sequence
  synthetic polynucleotide sequence
tcccatggcagccagcaa

SEQ ID NO: 12928 - DNA, 18 bp, Artificial sequence
  synthetic polynucleotide sequence
cctcacccccatcaggca

SEQ ID NO: 12929 - DNA, 18 bp, Artificial sequence
  synthetic polynucleotide sequence
ccccactgccagatgcta

SEQ ID NO: 12930 - DNA, 18 bp, Artificial sequence
  synthetic polynucleotide sequence
gccagcggtacccagaca

SEQ ID NO: 12931 - DNA, 18 bp, Artificial sequence
  synthetic polynucleotide sequence
aacccatgttccaccgca

SEQ ID NO: 12932 - DNA, 18 bp, Artificial sequence
  synthetic polynucleotide sequence
ggcaattccagaggcgaa

SEQ ID NO: 12933 - DNA, 18 bp, Artificial sequence
  synthetic polynucleotide sequence
agtggctgaatgccccca

SEQ ID NO: 12934 - DNA, 18 bp, Artificial sequence
  synthetic polynucleotide sequence
acggacaaatggtcccca

SEQ ID NO: 12935 - DNA, 18 bp, Artificial sequence
  synthetic polynucleotide sequence
tcaaccgtgactcagcca

SEQ ID NO: 12936 - DNA, 18 bp, Artificial sequence
  synthetic polynucleotide sequence
tcaaccgtgactcagcca

SEQ ID NO: 12937 - DNA, 18 bp, Artificial sequence
  synthetic polynucleotide sequence
gcagccttcaacggacca

SEQ ID NO: 12938 - DNA, 18 bp, Artificial sequence
  synthetic polynucleotide sequence
cggatggcatcatcagga

SEQ ID NO: 12939 - DNA, 18 bp, Artificial sequence
  synthetic polynucleotide sequence
cggaaaccccatcaggca

SEQ ID NO: 12940 - DNA, 18 bp, Artificial sequence
  synthetic polynucleotide sequence
gtgcaggagtagaggcca

SEQ ID NO: 12941 - DNA, 18 bp, Artificial sequence
  synthetic polynucleotide sequence
gcgagtcttgcacacgga

SEQ ID NO: 12942 - DNA, 18 bp, Artificial sequence
  synthetic polynucleotide sequence
ggaccacagtctgggaga

SEQ ID NO: 12943 - DNA, 18 bp, Artificial sequence
  synthetic polynucleotide sequence
tggacagccaggaccaga

SEQ ID NO: 12944 - DNA, 18 bp, Artificial sequence
  synthetic polynucleotide sequence
ctctcaatggggaggcca

SEQ ID NO: 12945 - DNA, 18 bp, Artificial sequence
  synthetic polynucleotide sequence
agccagctactgcccaga

SEQ ID NO: 12946 - DNA, 18 bp, Artificial sequence
  synthetic polynucleotide sequence
agcagcacggccagcaca

SEQ ID NO: 12947 - DNA, 18 bp, Artificial sequence
  synthetic polynucleotide sequence
gccgagttggagaaggca

SEQ ID NO: 12948 - DNA, 18 bp, Artificial sequence
  synthetic polynucleotide sequence
gccctgtcctgaaccaga

SEQ ID NO: 12949 - DNA, 18 bp, Artificial sequence
  synthetic polynucleotide sequence
aggcactggtacacccca

SEQ ID NO: 12950 - DNA, 18 bp, Artificial sequence
  synthetic polynucleotide sequence
gcgtgttgaaggccgaga

SEQ ID NO: 12951 - DNA, 18 bp, Artificial sequence
  synthetic polynucleotide sequence
gctctggagacggccaca

SEQ ID NO: 12952 - DNA, 18 bp, Artificial sequence
  synthetic polynucleotide sequence
ggacacctccaccgagca

SEQ ID NO: 12953 - DNA, 18 bp, Artificial sequence
  synthetic polynucleotide sequence
aggatgaggcagaggcca

SEQ ID NO: 12954 - DNA, 18 bp, Artificial sequence
  synthetic polynucleotide sequence
aggatgaggcagaggcca

SEQ ID NO: 12955 - DNA, 18 bp, Artificial sequence
  synthetic polynucleotide sequence
gcaacaaccccgaaccca

SEQ ID NO: 12956 - DNA, 18 bp, Artificial sequence
  synthetic polynucleotide sequence
gggaccagcaagaccaca

SEQ ID NO: 12957 - DNA, 18 bp, Artificial sequence
  synthetic polynucleotide sequence
ggagcaagtgcagcagca

SEQ ID NO: 12958 - DNA, 18 bp, Artificial sequence
  synthetic polynucleotide sequence
cttgaactccacgccgca

SEQ ID NO: 12959 - DNA, 18 bp, Artificial sequence
  synthetic polynucleotide sequence
agcagaagcggaagccca

SEQ ID NO: 12960 - DNA, 18 bp, Artificial sequence
  synthetic polynucleotide sequence
cgtgggaatcacagggga

SEQ ID NO: 12961 - DNA, 18 bp, Artificial sequence
  synthetic polynucleotide sequence
agaagaccctgcaggcca

SEQ ID NO: 12962 - DNA, 18 bp, Artificial sequence
  synthetic polynucleotide sequence
ggggaatgaggtggcgga

SEQ ID NO: 12963 - DNA, 18 bp, Artificial sequence
  synthetic polynucleotide sequence
aaggcggatcccaaagca

SEQ ID NO: 12964 - DNA, 18 bp, Artificial sequence
  synthetic polynucleotide sequence
gtgcgcaggacagagtga

SEQ ID NO: 12965 - DNA, 18 bp, Artificial sequence
  synthetic polynucleotide sequence
tcttggccagcaccggga

SEQ ID NO: 12966 - DNA, 18 bp, Artificial sequence
  synthetic polynucleotide sequence
tggcctaccaggaggcga

SEQ ID NO: 12967 - DNA, 18 bp, Artificial sequence
  synthetic polynucleotide sequence
cctgataggccagctcca

SEQ ID NO: 12968 - DNA, 18 bp, Artificial sequence
  synthetic polynucleotide sequence
gctgtcaatgcccaccaa

SEQ ID NO: 12969 - DNA, 18 bp, Artificial sequence
  synthetic polynucleotide sequence
aggcctcagtgaacggca

SEQ ID NO: 12970 - DNA, 18 bp, Artificial sequence
  synthetic polynucleotide sequence
ccacctgccttcagggga

SEQ ID NO: 12971 - DNA, 18 bp, Artificial sequence
  synthetic polynucleotide sequence
agaatgcaatcaggccca

SEQ ID NO: 12972 - DNA, 18 bp, Artificial sequence
  synthetic polynucleotide sequence
agaatgcaatcaggccca

SEQ ID NO: 12973 - DNA, 18 bp, Artificial sequence
  synthetic polynucleotide sequence
agaccattcacgccgaca

SEQ ID NO: 12974 - DNA, 18 bp, Artificial sequence
  synthetic polynucleotide sequence
gccacacttgccacagga

SEQ ID NO: 12975 - DNA, 18 bp, Artificial sequence
  synthetic polynucleotide sequence
gaccacctcgtgaacgaa

SEQ ID NO: 12976 - DNA, 18 bp, Artificial sequence
  synthetic polynucleotide sequence
cggcccattccacgtcca

SEQ ID NO: 12977 - DNA, 18 bp, Artificial sequence
  synthetic polynucleotide sequence
ctgttcaagaccaccgaa

SEQ ID NO: 12978 - DNA, 18 bp, Artificial sequence
  synthetic polynucleotide sequence
aaggagtggccagcccca

SEQ ID NO: 12979 - DNA, 18 bp, Artificial sequence
  synthetic polynucleotide sequence
ggggacgatgttcaccga

SEQ ID NO: 12980 - DNA, 18 bp, Artificial sequence
  synthetic polynucleotide sequence
gaacaagtggtgccacga

SEQ ID NO: 12981 - DNA, 18 bp, Artificial sequence
  synthetic polynucleotide sequence
cagcaagaacatcaccca

SEQ ID NO: 12982 - DNA, 18 bp, Artificial sequence
  synthetic polynucleotide sequence
taaccagggtcctacaga

SEQ ID NO: 12983 - DNA, 18 bp, Artificial sequence
  synthetic polynucleotide sequence
gcagcacccagctggaca

SEQ ID NO: 12984 - DNA, 18 bp, Artificial sequence
  synthetic polynucleotide sequence
ggacttccacgtggacca

SEQ ID NO: 12985 - DNA, 18 bp, Artificial sequence
  synthetic polynucleotide sequence
gcctaagcagctcatgca

SEQ ID NO: 12986 - DNA, 19 bp, Artificial sequence
  synthetic polynucleotide sequence
cacagacttggtggagaca

SEQ ID NO: 12987 - DNA, 18 bp, Artificial sequence
  synthetic polynucleotide sequence
gcccagtgactcctgaga

SEQ ID NO: 12988 - DNA, 18 bp, Artificial sequence
  synthetic polynucleotide sequence
cctgagaaaatggggcca

SEQ ID NO: 12989 - DNA, 18 bp, Artificial sequence
  synthetic polynucleotide sequence
ggctgcgatgaggggcga

SEQ ID NO: 12990 - DNA, 18 bp, Artificial sequence
  synthetic polynucleotide sequence
ggctgcgatgaggggcga

SEQ ID NO: 12991 - DNA, 18 bp, Artificial sequence
  synthetic polynucleotide sequence
ggaagccttcaccagcaa

SEQ ID NO: 12992 - DNA, 18 bp, Artificial sequence
  synthetic polynucleotide sequence
gcacagccttatggacca

SEQ ID NO: 12993 - DNA, 18 bp, Artificial sequence
  synthetic polynucleotide sequence
ggatgaggctggcaccga

SEQ ID NO: 12994 - DNA, 18 bp, Artificial sequence
  synthetic polynucleotide sequence
aatcgcaggatgtggcga

SEQ ID NO: 12995 - DNA, 18 bp, Artificial sequence
  synthetic polynucleotide sequence
catgatgagccgcgagga

SEQ ID NO: 12996 - DNA, 18 bp, Artificial sequence
  synthetic polynucleotide sequence
cttggtaggggaccccca

SEQ ID NO: 12997 - DNA, 18 bp, Artificial sequence
  synthetic polynucleotide sequence
ctcacgcatcacccagga

SEQ ID NO: 12998 - DNA, 18 bp, Artificial sequence
  synthetic polynucleotide sequence
gagccagctgtgtccaca

SEQ ID NO: 12999 - DNA, 18 bp, Artificial sequence
  synthetic polynucleotide sequence
gcagcacccaaactgaga

SEQ ID NO: 13000 - DNA, 18 bp, Artificial sequence
  synthetic polynucleotide sequence
atcagatgctggaagcca

SEQ ID NO: 13001 - DNA, 18 bp, Artificial sequence
  synthetic polynucleotide sequence
cccttgctagggaggaca

SEQ ID NO: 13002 - DNA, 18 bp, Artificial sequence
  synthetic polynucleotide sequence
tccccatgatgcaccaga

SEQ ID NO: 13003 - DNA, 18 bp, Artificial sequence
  synthetic polynucleotide sequence
tccagcagctccaagcca

SEQ ID NO: 13004 - DNA, 18 bp, Artificial sequence
  synthetic polynucleotide sequence
agcgcacacctgtacaga

SEQ ID NO: 13005 - DNA, 18 bp, Artificial sequence
  synthetic polynucleotide sequence
tagcacccacttgagcaa

SEQ ID NO: 13006 - DNA, 18 bp, Artificial sequence
  synthetic polynucleotide sequence
aaaggagccactgggcaa

SEQ ID NO: 13007 - DNA, 18 bp, Artificial sequence
  synthetic polynucleotide sequence
cagcattcaccagaacca

SEQ ID NO: 13008 - DNA, 18 bp, Artificial sequence
  synthetic polynucleotide sequence
cagcattcaccagaacca

SEQ ID NO: 13009 - DNA, 18 bp, Artificial sequence
  synthetic polynucleotide sequence
gcagcagaatggagccaa

SEQ ID NO: 13010 - DNA, 18 bp, Artificial sequence
  synthetic polynucleotide sequence
agaagagaacctgccaca

SEQ ID NO: 13011 - DNA, 18 bp, Artificial sequence
  synthetic polynucleotide sequence
cgtggctgaaggcaccca

SEQ ID NO: 13012 - DNA, 18 bp, Artificial sequence
  synthetic polynucleotide sequence
gcagcacctctggggtga

SEQ ID NO: 13013 - DNA, 18 bp, Artificial sequence
  synthetic polynucleotide sequence
gaacgaggaaggcaccca

SEQ ID NO: 13014 - DNA, 18 bp, Artificial sequence
  synthetic polynucleotide sequence
ggtcgacagtgaagcgga

SEQ ID NO: 13015 - DNA, 18 bp, Artificial sequence
  synthetic polynucleotide sequence
gaacctgggaatgaccga

SEQ ID NO: 13016 - DNA, 18 bp, Artificial sequence
  synthetic polynucleotide sequence
ctgtggatgaggaggcca

SEQ ID NO: 13017 - DNA, 18 bp, Artificial sequence
  synthetic polynucleotide sequence
gtcgacaagtgcccccaa

SEQ ID NO: 13018 - DNA, 18 bp, Artificial sequence
  synthetic polynucleotide sequence
tcggcagtgcaatcagca

SEQ ID NO: 13019 - DNA, 18 bp, Artificial sequence
  synthetic polynucleotide sequence
cagccttagggtccgaca

SEQ ID NO: 13020 - DNA, 18 bp, Artificial sequence
  synthetic polynucleotide sequence
aagctcgccaggtccaca

SEQ ID NO: 13021 - DNA, 18 bp, Artificial sequence
  synthetic polynucleotide sequence
gatgctgcacgccggaca

SEQ ID NO: 13022 - DNA, 18 bp, Artificial sequence
  synthetic polynucleotide sequence
gtcccaggtactggccaa

SEQ ID NO: 13023 - DNA, 18 bp, Artificial sequence
  synthetic polynucleotide sequence
aggaggacaaggcgggta

SEQ ID NO: 13024 - DNA, 18 bp, Artificial sequence
  synthetic polynucleotide sequence
gggtggccaagaacacca

SEQ ID NO: 13025 - DNA, 18 bp, Artificial sequence
  synthetic polynucleotide sequence
cgtgatggggcatgagga

SEQ ID NO: 13026 - DNA, 18 bp, Artificial sequence
  synthetic polynucleotide sequence
cgtgatggggcatgagga

SEQ ID NO: 13027 - DNA, 18 bp, Artificial sequence
  synthetic polynucleotide sequence
aaatgtagccgtggccaa

SEQ ID NO: 13028 - DNA, 18 bp, Artificial sequence
  synthetic polynucleotide sequence
agggccagataagtggca

SEQ ID NO: 13029 - DNA, 18 bp, Artificial sequence
  synthetic polynucleotide sequence
caaaggcttgtgcagaga

SEQ ID NO: 13030 - DNA, 18 bp, Artificial sequence
  synthetic polynucleotide sequence
ttcaccaggacaagccga

SEQ ID NO: 13031 - DNA, 18 bp, Artificial sequence
  synthetic polynucleotide sequence
ccaacccttggcagacga

SEQ ID NO: 13032 - DNA, 18 bp, Artificial sequence
  synthetic polynucleotide sequence
aacaggccctcaagccca

SEQ ID NO: 13033 - DNA, 18 bp, Artificial sequence
  synthetic polynucleotide sequence
gctggacacctccatgga

SEQ ID NO: 13034 - DNA, 18 bp, Artificial sequence
  synthetic polynucleotide sequence
gtcccccaagtaccggga

SEQ ID NO: 13035 - DNA, 18 bp, Artificial sequence
  synthetic polynucleotide sequence
tggccagatacctgccaa

SEQ ID NO: 13036 - DNA, 18 bp, Artificial sequence
  synthetic polynucleotide sequence
tcgtggctgagggggcca

SEQ ID NO: 13037 - DNA, 18 bp, Artificial sequence
  synthetic polynucleotide sequence
tgtaggggtaacggccca

SEQ ID NO: 13038 - DNA, 18 bp, Artificial sequence
  synthetic polynucleotide sequence
ggacagggaccaagcaga

SEQ ID NO: 13039 - DNA, 18 bp, Artificial sequence
  synthetic polynucleotide sequence
aactcatcagcacctgca

SEQ ID NO: 13040 - DNA, 18 bp, Artificial sequence
  synthetic polynucleotide sequence
cagcaggaagaggcagca

SEQ ID NO: 13041 - DNA, 18 bp, Artificial sequence
  synthetic polynucleotide sequence
gctggtgaagacgccaca

SEQ ID NO: 13042 - DNA, 18 bp, Artificial sequence
  synthetic polynucleotide sequence
ccccatccgaagaaccca

SEQ ID NO: 13043 - DNA, 18 bp, Artificial sequence
  synthetic polynucleotide sequence
gcagttaggcgtgcagca

SEQ ID NO: 13044 - DNA, 18 bp, Artificial sequence
  synthetic polynucleotide sequence
gcagttaggcgtgcagca

SEQ ID NO: 13045 - DNA, 18 bp, Artificial sequence
  synthetic polynucleotide sequence
gcctgaacccttaccgga

SEQ ID NO: 13046 - DNA, 18 bp, Artificial sequence
  synthetic polynucleotide sequence
cactccaggtcctcagga

SEQ ID NO: 13047 - DNA, 18 bp, Artificial sequence
  synthetic polynucleotide sequence
ctacgccatgaaggccga

SEQ ID NO: 13048 - DNA, 18 bp, Artificial sequence
  synthetic polynucleotide sequence
agcgctgtctcccagcaa

SEQ ID NO: 13049 - DNA, 18 bp, Artificial sequence
  synthetic polynucleotide sequence
gagagcccacgtgcagga

SEQ ID NO: 13050 - DNA, 18 bp, Artificial sequence
  synthetic polynucleotide sequence
gacggtgcaccaagccca

SEQ ID NO: 13051 - DNA, 18 bp, Artificial sequence
  synthetic polynucleotide sequence
gaccctcagactcgccaa

SEQ ID NO: 13052 - DNA, 18 bp, Artificial sequence
  synthetic polynucleotide sequence
tactggtgcacaccccca

SEQ ID NO: 13053 - DNA, 18 bp, Artificial sequence
  synthetic polynucleotide sequence
gcccttcatggaagccca

SEQ ID NO: 13054 - DNA, 18 bp, Artificial sequence
  synthetic polynucleotide sequence
aggcaccatcacggggga

SEQ ID NO: 13055 - DNA, 18 bp, Artificial sequence
  synthetic polynucleotide sequence
ggaggcacagtacttgga

SEQ ID NO: 13056 - DNA, 18 bp, Artificial sequence
  synthetic polynucleotide sequence
agaggttgacagcaggga

SEQ ID NO: 13057 - DNA, 18 bp, Artificial sequence
  synthetic polynucleotide sequence
agccgcgatgtctcggga

SEQ ID NO: 13058 - DNA, 18 bp, Artificial sequence
  synthetic polynucleotide sequence
cgacgccaagaaacggga

SEQ ID NO: 13059 - DNA, 18 bp, Artificial sequence
  synthetic polynucleotide sequence
tggccccacagcaacaga

SEQ ID NO: 13060 - DNA, 18 bp, Artificial sequence
  synthetic polynucleotide sequence
agaatccgggctgggaca

SEQ ID NO: 13061 - DNA, 18 bp, Artificial sequence
  synthetic polynucleotide sequence
tagacagcgtacacccca

SEQ ID NO: 13062 - DNA, 18 bp, Artificial sequence
  synthetic polynucleotide sequence
tagacagcgtacacccca

SEQ ID NO: 13063 - DNA, 18 bp, Artificial sequence
  synthetic polynucleotide sequence
ttggacctggagcagaca

SEQ ID NO: 13064 - DNA, 18 bp, Artificial sequence
  synthetic polynucleotide sequence
ctctccatggcggagaca

SEQ ID NO: 13065 - DNA, 18 bp, Artificial sequence
  synthetic polynucleotide sequence
ctgccacgatcctggaga

SEQ ID NO: 13066 - DNA, 18 bp, Artificial sequence
  synthetic polynucleotide sequence
gcaccattctcaggggca

SEQ ID NO: 13067 - DNA, 18 bp, Artificial sequence
  synthetic polynucleotide sequence
aggtcccgaggaacgaca

SEQ ID NO: 13068 - DNA, 18 bp, Artificial sequence
  synthetic polynucleotide sequence
cctagcagctcgtagcca

SEQ ID NO: 13069 - DNA, 18 bp, Artificial sequence
  synthetic polynucleotide sequence
tcaccctccaggagcaga

SEQ ID NO: 13070 - DNA, 18 bp, Artificial sequence
  synthetic polynucleotide sequence
agtgatgggtggagccga

SEQ ID NO: 13071 - DNA, 18 bp, Artificial sequence
  synthetic polynucleotide sequence
caaagccttccagcgaca

SEQ ID NO: 13072 - DNA, 18 bp, Artificial sequence
  synthetic polynucleotide sequence
gcccacaaggagacagca

SEQ ID NO: 13073 - DNA, 18 bp, Artificial sequence
  synthetic polynucleotide sequence
gcttcagccaaggcagca

SEQ ID NO: 13074 - DNA, 18 bp, Artificial sequence
  synthetic polynucleotide sequence
cctggcaagcgagacaca

SEQ ID NO: 13075 - DNA, 18 bp, Artificial sequence
  synthetic polynucleotide sequence
gcgagttcagcccaggga

SEQ ID NO: 13076 - DNA, 18 bp, Artificial sequence
  synthetic polynucleotide sequence
gggatgccagtaggacca

SEQ ID NO: 13077 - DNA, 18 bp, Artificial sequence
  synthetic polynucleotide sequence
ccttggccacacccacca

SEQ ID NO: 13078 - DNA, 18 bp, Artificial sequence
  synthetic polynucleotide sequence
agctcccaaggctggcaa

SEQ ID NO: 13079 - DNA, 18 bp, Artificial sequence
  synthetic polynucleotide sequence
ggacctctctaaggacca

SEQ ID NO: 13080 - DNA, 18 bp, Artificial sequence
  synthetic polynucleotide sequence
ggacctctctaaggacca

SEQ ID NO: 13081 - DNA, 18 bp, Artificial sequence
  synthetic polynucleotide sequence
accaggaggccatggaca

SEQ ID NO: 13082 - DNA, 18 bp, Artificial sequence
  synthetic polynucleotide sequence
agccatggcctcgtcgaa

SEQ ID NO: 13083 - DNA, 18 bp, Artificial sequence
  synthetic polynucleotide sequence
aggcaagaggaggaacga

SEQ ID NO: 13084 - DNA, 18 bp, Artificial sequence
  synthetic polynucleotide sequence
taacctatgccaccacca

SEQ ID NO: 13085 - DNA, 18 bp, Artificial sequence
  synthetic polynucleotide sequence
ccgcccaatgccaccgaa

SEQ ID NO: 13086 - DNA, 18 bp, Artificial sequence
  synthetic polynucleotide sequence
aactcgctggcacagaga

SEQ ID NO: 13087 - DNA, 18 bp, Artificial sequence
  synthetic polynucleotide sequence
gacgagaccatccagcca

SEQ ID NO: 13088 - DNA, 18 bp, Artificial sequence
  synthetic polynucleotide sequence
aacggtcgcactcaagca

SEQ ID NO: 13089 - DNA, 18 bp, Artificial sequence
  synthetic polynucleotide sequence
tgaagccatcgtcacgga

SEQ ID NO: 13090 - DNA, 18 bp, Artificial sequence
  synthetic polynucleotide sequence
cagccactcctctgcaca

SEQ ID NO: 13091 - DNA, 18 bp, Artificial sequence
  synthetic polynucleotide sequence
gtagagggagcaggggta

SEQ ID NO: 13092 - DNA, 18 bp, Artificial sequence
  synthetic polynucleotide sequence
ccgcaaagtggatggaca

SEQ ID NO: 13093 - DNA, 18 bp, Artificial sequence
  synthetic polynucleotide sequence
cgctggtccctgaaggga

SEQ ID NO: 13094 - DNA, 18 bp, Artificial sequence
  synthetic polynucleotide sequence
gcaactgaagctgaagga

SEQ ID NO: 13095 - DNA, 18 bp, Artificial sequence
  synthetic polynucleotide sequence
gccgcctgctctggcaca

SEQ ID NO: 13096 - DNA, 18 bp, Artificial sequence
  synthetic polynucleotide sequence
ggccctccagggcttcca

SEQ ID NO: 13097 - DNA, 18 bp, Artificial sequence
  synthetic polynucleotide sequence
ctccacgctctccaggga

SEQ ID NO: 13098 - DNA, 18 bp, Artificial sequence
  synthetic polynucleotide sequence
ctccacgctctccaggga

SEQ ID NO: 13099 - DNA, 18 bp, Artificial sequence
  synthetic polynucleotide sequence
agaatggctgccgcgaga

SEQ ID NO: 13100 - DNA, 18 bp, Artificial sequence
  synthetic polynucleotide sequence
caacacaggcctggagca

SEQ ID NO: 13101 - DNA, 18 bp, Artificial sequence
  synthetic polynucleotide sequence
aagtaggtgccccaggca

SEQ ID NO: 13102 - DNA, 18 bp, Artificial sequence
  synthetic polynucleotide sequence
gacttccctggggaccca

SEQ ID NO: 13103 - DNA, 18 bp, Artificial sequence
  synthetic polynucleotide sequence
catggacaaggaaggcaa

SEQ ID NO: 13104 - DNA, 18 bp, Artificial sequence
  synthetic polynucleotide sequence
atcagagctgaggtccca

SEQ ID NO: 13105 - DNA, 18 bp, Artificial sequence
  synthetic polynucleotide sequence
cctggacagcgatggcaa

SEQ ID NO: 13106 - DNA, 18 bp, Artificial sequence
  synthetic polynucleotide sequence
cgatcgggggtagcacca

SEQ ID NO: 13107 - DNA, 18 bp, Artificial sequence
  synthetic polynucleotide sequence
agtgccggagcctgcaga

SEQ ID NO: 13108 - DNA, 18 bp, Artificial sequence
  synthetic polynucleotide sequence
tgaccagagcatccacca

SEQ ID NO: 13109 - DNA, 18 bp, Artificial sequence
  synthetic polynucleotide sequence
aatgcgaatcacggccca

SEQ ID NO: 13110 - DNA, 18 bp, Artificial sequence
  synthetic polynucleotide sequence
aggctgttgagagaagga

SEQ ID NO: 13111 - DNA, 18 bp, Artificial sequence
  synthetic polynucleotide sequence
cccattggcgcagacgca

SEQ ID NO: 13112 - DNA, 18 bp, Artificial sequence
  synthetic polynucleotide sequence
agccacctgcaggacaga

SEQ ID NO: 13113 - DNA, 18 bp, Artificial sequence
  synthetic polynucleotide sequence
aagcgttgacaggggcca

SEQ ID NO: 13114 - DNA, 18 bp, Artificial sequence
  synthetic polynucleotide sequence
atgtgctgccgacgggaa

SEQ ID NO: 13115 - DNA, 18 bp, Artificial sequence
  synthetic polynucleotide sequence
gctgccagagggacccca

SEQ ID NO: 13116 - DNA, 18 bp, Artificial sequence
  synthetic polynucleotide sequence
gctgccagagggacccca

SEQ ID NO: 13117 - DNA, 18 bp, Artificial sequence
  synthetic polynucleotide sequence
gcgtcctcgtcacagcca

SEQ ID NO: 13118 - DNA, 18 bp, Artificial sequence
  synthetic polynucleotide sequence
gagtccgtgggaggcgca

SEQ ID NO: 13119 - DNA, 18 bp, Artificial sequence
  synthetic polynucleotide sequence
cccagagttcacccagga

SEQ ID NO: 13120 - DNA, 18 bp, Artificial sequence
  synthetic polynucleotide sequence
aatgcacttgaggcccca

SEQ ID NO: 13121 - DNA, 18 bp, Artificial sequence
  synthetic polynucleotide sequence
ggagactgggaagcccaa

SEQ ID NO: 13122 - DNA, 18 bp, Artificial sequence
  synthetic polynucleotide sequence
tccagtgataccaccaga

SEQ ID NO: 13123 - DNA, 18 bp, Artificial sequence
  synthetic polynucleotide sequence
gctccaaagctcaatgga

SEQ ID NO: 13124 - DNA, 18 bp, Artificial sequence
  synthetic polynucleotide sequence
taccaccagaagtgacga

SEQ ID NO: 13125 - DNA, 19 bp, Artificial sequence
  synthetic polynucleotide sequence
gagtacagcatgccctcca

SEQ ID NO: 13126 - DNA, 19 bp, Artificial sequence
  synthetic polynucleotide sequence
tagagaacaccagcaggga

SEQ ID NO: 13127 - DNA, 18 bp, Artificial sequence
  synthetic polynucleotide sequence
tcgatgaaggtccaggca

SEQ ID NO: 13128 - DNA, 18 bp, Artificial sequence
  synthetic polynucleotide sequence
gcaggctctacactggga

SEQ ID NO: 13129 - DNA, 18 bp, Artificial sequence
  synthetic polynucleotide sequence
ccagctggtcccgaagca

SEQ ID NO: 13130 - DNA, 18 bp, Artificial sequence
  synthetic polynucleotide sequence
gggagctctacgaccgga

SEQ ID NO: 13131 - DNA, 18 bp, Artificial sequence
  synthetic polynucleotide sequence
aagacaccgtgggagcca

SEQ ID NO: 13132 - DNA, 18 bp, Artificial sequence
  synthetic polynucleotide sequence
cccttggacactccggaa

SEQ ID NO: 13133 - DNA, 18 bp, Artificial sequence
  synthetic polynucleotide sequence
tcggcccagccaccagca

SEQ ID NO: 13134 - DNA, 18 bp, Artificial sequence
  synthetic polynucleotide sequence
tcggcccagccaccagca

SEQ ID NO: 13135 - DNA, 18 bp, Artificial sequence
  synthetic polynucleotide sequence
ggagagcacagaagcaga

SEQ ID NO: 13136 - DNA, 18 bp, Artificial sequence
  synthetic polynucleotide sequence
ggccctgcagctgaacca

SEQ ID NO: 13137 - DNA, 18 bp, Artificial sequence
  synthetic polynucleotide sequence
gcagggaaaccggcgaga

SEQ ID NO: 13138 - DNA, 18 bp, Artificial sequence
  synthetic polynucleotide sequence
accgtgatacagcacaca

SEQ ID NO: 13139 - DNA, 18 bp, Artificial sequence
  synthetic polynucleotide sequence
ggaaggggtggatggcaa

SEQ ID NO: 13140 - DNA, 18 bp, Artificial sequence
  synthetic polynucleotide sequence
acgagacacagaggcaca

SEQ ID NO: 13141 - DNA, 18 bp, Artificial sequence
  synthetic polynucleotide sequence
cctccagactcaaaggga

SEQ ID NO: 13142 - DNA, 18 bp, Artificial sequence
  synthetic polynucleotide sequence
tcagggaggttgcccaca

SEQ ID NO: 13143 - DNA, 18 bp, Artificial sequence
  synthetic polynucleotide sequence
ccccgagaacctcagcaa

SEQ ID NO: 13144 - DNA, 18 bp, Artificial sequence
  synthetic polynucleotide sequence
tctcaggtggccacagca

SEQ ID NO: 13145 - DNA, 18 bp, Artificial sequence
  synthetic polynucleotide sequence
cgtccagggagttcacca

SEQ ID NO: 13146 - DNA, 18 bp, Artificial sequence
  synthetic polynucleotide sequence
ttgtggacagcgaggcca

SEQ ID NO: 13147 - DNA, 18 bp, Artificial sequence
  synthetic polynucleotide sequence
gcctgcaggtcatccaca

SEQ ID NO: 13148 - DNA, 18 bp, Artificial sequence
  synthetic polynucleotide sequence
ccaggtacaatgccgcca

SEQ ID NO: 13149 - DNA, 18 bp, Artificial sequence
  synthetic polynucleotide sequence
gcacctccacgtagctga

SEQ ID NO: 13150 - DNA, 18 bp, Artificial sequence
  synthetic polynucleotide sequence
cttcgagcccgagaacga

SEQ ID NO: 13151 - DNA, 18 bp, Artificial sequence
  synthetic polynucleotide sequence
gtgtgggagagaccccca

SEQ ID NO: 13152 - DNA, 18 bp, Artificial sequence
  synthetic polynucleotide sequence
gtgtgggagagaccccca

SEQ ID NO: 13153 - DNA, 18 bp, Artificial sequence
  synthetic polynucleotide sequence
gcagagtcgcagagccaa

SEQ ID NO: 13154 - DNA, 18 bp, Artificial sequence
  synthetic polynucleotide sequence
ccttgagccctccacgga

SEQ ID NO: 13155 - DNA, 18 bp, Artificial sequence
  synthetic polynucleotide sequence
tggccctagcactcagca

SEQ ID NO: 13156 - DNA, 18 bp, Artificial sequence
  synthetic polynucleotide sequence
gcgagttgcagagcgaca

SEQ ID NO: 13157 - DNA, 18 bp, Artificial sequence
  synthetic polynucleotide sequence
gggcaaacaccgacccaa

SEQ ID NO: 13158 - DNA, 18 bp, Artificial sequence
  synthetic polynucleotide sequence
tgccggagcatcaaccca

SEQ ID NO: 13159 - DNA, 18 bp, Artificial sequence
  synthetic polynucleotide sequence
gggacaccagagaaccca

SEQ ID NO: 13160 - DNA, 18 bp, Artificial sequence
  synthetic polynucleotide sequence
ggttaaggaggggagcca

SEQ ID NO: 13161 - DNA, 18 bp, Artificial sequence
  synthetic polynucleotide sequence
cgggagagcacgaccaca

SEQ ID NO: 13162 - DNA, 18 bp, Artificial sequence
  synthetic polynucleotide sequence
ccgcagagatgatgggca

SEQ ID NO: 13163 - DNA, 18 bp, Artificial sequence
  synthetic polynucleotide sequence
cactggctgctggagaca

SEQ ID NO: 13164 - DNA, 18 bp, Artificial sequence
  synthetic polynucleotide sequence
gaaggcacgatccggaca

SEQ ID NO: 13165 - DNA, 18 bp, Artificial sequence
  synthetic polynucleotide sequence
ctgtcaagcagctggaga

SEQ ID NO: 13166 - DNA, 18 bp, Artificial sequence
  synthetic polynucleotide sequence
gggtcaaagggatgcaga

SEQ ID NO: 13167 - DNA, 18 bp, Artificial sequence
  synthetic polynucleotide sequence
ggaagtcgctgtagagca

SEQ ID NO: 13168 - DNA, 18 bp, Artificial sequence
  synthetic polynucleotide sequence
cacggtgcacctggagca

SEQ ID NO: 13169 - DNA, 18 bp, Artificial sequence
  synthetic polynucleotide sequence
ggctgaggataaggggca

SEQ ID NO: 13170 - DNA, 18 bp, Artificial sequence
  synthetic polynucleotide sequence
ggctgaggataaggggca

SEQ ID NO: 13171 - DNA, 18 bp, Artificial sequence
  synthetic polynucleotide sequence
tcgtgcagcacccggaga

SEQ ID NO: 13172 - DNA, 18 bp, Artificial sequence
  synthetic polynucleotide sequence
gcggaagcgagtcacaga

SEQ ID NO: 13173 - DNA, 18 bp, Artificial sequence
  synthetic polynucleotide sequence
tagagctgaccctgcaga

SEQ ID NO: 13174 - DNA, 18 bp, Artificial sequence
  synthetic polynucleotide sequence
gagggaagagagaggcga

SEQ ID NO: 13175 - DNA, 18 bp, Artificial sequence
  synthetic polynucleotide sequence
cggacatcgtcaccacca

SEQ ID NO: 13176 - DNA, 18 bp, Artificial sequence
  synthetic polynucleotide sequence
gcagggagtactcccgga

SEQ ID NO: 13177 - DNA, 18 bp, Artificial sequence
  synthetic polynucleotide sequence
ccaccacctgcatccgca

SEQ ID NO: 13178 - DNA, 18 bp, Artificial sequence
  synthetic polynucleotide sequence
ccagcgtggcgagcggca

SEQ ID NO: 13179 - DNA, 18 bp, Artificial sequence
  synthetic polynucleotide sequence
ctgctgcccctgcacaca

SEQ ID NO: 13180 - DNA, 18 bp, Artificial sequence
  synthetic polynucleotide sequence
gcctgaagctcatgggca

SEQ ID NO: 13181 - DNA, 18 bp, Artificial sequence
  synthetic polynucleotide sequence
ggcggctgaactggagga

SEQ ID NO: 13182 - DNA, 18 bp, Artificial sequence
  synthetic polynucleotide sequence
actggacgccatcaggga

SEQ ID NO: 13183 - DNA, 18 bp, Artificial sequence
  synthetic polynucleotide sequence
tgagctcactggccacga

SEQ ID NO: 13184 - DNA, 18 bp, Artificial sequence
  synthetic polynucleotide sequence
gggaaccctacctcgaga

SEQ ID NO: 13185 - DNA, 18 bp, Artificial sequence
  synthetic polynucleotide sequence
caggctctccagcagaca

SEQ ID NO: 13186 - DNA, 19 bp, Artificial sequence
  synthetic polynucleotide sequence
aaggagaacctggatcgca

SEQ ID NO: 13187 - DNA, 18 bp, Artificial sequence
  synthetic polynucleotide sequence
aggggatgttagcagcca

SEQ ID NO: 13188 - DNA, 18 bp, Artificial sequence
  synthetic polynucleotide sequence
aggggatgttagcagcca

SEQ ID NO: 13189 - DNA, 18 bp, Artificial sequence
  synthetic polynucleotide sequence
gctatgtccccaacccaa

SEQ ID NO: 13190 - DNA, 18 bp, Artificial sequence
  synthetic polynucleotide sequence
tgcagccgataagccaca

SEQ ID NO: 13191 - DNA, 18 bp, Artificial sequence
  synthetic polynucleotide sequence
atacgatggtcaccagca

SEQ ID NO: 13192 - DNA, 18 bp, Artificial sequence
  synthetic polynucleotide sequence
agctcaagtcggtaagca

SEQ ID NO: 13193 - DNA, 18 bp, Artificial sequence
  synthetic polynucleotide sequence
tgcacgcccacaagagca

SEQ ID NO: 13194 - DNA, 18 bp, Artificial sequence
  synthetic polynucleotide sequence
atcatcacccagtcgaca

SEQ ID NO: 13195 - DNA, 18 bp, Artificial sequence
  synthetic polynucleotide sequence
ccctggaagccaaggaca

SEQ ID NO: 13196 - DNA, 18 bp, Artificial sequence
  synthetic polynucleotide sequence
gcatgcacaggccagcga

SEQ ID NO: 13197 - DNA, 18 bp, Artificial sequence
  synthetic polynucleotide sequence
cagagtcgagggagcaca

SEQ ID NO: 13198 - DNA, 18 bp, Artificial sequence
  synthetic polynucleotide sequence
acaccaggaaggacccga

SEQ ID NO: 13199 - DNA, 18 bp, Artificial sequence
  synthetic polynucleotide sequence
cgagatccgagacgtcca

SEQ ID NO: 13200 - DNA, 18 bp, Artificial sequence
  synthetic polynucleotide sequence
ctcagaggtggacccgga

SEQ ID NO: 13201 - DNA, 18 bp, Artificial sequence
  synthetic polynucleotide sequence
gatgatcagggccaggca

SEQ ID NO: 13202 - DNA, 18 bp, Artificial sequence
  synthetic polynucleotide sequence
catcctgcagctgccaga

SEQ ID NO: 13203 - DNA, 18 bp, Artificial sequence
  synthetic polynucleotide sequence
cccctgttcacaggccca

SEQ ID NO: 13204 - DNA, 18 bp, Artificial sequence
  synthetic polynucleotide sequence
ggaagggggattcaggga

SEQ ID NO: 13205 - DNA, 18 bp, Artificial sequence
  synthetic polynucleotide sequence
gcagcgccttgaagccga

SEQ ID NO: 13206 - DNA, 18 bp, Artificial sequence
  synthetic polynucleotide sequence
gcagcgccttgaagccga

SEQ ID NO: 13207 - DNA, 18 bp, Artificial sequence
  synthetic polynucleotide sequence
ccaggaccacagcaccaa

SEQ ID NO: 13208 - DNA, 18 bp, Artificial sequence
  synthetic polynucleotide sequence
ggggaagccctggaacca

SEQ ID NO: 13209 - DNA, 18 bp, Artificial sequence
  synthetic polynucleotide sequence
agcagcggacgtgggaga

SEQ ID NO: 13210 - DNA, 18 bp, Artificial sequence
  synthetic polynucleotide sequence
ctgaggagtgggcagcca

SEQ ID NO: 13211 - DNA, 18 bp, Artificial sequence
  synthetic polynucleotide sequence
gtcactcccagagggcca

SEQ ID NO: 13212 - DNA, 18 bp, Artificial sequence
  synthetic polynucleotide sequence
atccctcaggtgcaccca

SEQ ID NO: 13213 - DNA, 18 bp, Artificial sequence
  synthetic polynucleotide sequence
tcttccagcgcgaagaga

SEQ ID NO: 13214 - DNA, 18 bp, Artificial sequence
  synthetic polynucleotide sequence
cgcattcacgaacaccca

SEQ ID NO: 13215 - DNA, 17 bp, Artificial sequence
  synthetic polynucleotide sequence
cggcctcggagctcgga

SEQ ID NO: 13216 - DNA, 18 bp, Artificial sequence
  synthetic polynucleotide sequence
cgggaagaacaagggcca

SEQ ID NO: 13217 - DNA, 18 bp, Artificial sequence
  synthetic polynucleotide sequence
gcatccgacatccgggca

SEQ ID NO: 13218 - DNA, 18 bp, Artificial sequence
  synthetic polynucleotide sequence
ccgtccatgagcaccaca

SEQ ID NO: 13219 - DNA, 18 bp, Artificial sequence
  synthetic polynucleotide sequence
tgggacagcagaatgtga

SEQ ID NO: 13220 - DNA, 18 bp, Artificial sequence
  synthetic polynucleotide sequence
ccaggtcaggcagaggta

SEQ ID NO: 13221 - DNA, 18 bp, Artificial sequence
  synthetic polynucleotide sequence
gggcatcatgctcgggca

SEQ ID NO: 13222 - DNA, 18 bp, Artificial sequence
  synthetic polynucleotide sequence
cccagagaagctgcagca

SEQ ID NO: 13223 - DNA, 18 bp, Artificial sequence
  synthetic polynucleotide sequence
cctcagaccacgaaggga

SEQ ID NO: 13224 - DNA, 18 bp, Artificial sequence
  synthetic polynucleotide sequence
cctcagaccacgaaggga

SEQ ID NO: 13225 - DNA, 18 bp, Artificial sequence
  synthetic polynucleotide sequence
tggcacccctatggcaca

SEQ ID NO: 13226 - DNA, 18 bp, Artificial sequence
  synthetic polynucleotide sequence
aaccactgggctggcaga

SEQ ID NO: 13227 - DNA, 18 bp, Artificial sequence
  synthetic polynucleotide sequence
agcccacccgaaggagca

SEQ ID NO: 13228 - DNA, 18 bp, Artificial sequence
  synthetic polynucleotide sequence
ccgccatcagtagggcca

SEQ ID NO: 13229 - DNA, 18 bp, Artificial sequence
  synthetic polynucleotide sequence
ctgtgcccacagggacga

SEQ ID NO: 13230 - DNA, 18 bp, Artificial sequence
  synthetic polynucleotide sequence
gctgagatctccagggca

SEQ ID NO: 13231 - DNA, 18 bp, Artificial sequence
  synthetic polynucleotide sequence
gatcatccagccccagga

SEQ ID NO: 13232 - DNA, 18 bp, Artificial sequence
  synthetic polynucleotide sequence
ctgatgggtccaggggga

SEQ ID NO: 13233 - DNA, 18 bp, Artificial sequence
  synthetic polynucleotide sequence
caagcctggcaacacaga

SEQ ID NO: 13234 - DNA, 18 bp, Artificial sequence
  synthetic polynucleotide sequence
ctgagtgccccgacctga

SEQ ID NO: 13235 - DNA, 18 bp, Artificial sequence
  synthetic polynucleotide sequence
aagttggcagtcccacga

SEQ ID NO: 13236 - DNA, 18 bp, Artificial sequence
  synthetic polynucleotide sequence
gcatccgcagcacagcca

SEQ ID NO: 13237 - DNA, 18 bp, Artificial sequence
  synthetic polynucleotide sequence
gaatatacctcagcgcca

SEQ ID NO: 13238 - DNA, 18 bp, Artificial sequence
  synthetic polynucleotide sequence
gagtggcaaaggagcaga

SEQ ID NO: 13239 - DNA, 18 bp, Artificial sequence
  synthetic polynucleotide sequence
gcgtgtagcagcgcagga

SEQ ID NO: 13240 - DNA, 18 bp, Artificial sequence
  synthetic polynucleotide sequence
cctgggcagttcaagcca

SEQ ID NO: 13241 - DNA, 18 bp, Artificial sequence
  synthetic polynucleotide sequence
gctgcacaaggtcccgca

SEQ ID NO: 13242 - DNA, 18 bp, Artificial sequence
  synthetic polynucleotide sequence
gctgcacaaggtcccgca

SEQ ID NO: 13243 - DNA, 18 bp, Artificial sequence
  synthetic polynucleotide sequence
tccaagtcctgaacccca

SEQ ID NO: 13244 - DNA, 18 bp, Artificial sequence
  synthetic polynucleotide sequence
acgcaggttgggacctga

SEQ ID NO: 13245 - DNA, 18 bp, Artificial sequence
  synthetic polynucleotide sequence
cgatgagctgcaccgcaa

SEQ ID NO: 13246 - DNA, 18 bp, Artificial sequence
  synthetic polynucleotide sequence
gcctcttcacaccgggga

SEQ ID NO: 13247 - DNA, 18 bp, Artificial sequence
  synthetic polynucleotide sequence
cgcagtacgtccgagaca

SEQ ID NO: 13248 - DNA, 18 bp, Artificial sequence
  synthetic polynucleotide sequence
gcgatgtacccagcgtga

SEQ ID NO: 13249 - DNA, 18 bp, Artificial sequence
  synthetic polynucleotide sequence
gcagtggaccccgaagga

SEQ ID NO: 13250 - DNA, 18 bp, Artificial sequence
  synthetic polynucleotide sequence
ctgcacagcgacttccga

SEQ ID NO: 13251 - DNA, 18 bp, Artificial sequence
  synthetic polynucleotide sequence
tgccagggctgcagagga

SEQ ID NO: 13252 - DNA, 18 bp, Artificial sequence
  synthetic polynucleotide sequence
gtccagcaccacctccga

SEQ ID NO: 13253 - DNA, 18 bp, Artificial sequence
  synthetic polynucleotide sequence
gaagctgccactgacaca

SEQ ID NO: 13254 - DNA, 18 bp, Artificial sequence
  synthetic polynucleotide sequence
caggcctgatacccagca

SEQ ID NO: 13255 - DNA, 18 bp, Artificial sequence
  synthetic polynucleotide sequence
ggaaccacaacttgggga

SEQ ID NO: 13256 - DNA, 18 bp, Artificial sequence
  synthetic polynucleotide sequence
tccagcagaagccagaga

SEQ ID NO: 13257 - DNA, 18 bp, Artificial sequence
  synthetic polynucleotide sequence
tctcctacccaccagcca

SEQ ID NO: 13258 - DNA, 18 bp, Artificial sequence
  synthetic polynucleotide sequence
gctccagtgaaagtggaa

SEQ ID NO: 13259 - DNA, 18 bp, Artificial sequence
  synthetic polynucleotide sequence
gagggtgaacacagccca

SEQ ID NO: 13260 - DNA, 18 bp, Artificial sequence
  synthetic polynucleotide sequence
gagggtgaacacagccca

SEQ ID NO: 13261 - DNA, 18 bp, Artificial sequence
  synthetic polynucleotide sequence
ctgggtggaccagcagca

SEQ ID NO: 13262 - DNA, 18 bp, Artificial sequence
  synthetic polynucleotide sequence
gggccaggaagaacctga

SEQ ID NO: 13263 - DNA, 18 bp, Artificial sequence
  synthetic polynucleotide sequence
cctgggcaactggagcta

SEQ ID NO: 13264 - DNA, 18 bp, Artificial sequence
  synthetic polynucleotide sequence
aggcgcctcatacaacga

SEQ ID NO: 13265 - DNA, 18 bp, Artificial sequence
  synthetic polynucleotide sequence
ggaaacggctgaagagca

SEQ ID NO: 13266 - DNA, 18 bp, Artificial sequence
  synthetic polynucleotide sequence
tcatcagacgctaggcga

SEQ ID NO: 13267 - DNA, 18 bp, Artificial sequence
  synthetic polynucleotide sequence
gtccagactgcaggagga

SEQ ID NO: 13268 - DNA, 18 bp, Artificial sequence
  synthetic polynucleotide sequence
agggacaggtaagaggca

SEQ ID NO: 13269 - DNA, 19 bp, Artificial sequence
  synthetic polynucleotide sequence
ataacatccccagcgtcca

SEQ ID NO: 13270 - DNA, 19 bp, Artificial sequence
  synthetic polynucleotide sequence
gcggtgagatgtacagcca

SEQ ID NO: 13271 - DNA, 18 bp, Artificial sequence
  synthetic polynucleotide sequence
gagggacaggaggtggga

SEQ ID NO: 13272 - DNA, 18 bp, Artificial sequence
  synthetic polynucleotide sequence
aggagaacgggacctgca

SEQ ID NO: 13273 - DNA, 19 bp, Artificial sequence
  synthetic polynucleotide sequence
aagcttctgggcagagaca

SEQ ID NO: 13274 - DNA, 18 bp, Artificial sequence
  synthetic polynucleotide sequence
gaggccttgggaaacaca

SEQ ID NO: 13275 - DNA, 19 bp, Artificial sequence
  synthetic polynucleotide sequence
cagagcttcctggcaagga

SEQ ID NO: 13276 - DNA, 17 bp, Artificial sequence
  synthetic polynucleotide sequence
gcagccaatgagtccca

SEQ ID NO: 13277 - DNA, 18 bp, Artificial sequence
  synthetic polynucleotide sequence
cagcatcaggagcagcga

SEQ ID NO: 13278 - DNA, 18 bp, Artificial sequence
  synthetic polynucleotide sequence
cagcatcaggagcagcga

SEQ ID NO: 13279 - DNA, 18 bp, Artificial sequence
  synthetic polynucleotide sequence
cctccagcggaagaagga

SEQ ID NO: 13280 - DNA, 18 bp, Artificial sequence
  synthetic polynucleotide sequence
ggtgtgccagagtacaca

SEQ ID NO: 13281 - DNA, 18 bp, Artificial sequence
  synthetic polynucleotide sequence
caggcatccggctaccca

SEQ ID NO: 13282 - DNA, 18 bp, Artificial sequence
  synthetic polynucleotide sequence
gcagcatggccaaggcca

SEQ ID NO: 13283 - DNA, 18 bp, Artificial sequence
  synthetic polynucleotide sequence
gcccaccctcatgcagga

SEQ ID NO: 13284 - DNA, 18 bp, Artificial sequence
  synthetic polynucleotide sequence
ggcaacaggtccagacca

SEQ ID NO: 13285 - DNA, 18 bp, Artificial sequence
  synthetic polynucleotide sequence
ggcggattgcaggaggaa

SEQ ID NO: 13286 - DNA, 18 bp, Artificial sequence
  synthetic polynucleotide sequence
taagccacgctgaccaca

SEQ ID NO: 13287 - DNA, 18 bp, Artificial sequence
  synthetic polynucleotide sequence
ccgagatgccaccgggaa

SEQ ID NO: 13288 - DNA, 18 bp, Artificial sequence
  synthetic polynucleotide sequence
ccttgcacagagcctgga

SEQ ID NO: 13289 - DNA, 18 bp, Artificial sequence
  synthetic polynucleotide sequence
acacccttgatccagcca

SEQ ID NO: 13290 - DNA, 18 bp, Artificial sequence
  synthetic polynucleotide sequence
ctccacgacgagctggaa

SEQ ID NO: 13291 - DNA, 18 bp, Artificial sequence
  synthetic polynucleotide sequence
cgcctacgaacacacgga

SEQ ID NO: 13292 - DNA, 18 bp, Artificial sequence
  synthetic polynucleotide sequence
tgaaggaggagcaggcca

SEQ ID NO: 13293 - DNA, 18 bp, Artificial sequence
  synthetic polynucleotide sequence
cacaggcgaggttcacga

SEQ ID NO: 13294 - DNA, 18 bp, Artificial sequence
  synthetic polynucleotide sequence
ggtgaacccacatgggca

SEQ ID NO: 13295 - DNA, 18 bp, Artificial sequence
  synthetic polynucleotide sequence
gcccaggcatgttgagca

SEQ ID NO: 13296 - DNA, 18 bp, Artificial sequence
  synthetic polynucleotide sequence
gcccaggcatgttgagca

SEQ ID NO: 13297 - DNA, 18 bp, Artificial sequence
  synthetic polynucleotide sequence
gacaagggaaggggccaa

SEQ ID NO: 13298 - DNA, 18 bp, Artificial sequence
  synthetic polynucleotide sequence
ggaacacatggacaggga

SEQ ID NO: 13299 - DNA, 18 bp, Artificial sequence
  synthetic polynucleotide sequence
ggaccctgtacagccgca

SEQ ID NO: 13300 - DNA, 18 bp, Artificial sequence
  synthetic polynucleotide sequence
ccggagattcgcagcaga

SEQ ID NO: 13301 - DNA, 18 bp, Artificial sequence
  synthetic polynucleotide sequence
tgcagaccgtgaacgcca

SEQ ID NO: 13302 - DNA, 18 bp, Artificial sequence
  synthetic polynucleotide sequence
cctgcacgatggcagcca

SEQ ID NO: 13303 - DNA, 18 bp, Artificial sequence
  synthetic polynucleotide sequence
ctgtacaacgcggcacca

SEQ ID NO: 13304 - DNA, 18 bp, Artificial sequence
  synthetic polynucleotide sequence
gtagaggtccatccggca

SEQ ID NO: 13305 - DNA, 18 bp, Artificial sequence
  synthetic polynucleotide sequence
gacatggtagcccgacca

SEQ ID NO: 13306 - DNA, 18 bp, Artificial sequence
  synthetic polynucleotide sequence
caatacggagctgagcca

SEQ ID NO: 13307 - DNA, 18 bp, Artificial sequence
  synthetic polynucleotide sequence
ccaccatgccgtaggaga

SEQ ID NO: 13308 - DNA, 18 bp, Artificial sequence
  synthetic polynucleotide sequence
gggcgtgcccgacaccaa

SEQ ID NO: 13309 - DNA, 18 bp, Artificial sequence
  synthetic polynucleotide sequence
gactgaccgtctcaagga

SEQ ID NO: 13310 - DNA, 18 bp, Artificial sequence
  synthetic polynucleotide sequence
gggcctaacaggaacaga

SEQ ID NO: 13311 - DNA, 18 bp, Artificial sequence
  synthetic polynucleotide sequence
gtagaccccagctgcaga

SEQ ID NO: 13312 - DNA, 18 bp, Artificial sequence
  synthetic polynucleotide sequence
tcctcaacagggagccca

SEQ ID NO: 13313 - DNA, 18 bp, Artificial sequence
  synthetic polynucleotide sequence
ctgcgtacataacagcca

SEQ ID NO: 13314 - DNA, 18 bp, Artificial sequence
  synthetic polynucleotide sequence
ctgcgtacataacagcca

SEQ ID NO: 13315 - DNA, 18 bp, Artificial sequence
  synthetic polynucleotide sequence
cagtgccgtgggtaccca

SEQ ID NO: 13316 - DNA, 18 bp, Artificial sequence
  synthetic polynucleotide sequence
gtcagcagcttgaccaga

SEQ ID NO: 13317 - DNA, 18 bp, Artificial sequence
  synthetic polynucleotide sequence
atcgccatgctggagcca

SEQ ID NO: 13318 - DNA, 18 bp, Artificial sequence
  synthetic polynucleotide sequence
gcaagaaggcaacgccca

SEQ ID NO: 13319 - DNA, 18 bp, Artificial sequence
  synthetic polynucleotide sequence
aggcgggaagctgggaca

SEQ ID NO: 13320 - DNA, 18 bp, Artificial sequence
  synthetic polynucleotide sequence
ccacctcgttccacagga

SEQ ID NO: 13321 - DNA, 18 bp, Artificial sequence
  synthetic polynucleotide sequence
caccccagcttctaacca

SEQ ID NO: 13322 - DNA, 18 bp, Artificial sequence
  synthetic polynucleotide sequence
cagcagagaagagggcga

SEQ ID NO: 13323 - DNA, 18 bp, Artificial sequence
  synthetic polynucleotide sequence
ccatcagtatcacggcca

SEQ ID NO: 13324 - DNA, 18 bp, Artificial sequence
  synthetic polynucleotide sequence
ggcccacggcactcagca

SEQ ID NO: 13325 - DNA, 18 bp, Artificial sequence
  synthetic polynucleotide sequence
tgaggagcatggtgacca

SEQ ID NO: 13326 - DNA, 18 bp, Artificial sequence
  synthetic polynucleotide sequence
atgaagcggtagccgcca

SEQ ID NO: 13327 - DNA, 18 bp, Artificial sequence
  synthetic polynucleotide sequence
ccgcgatgatgagcgtga

SEQ ID NO: 13328 - DNA, 18 bp, Artificial sequence
  synthetic polynucleotide sequence
gacaagcgcgtcaccaga

SEQ ID NO: 13329 - DNA, 18 bp, Artificial sequence
  synthetic polynucleotide sequence
tccccaggctggtcacca

SEQ ID NO: 13330 - DNA, 18 bp, Artificial sequence
  synthetic polynucleotide sequence
ccctcaacgaggcgacga

SEQ ID NO: 13331 - DNA, 18 bp, Artificial sequence
  synthetic polynucleotide sequence
acgctgtggccgtgacca

SEQ ID NO: 13332 - DNA, 18 bp, Artificial sequence
  synthetic polynucleotide sequence
acgctgtggccgtgacca

SEQ ID NO: 13333 - DNA, 18 bp, Artificial sequence
  synthetic polynucleotide sequence
aggcgggtctggtcacca

SEQ ID NO: 13334 - DNA, 18 bp, Artificial sequence
  synthetic polynucleotide sequence
tgcgaagccggtcaagga

SEQ ID NO: 13335 - DNA, 18 bp, Artificial sequence
  synthetic polynucleotide sequence
ccagaccatggggaagga

SEQ ID NO: 13336 - DNA, 18 bp, Artificial sequence
  synthetic polynucleotide sequence
cagacacaacagagccca

SEQ ID NO: 13337 - DNA, 18 bp, Artificial sequence
  synthetic polynucleotide sequence
gctgagctgtaccccaca

SEQ ID NO: 13338 - DNA, 18 bp, Artificial sequence
  synthetic polynucleotide sequence
agcaggcccaacaccgca

SEQ ID NO: 13339 - DNA, 18 bp, Artificial sequence
  synthetic polynucleotide sequence
gcctaacctgcctcacca

SEQ ID NO: 13340 - DNA, 18 bp, Artificial sequence
  synthetic polynucleotide sequence
agaggagaggaggcagca

SEQ ID NO: 13341 - DNA, 18 bp, Artificial sequence
  synthetic polynucleotide sequence
ggagctgagcatgggcca

SEQ ID NO: 13342 - DNA, 18 bp, Artificial sequence
  synthetic polynucleotide sequence
gctgggatgtccacgaca

SEQ ID NO: 13343 - DNA, 18 bp, Artificial sequence
  synthetic polynucleotide sequence
gcactcagagttaggcca

SEQ ID NO: 13344 - DNA, 18 bp, Artificial sequence
  synthetic polynucleotide sequence
cacacccagccaacagga

SEQ ID NO: 13345 - DNA, 18 bp, Artificial sequence
  synthetic polynucleotide sequence
gtcccagagttcggagca

SEQ ID NO: 13346 - DNA, 18 bp, Artificial sequence
  synthetic polynucleotide sequence
acgtggtcaccgacagca

SEQ ID NO: 13347 - DNA, 18 bp, Artificial sequence
  synthetic polynucleotide sequence
tgcaggaagctgaagcca

SEQ ID NO: 13348 - DNA, 18 bp, Artificial sequence
  synthetic polynucleotide sequence
ggaaggtgcccctcacca

SEQ ID NO: 13349 - DNA, 18 bp, Artificial sequence
  synthetic polynucleotide sequence
aggaagcggtcgtaggca

SEQ ID NO: 13350 - DNA, 18 bp, Artificial sequence
  synthetic polynucleotide sequence
aggaagcggtcgtaggca

SEQ ID NO: 13351 - DNA, 18 bp, Artificial sequence
  synthetic polynucleotide sequence
ggagctgaccatgggcaa

SEQ ID NO: 13352 - DNA, 18 bp, Artificial sequence
  synthetic polynucleotide sequence
ccacaagcttggcaggca

SEQ ID NO: 13353 - DNA, 18 bp, Artificial sequence
  synthetic polynucleotide sequence
atcagcccttgccagaga

SEQ ID NO: 13354 - DNA, 18 bp, Artificial sequence
  synthetic polynucleotide sequence
cgtgaggctgtagaggga

SEQ ID NO: 13355 - DNA, 18 bp, Artificial sequence
  synthetic polynucleotide sequence
caggggcatcttcaccga

SEQ ID NO: 13356 - DNA, 18 bp, Artificial sequence
  synthetic polynucleotide sequence
cgatggtgcccaggacca

SEQ ID NO: 13357 - DNA, 18 bp, Artificial sequence
  synthetic polynucleotide sequence
gccagctcattgggacca

SEQ ID NO: 13358 - DNA, 18 bp, Artificial sequence
  synthetic polynucleotide sequence
ggatccggggataccaga

SEQ ID NO: 13359 - DNA, 18 bp, Artificial sequence
  synthetic polynucleotide sequence
tctgcccccaccaaggca

SEQ ID NO: 13360 - DNA, 18 bp, Artificial sequence
  synthetic polynucleotide sequence
ccccaccaacaacaggca

SEQ ID NO: 13361 - DNA, 18 bp, Artificial sequence
  synthetic polynucleotide sequence
gaaggccagcctcagaga

SEQ ID NO: 13362 - DNA, 18 bp, Artificial sequence
  synthetic polynucleotide sequence
gcagcaactgcgacgcaa

SEQ ID NO: 13363 - DNA, 18 bp, Artificial sequence
  synthetic polynucleotide sequence
tgagagcgacagagccca

SEQ ID NO: 13364 - DNA, 18 bp, Artificial sequence
  synthetic polynucleotide sequence
gacaaggccttggggaca

SEQ ID NO: 13365 - DNA, 18 bp, Artificial sequence
  synthetic polynucleotide sequence
gtaccagttgcgcaggga

SEQ ID NO: 13366 - DNA, 18 bp, Artificial sequence
  synthetic polynucleotide sequence
accagggcctcacagcca

SEQ ID NO: 13367 - DNA, 18 bp, Artificial sequence
  synthetic polynucleotide sequence
catccaggggctggcaca

SEQ ID NO: 13368 - DNA, 18 bp, Artificial sequence
  synthetic polynucleotide sequence
catccaggggctggcaca

SEQ ID NO: 13369 - DNA, 18 bp, Artificial sequence
  synthetic polynucleotide sequence
ctactcccaatccaagca

SEQ ID NO: 13370 - DNA, 18 bp, Artificial sequence
  synthetic polynucleotide sequence
tggcaatgtccacaggca

SEQ ID NO: 13371 - DNA, 18 bp, Artificial sequence
  synthetic polynucleotide sequence
gaagaagggccctcagca

SEQ ID NO: 13372 - DNA, 18 bp, Artificial sequence
  synthetic polynucleotide sequence
tcagggttggcaggagga

SEQ ID NO: 13373 - DNA, 18 bp, Artificial sequence
  synthetic polynucleotide sequence
ctgcgtgaagaaggacca

SEQ ID NO: 13374 - DNA, 18 bp, Artificial sequence
  synthetic polynucleotide sequence
caggattcggggcaggca

SEQ ID NO: 13375 - DNA, 18 bp, Artificial sequence
  synthetic polynucleotide sequence
caagggagcatgattgga

SEQ ID NO: 13376 - DNA, 18 bp, Artificial sequence
  synthetic polynucleotide sequence
ggccagagccccagccaa

SEQ ID NO: 13377 - DNA, 18 bp, Artificial sequence
  synthetic polynucleotide sequence
gcaggcaaagctgagtga

SEQ ID NO: 13378 - DNA, 18 bp, Artificial sequence
  synthetic polynucleotide sequence
gtccatggtagaacccca

SEQ ID NO: 13379 - DNA, 18 bp, Artificial sequence
  synthetic polynucleotide sequence
gcattcgccgacgagtca

SEQ ID NO: 13380 - DNA, 18 bp, Artificial sequence
  synthetic polynucleotide sequence
gcagaccttcatcagaca

SEQ ID NO: 13381 - DNA, 18 bp, Artificial sequence
  synthetic polynucleotide sequence
gtgcacgcttcagcccca

SEQ ID NO: 13382 - DNA, 18 bp, Artificial sequence
  synthetic polynucleotide sequence
gccaaactgctgcagaca

SEQ ID NO: 13383 - DNA, 18 bp, Artificial sequence
  synthetic polynucleotide sequence
acaccagctccactgcca

SEQ ID NO: 13384 - DNA, 18 bp, Artificial sequence
  synthetic polynucleotide sequence
agctcagggtgagcccaa

SEQ ID NO: 13385 - DNA, 18 bp, Artificial sequence
  synthetic polynucleotide sequence
ccagccaccaagatccga

SEQ ID NO: 13386 - DNA, 18 bp, Artificial sequence
  synthetic polynucleotide sequence
ccagccaccaagatccga

SEQ ID NO: 13387 - DNA, 18 bp, Artificial sequence
  synthetic polynucleotide sequence
cacgactcggcagaccca

SEQ ID NO: 13388 - DNA, 18 bp, Artificial sequence
  synthetic polynucleotide sequence
gcagacccagcatggaca

SEQ ID NO: 13389 - DNA, 18 bp, Artificial sequence
  synthetic polynucleotide sequence
gctgcggaagacaggcca

SEQ ID NO: 13390 - DNA, 18 bp, Artificial sequence
  synthetic polynucleotide sequence
tagtgctgcagccaggca

SEQ ID NO: 13391 - DNA, 18 bp, Artificial sequence
  synthetic polynucleotide sequence
cggaagtggtcaagcaga

SEQ ID NO: 13392 - DNA, 18 bp, Artificial sequence
  synthetic polynucleotide sequence
tccagagaggacgtggga

SEQ ID NO: 13393 - DNA, 18 bp, Artificial sequence
  synthetic polynucleotide sequence
ggctactccatgcaggga

SEQ ID NO: 13394 - DNA, 18 bp, Artificial sequence
  synthetic polynucleotide sequence
tccataggagccagggca

SEQ ID NO: 13395 - DNA, 18 bp, Artificial sequence
  synthetic polynucleotide sequence
cgcagcaccggtcagcaa

SEQ ID NO: 13396 - DNA, 18 bp, Artificial sequence
  synthetic polynucleotide sequence
ggatggactggaagggga

SEQ ID NO: 13397 - DNA, 18 bp, Artificial sequence
  synthetic polynucleotide sequence
ccacctggtcatgaggca

SEQ ID NO: 13398 - DNA, 18 bp, Artificial sequence
  synthetic polynucleotide sequence
acgctgccctgaggagca

SEQ ID NO: 13399 - DNA, 18 bp, Artificial sequence
  synthetic polynucleotide sequence
agcacattggaccaggca

SEQ ID NO: 13400 - DNA, 18 bp, Artificial sequence
  synthetic polynucleotide sequence
agtgtgacggcagtcgca

SEQ ID NO: 13401 - DNA, 18 bp, Artificial sequence
  synthetic polynucleotide sequence
tctgacagcgtgcgggga

SEQ ID NO: 13402 - DNA, 18 bp, Artificial sequence
  synthetic polynucleotide sequence
ccttccccctcgccagca

SEQ ID NO: 13403 - DNA, 18 bp, Artificial sequence
  synthetic polynucleotide sequence
gcaccacccgatgccaga

SEQ ID NO: 13404 - DNA, 18 bp, Artificial sequence
  synthetic polynucleotide sequence
gcaccacccgatgccaga

SEQ ID NO: 13405 - DNA, 18 bp, Artificial sequence
  synthetic polynucleotide sequence
acgatacggccaagggca

SEQ ID NO: 13406 - DNA, 18 bp, Artificial sequence
  synthetic polynucleotide sequence
tgtcgaaggggtaggaca

SEQ ID NO: 13407 - DNA, 18 bp, Artificial sequence
  synthetic polynucleotide sequence
cagggatccacacactga

SEQ ID NO: 13408 - DNA, 18 bp, Artificial sequence
  synthetic polynucleotide sequence
gattgcactgagccagca

SEQ ID NO: 13409 - DNA, 18 bp, Artificial sequence
  synthetic polynucleotide sequence
cagatcagcagttcagga

SEQ ID NO: 13410 - DNA, 18 bp, Artificial sequence
  synthetic polynucleotide sequence
tgtagaggcgccaggaga

SEQ ID NO: 13411 - DNA, 18 bp, Artificial sequence
  synthetic polynucleotide sequence
ccgagtgcaactgcagca

SEQ ID NO: 13412 - DNA, 18 bp, Artificial sequence
  synthetic polynucleotide sequence
atgcagaggccctgggca

SEQ ID NO: 13413 - DNA, 18 bp, Artificial sequence
  synthetic polynucleotide sequence
gggaaaatgtggccacca

SEQ ID NO: 13414 - DNA, 18 bp, Artificial sequence
  synthetic polynucleotide sequence
gaggccatgccaatgcga

SEQ ID NO: 13415 - DNA, 18 bp, Artificial sequence
  synthetic polynucleotide sequence
agtacaccagggcagcca

SEQ ID NO: 13416 - DNA, 19 bp, Artificial sequence
  synthetic polynucleotide sequence
caagcacagaacacctgga

SEQ ID NO: 13417 - DNA, 18 bp, Artificial sequence
  synthetic polynucleotide sequence
cagggagccaagcgcgaa

SEQ ID NO: 13418 - DNA, 17 bp, Artificial sequence
  synthetic polynucleotide sequence
ccgatggaagggcgaga

SEQ ID NO: 13419 - DNA, 18 bp, Artificial sequence
  synthetic polynucleotide sequence
ccacaggcgcggatgcaa

SEQ ID NO: 13420 - DNA, 18 bp, Artificial sequence
  synthetic polynucleotide sequence
gatgagcaatgagccgga

SEQ ID NO: 13421 - DNA, 18 bp, Artificial sequence
  synthetic polynucleotide sequence
ccaccatctcagccacca

SEQ ID NO: 13422 - DNA, 18 bp, Artificial sequence
  synthetic polynucleotide sequence
ccaccatctcagccacca

SEQ ID NO: 13423 - DNA, 18 bp, Artificial sequence
  synthetic polynucleotide sequence
cagagaccgcaggagcca

SEQ ID NO: 13424 - DNA, 18 bp, Artificial sequence
  synthetic polynucleotide sequence
tgcccggaacaggaagga

SEQ ID NO: 13425 - DNA, 18 bp, Artificial sequence
  synthetic polynucleotide sequence
ctccaccagtcctgggaa

SEQ ID NO: 13426 - DNA, 18 bp, Artificial sequence
  synthetic polynucleotide sequence
tctggggcacgtggcaca

SEQ ID NO: 13427 - DNA, 18 bp, Artificial sequence
  synthetic polynucleotide sequence
gccagggcccaatagcaa

SEQ ID NO: 13428 - DNA, 18 bp, Artificial sequence
  synthetic polynucleotide sequence
ccagcagggagctgagga

SEQ ID NO: 13429 - DNA, 18 bp, Artificial sequence
  synthetic polynucleotide sequence
gggtgatctgggccgaca

SEQ ID NO: 13430 - DNA, 18 bp, Artificial sequence
  synthetic polynucleotide sequence
gaagaccacacgcaggca

SEQ ID NO: 13431 - DNA, 18 bp, Artificial sequence
  synthetic polynucleotide sequence
ccacgagcatcttcgaga

SEQ ID NO: 13432 - DNA, 18 bp, Artificial sequence
  synthetic polynucleotide sequence
agggtagctgctccagca

SEQ ID NO: 13433 - DNA, 18 bp, Artificial sequence
  synthetic polynucleotide sequence
gtctcaggaagacagcca

SEQ ID NO: 13434 - DNA, 18 bp, Artificial sequence
  synthetic polynucleotide sequence
cacctggaatgggaccaa

SEQ ID NO: 13435 - DNA, 18 bp, Artificial sequence
  synthetic polynucleotide sequence
aaggccaggagcactcca

SEQ ID NO: 13436 - DNA, 18 bp, Artificial sequence
  synthetic polynucleotide sequence
aaattgggccaggcccga

SEQ ID NO: 13437 - DNA, 18 bp, Artificial sequence
  synthetic polynucleotide sequence
agtgagcagcggagggga

SEQ ID NO: 13438 - DNA, 18 bp, Artificial sequence
  synthetic polynucleotide sequence
aaattggaccaggcccca

SEQ ID NO: 13439 - DNA, 18 bp, Artificial sequence
  synthetic polynucleotide sequence
agaagggcagcaggacca

SEQ ID NO: 13440 - DNA, 18 bp, Artificial sequence
  synthetic polynucleotide sequence
agaagggcagcaggacca

SEQ ID NO: 13441 - DNA, 18 bp, Artificial sequence
  synthetic polynucleotide sequence
gctgtcaactccccagca

SEQ ID NO: 13442 - DNA, 18 bp, Artificial sequence
  synthetic polynucleotide sequence
cgaccaggagggatccga

SEQ ID NO: 13443 - DNA, 18 bp, Artificial sequence
  synthetic polynucleotide sequence
agggcgtggcgacaggca

SEQ ID NO: 13444 - DNA, 18 bp, Artificial sequence
  synthetic polynucleotide sequence
aagcggaggcaagccaga

SEQ ID NO: 13445 - DNA, 18 bp, Artificial sequence
  synthetic polynucleotide sequence
cctgacccctgcaaagca

SEQ ID NO: 13446 - DNA, 18 bp, Artificial sequence
  synthetic polynucleotide sequence
agcacccagcaaggacca

SEQ ID NO: 13447 - DNA, 18 bp, Artificial sequence
  synthetic polynucleotide sequence
caagggctgtgctaagca

SEQ ID NO: 13448 - DNA, 18 bp, Artificial sequence
  synthetic polynucleotide sequence
gtgtctagagagggccca

SEQ ID NO: 13449 - DNA, 18 bp, Artificial sequence
  synthetic polynucleotide sequence
acaaggcagccgacccca

SEQ ID NO: 13450 - DNA, 18 bp, Artificial sequence
  synthetic polynucleotide sequence
gatggccaggtgtgcaga

SEQ ID NO: 13451 - DNA, 18 bp, Artificial sequence
  synthetic polynucleotide sequence
cttccagctgaagaggaa

SEQ ID NO: 13452 - DNA, 18 bp, Artificial sequence
  synthetic polynucleotide sequence
tgcaaacagtgctgcaca

SEQ ID NO: 13453 - DNA, 18 bp, Artificial sequence
  synthetic polynucleotide sequence
tgaagtagccgatgacca

SEQ ID NO: 13454 - DNA, 18 bp, Artificial sequence
  synthetic polynucleotide sequence
cgcagagacagacgggga

SEQ ID NO: 13455 - DNA, 18 bp, Artificial sequence
  synthetic polynucleotide sequence
ttgagtccgaggcaggga

SEQ ID NO: 13456 - DNA, 18 bp, Artificial sequence
  synthetic polynucleotide sequence
cttggaggaggcgcagga

SEQ ID NO: 13457 - DNA, 18 bp, Artificial sequence
  synthetic polynucleotide sequence
gaccagcactgtgagcca

SEQ ID NO: 13458 - DNA, 18 bp, Artificial sequence
  synthetic polynucleotide sequence
gaccagcactgtgagcca

SEQ ID NO: 13459 - DNA, 18 bp, Artificial sequence
  synthetic polynucleotide sequence
ggaccacatgcgggctca

SEQ ID NO: 13460 - DNA, 18 bp, Artificial sequence
  synthetic polynucleotide sequence
aagctctgacccagggca

SEQ ID NO: 13461 - DNA, 18 bp, Artificial sequence
  synthetic polynucleotide sequence
agctccccagccaccaca

SEQ ID NO: 13462 - DNA, 18 bp, Artificial sequence
  synthetic polynucleotide sequence
gcccactgtgaagaggca

SEQ ID NO: 13463 - DNA, 18 bp, Artificial sequence
  synthetic polynucleotide sequence
cgtcggccgaaacgctga

SEQ ID NO: 13464 - DNA, 18 bp, Artificial sequence
  synthetic polynucleotide sequence
ccacccagagaactgcca

SEQ ID NO: 13465 - DNA, 18 bp, Artificial sequence
  synthetic polynucleotide sequence
cgccggtgatcatagcca

SEQ ID NO: 13466 - DNA, 18 bp, Artificial sequence
  synthetic polynucleotide sequence
gagcctggtagtacagca

SEQ ID NO: 13467 - DNA, 18 bp, Artificial sequence
  synthetic polynucleotide sequence
gtcagtgggccctacaca

SEQ ID NO: 13468 - DNA, 18 bp, Artificial sequence
  synthetic polynucleotide sequence
tggccgtcacggtggaga

SEQ ID NO: 13469 - DNA, 18 bp, Artificial sequence
  synthetic polynucleotide sequence
ggcagactcgaagcccca

SEQ ID NO: 13470 - DNA, 18 bp, Artificial sequence
  synthetic polynucleotide sequence
gctaaggagacaggctca

SEQ ID NO: 13471 - DNA, 18 bp, Artificial sequence
  synthetic polynucleotide sequence
aaccacggtatgacgaca

SEQ ID NO: 13472 - DNA, 18 bp, Artificial sequence
  synthetic polynucleotide sequence
tgacaacgtgcagtccga

SEQ ID NO: 13473 - DNA, 18 bp, Artificial sequence
  synthetic polynucleotide sequence
atgggaagaacagcagga

SEQ ID NO: 13474 - DNA, 18 bp, Artificial sequence
  synthetic polynucleotide sequence
ccaccttaacacagccaa

SEQ ID NO: 13475 - DNA, 18 bp, Artificial sequence
  synthetic polynucleotide sequence
taagaagccaggagagca

SEQ ID NO: 13476 - DNA, 18 bp, Artificial sequence
  synthetic polynucleotide sequence
taagaagccaggagagca

SEQ ID NO: 13477 - DNA, 18 bp, Artificial sequence
  synthetic polynucleotide sequence
ctactgcagcatgcgcaa

SEQ ID NO: 13478 - DNA, 18 bp, Artificial sequence
  synthetic polynucleotide sequence
agatgaggcagcaggcca

SEQ ID NO: 13479 - DNA, 18 bp, Artificial sequence
  synthetic polynucleotide sequence
ccagtggcaccacaagca

SEQ ID NO: 13480 - DNA, 18 bp, Artificial sequence
  synthetic polynucleotide sequence
gcaccaattgcgagccca

SEQ ID NO: 13481 - DNA, 18 bp, Artificial sequence
  synthetic polynucleotide sequence
gaagctgcagaacgggga

SEQ ID NO: 13482 - DNA, 18 bp, Artificial sequence
  synthetic polynucleotide sequence
gcggacacctttcagcca

SEQ ID NO: 13483 - DNA, 18 bp, Artificial sequence
  synthetic polynucleotide sequence
agtcagcgaggagagcga

SEQ ID NO: 13484 - DNA, 18 bp, Artificial sequence
  synthetic polynucleotide sequence
ccacgttgtgcagcagga

SEQ ID NO: 13485 - DNA, 18 bp, Artificial sequence
  synthetic polynucleotide sequence
aacagccagcacccacca

SEQ ID NO: 13486 - DNA, 18 bp, Artificial sequence
  synthetic polynucleotide sequence
acagccctgactggagca

SEQ ID NO: 13487 - DNA, 18 bp, Artificial sequence
  synthetic polynucleotide sequence
atcaccatccaggccaga

SEQ ID NO: 13488 - DNA, 18 bp, Artificial sequence
  synthetic polynucleotide sequence
ccaccaccaaaaccacca

SEQ ID NO: 13489 - DNA, 18 bp, Artificial sequence
  synthetic polynucleotide sequence
atgcctccagcaagtgca

SEQ ID NO: 13490 - DNA, 18 bp, Artificial sequence
  synthetic polynucleotide sequence
tcaatgcagggatgagca

SEQ ID NO: 13491 - DNA, 18 bp, Artificial sequence
  synthetic polynucleotide sequence
ctgccaccagtctaggca

SEQ ID NO: 13492 - DNA, 18 bp, Artificial sequence
  synthetic polynucleotide sequence
accgcatacctcgggaga

SEQ ID NO: 13493 - DNA, 18 bp, Artificial sequence
  synthetic polynucleotide sequence
cgtaggggaagcggagca

SEQ ID NO: 13494 - DNA, 18 bp, Artificial sequence
  synthetic polynucleotide sequence
cgtaggggaagcggagca

SEQ ID NO: 13495 - DNA, 18 bp, Artificial sequence
  synthetic polynucleotide sequence
ggtacggtggcaaaagga

SEQ ID NO: 13496 - DNA, 18 bp, Artificial sequence
  synthetic polynucleotide sequence
cagcacacatcgtgcaca

SEQ ID NO: 13497 - DNA, 18 bp, Artificial sequence
  synthetic polynucleotide sequence
tccacaggcatcacggca

SEQ ID NO: 13498 - DNA, 18 bp, Artificial sequence
  synthetic polynucleotide sequence
cagttcccaggctcagca

SEQ ID NO: 13499 - DNA, 18 bp, Artificial sequence
  synthetic polynucleotide sequence
agggcatggactgcgcca

SEQ ID NO: 13500 - DNA, 18 bp, Artificial sequence
  synthetic polynucleotide sequence
cctatcagtgccaccgca

SEQ ID NO: 13501 - DNA, 18 bp, Artificial sequence
  synthetic polynucleotide sequence
aaggcgttcggatgggca

SEQ ID NO: 13502 - DNA, 18 bp, Artificial sequence
  synthetic polynucleotide sequence
aagctgtcaccacggcca

SEQ ID NO: 13503 - DNA, 18 bp, Artificial sequence
  synthetic polynucleotide sequence
tccaggaggaagttcaga

SEQ ID NO: 13504 - DNA, 18 bp, Artificial sequence
  synthetic polynucleotide sequence
acgctggttgcaagagca

SEQ ID NO: 13505 - DNA, 18 bp, Artificial sequence
  synthetic polynucleotide sequence
cgtggacttcaccaccca

SEQ ID NO: 13506 - DNA, 18 bp, Artificial sequence
  synthetic polynucleotide sequence
tcacgtcgctcagcggca

SEQ ID NO: 13507 - DNA, 18 bp, Artificial sequence
  synthetic polynucleotide sequence
caggctggagcagactga

SEQ ID NO: 13508 - DNA, 18 bp, Artificial sequence
  synthetic polynucleotide sequence
gctggacatgcatgccaa

SEQ ID NO: 13509 - DNA, 18 bp, Artificial sequence
  synthetic polynucleotide sequence
gccgggatagcagcagca

SEQ ID NO: 13510 - DNA, 18 bp, Artificial sequence
  synthetic polynucleotide sequence
ccctagtaggcgtggaca

SEQ ID NO: 13511 - DNA, 18 bp, Artificial sequence
  synthetic polynucleotide sequence
ggctgccacggtgagaca

SEQ ID NO: 13512 - DNA, 18 bp, Artificial sequence
  synthetic polynucleotide sequence
ggctgccacggtgagaca

SEQ ID NO: 13513 - DNA, 18 bp, Artificial sequence
  synthetic polynucleotide sequence
ggccgtcatctggacaga

SEQ ID NO: 13514 - DNA, 18 bp, Artificial sequence
  synthetic polynucleotide sequence
cgaaggccaaggtccaga

SEQ ID NO: 13515 - DNA, 18 bp, Artificial sequence
  synthetic polynucleotide sequence
gctgtgcagatgacgcca

SEQ ID NO: 13516 - DNA, 18 bp, Artificial sequence
  synthetic polynucleotide sequence
tgtacccggggatgagga

SEQ ID NO: 13517 - DNA, 18 bp, Artificial sequence
  synthetic polynucleotide sequence
accccaaggcggtcacca

SEQ ID NO: 13518 - DNA, 18 bp, Artificial sequence
  synthetic polynucleotide sequence
actggctgtccaggccca

SEQ ID NO: 13519 - DNA, 18 bp, Artificial sequence
  synthetic polynucleotide sequence
cctagggctggacagcca

SEQ ID NO: 13520 - DNA, 18 bp, Artificial sequence
  synthetic polynucleotide sequence
ggtagcacatgacggcga

SEQ ID NO: 13521 - DNA, 18 bp, Artificial sequence
  synthetic polynucleotide sequence
ccagaggctctagcccaa

SEQ ID NO: 13522 - DNA, 18 bp, Artificial sequence
  synthetic polynucleotide sequence
aaccaagcagcagcccaa

SEQ ID NO: 13523 - DNA, 18 bp, Artificial sequence
  synthetic polynucleotide sequence
gacactgatcccaaggca

SEQ ID NO: 13524 - DNA, 18 bp, Artificial sequence
  synthetic polynucleotide sequence
gaattcggcgaggcagca

SEQ ID NO: 13525 - DNA, 18 bp, Artificial sequence
  synthetic polynucleotide sequence
tggcctcagtgaaggcga

SEQ ID NO: 13526 - DNA, 18 bp, Artificial sequence
  synthetic polynucleotide sequence
gaccgtgaaggaggacca

SEQ ID NO: 13527 - DNA, 18 bp, Artificial sequence
  synthetic polynucleotide sequence
gcgtgatgccataggcca

SEQ ID NO: 13528 - DNA, 18 bp, Artificial sequence
  synthetic polynucleotide sequence
gccactcacctacgacga

SEQ ID NO: 13529 - DNA, 18 bp, Artificial sequence
  synthetic polynucleotide sequence
gcccgtacacgtagcaca

SEQ ID NO: 13530 - DNA, 18 bp, Artificial sequence
  synthetic polynucleotide sequence
gcccgtacacgtagcaca

SEQ ID NO: 13531 - DNA, 18 bp, Artificial sequence
  synthetic polynucleotide sequence
ggcagttcagcgacgaca

SEQ ID NO: 13532 - DNA, 18 bp, Artificial sequence
  synthetic polynucleotide sequence
caccatggccatggagga

SEQ ID NO: 13533 - DNA, 18 bp, Artificial sequence
  synthetic polynucleotide sequence
gtcgcgctgatcgaagca

SEQ ID NO: 13534 - DNA, 18 bp, Artificial sequence
  synthetic polynucleotide sequence
cccagcagatcctccaga

SEQ ID NO: 13535 - DNA, 18 bp, Artificial sequence
  synthetic polynucleotide sequence
cctggaatcgaccaccca

SEQ ID NO: 13536 - DNA, 18 bp, Artificial sequence
  synthetic polynucleotide sequence
aggcgggtgatgtcagga

SEQ ID NO: 13537 - DNA, 18 bp, Artificial sequence
  synthetic polynucleotide sequence
cagagcagggcgtgcaca

SEQ ID NO: 13538 - DNA, 18 bp, Artificial sequence
  synthetic polynucleotide sequence
gcacaacagagggccaca

SEQ ID NO: 13539 - DNA, 18 bp, Artificial sequence
  synthetic polynucleotide sequence
catccccctcaccagcca

SEQ ID NO: 13540 - DNA, 18 bp, Artificial sequence
  synthetic polynucleotide sequence
agagacgaagcgccagca

SEQ ID NO: 13541 - DNA, 18 bp, Artificial sequence
  synthetic polynucleotide sequence
agcactggcaggaaggga

SEQ ID NO: 13542 - DNA, 18 bp, Artificial sequence
  synthetic polynucleotide sequence
gaagggaggctctcacca

SEQ ID NO: 13543 - DNA, 18 bp, Artificial sequence
  synthetic polynucleotide sequence
ccagcaggaaggcccaga

SEQ ID NO: 13544 - DNA, 18 bp, Artificial sequence
  synthetic polynucleotide sequence
gcgacacgtacacgctca

SEQ ID NO: 13545 - DNA, 18 bp, Artificial sequence
  synthetic polynucleotide sequence
cagtagctgcagggcgta

SEQ ID NO: 13546 - DNA, 18 bp, Artificial sequence
  synthetic polynucleotide sequence
tgctccagaacacgggca

SEQ ID NO: 13547 - DNA, 18 bp, Artificial sequence
  synthetic polynucleotide sequence
tggtcacgatgaccgcga

SEQ ID NO: 13548 - DNA, 18 bp, Artificial sequence
  synthetic polynucleotide sequence
tggtcacgatgaccgcga

SEQ ID NO: 13549 - DNA, 18 bp, Artificial sequence
  synthetic polynucleotide sequence
ggaggtggccaaggcaga

SEQ ID NO: 13550 - DNA, 18 bp, Artificial sequence
  synthetic polynucleotide sequence
gccagtgatgaaggccca

SEQ ID NO: 13551 - DNA, 18 bp, Artificial sequence
  synthetic polynucleotide sequence
ccctggccatcatcggca

SEQ ID NO: 13552 - DNA, 18 bp, Artificial sequence
  synthetic polynucleotide sequence
tccagaaggagacggcga

SEQ ID NO: 13553 - DNA, 18 bp, Artificial sequence
  synthetic polynucleotide sequence
ccagggacactctgagca

SEQ ID NO: 13554 - DNA, 18 bp, Artificial sequence
  synthetic polynucleotide sequence
agggcagagtagagggca

SEQ ID NO: 13555 - DNA, 18 bp, Artificial sequence
  synthetic polynucleotide sequence
ctggcaacacaagcccaa

SEQ ID NO: 13556 - DNA, 18 bp, Artificial sequence
  synthetic polynucleotide sequence
ccacctcggggtacacga

SEQ ID NO: 13557 - DNA, 18 bp, Artificial sequence
  synthetic polynucleotide sequence
ccatctaccacgcagcca

SEQ ID NO: 13558 - DNA, 18 bp, Artificial sequence
  synthetic polynucleotide sequence
gatacagcagcaccccca

SEQ ID NO: 13559 - DNA, 18 bp, Artificial sequence
  synthetic polynucleotide sequence
caatgcccacgaaggcga

SEQ ID NO: 13560 - DNA, 18 bp, Artificial sequence
  synthetic polynucleotide sequence
ctgacacgttcgccagca

SEQ ID NO: 13561 - DNA, 18 bp, Artificial sequence
  synthetic polynucleotide sequence
agccgaagtgcgaggcca

SEQ ID NO: 13562 - DNA, 18 bp, Artificial sequence
  synthetic polynucleotide sequence
tgcagcaggggatgagga

SEQ ID NO: 13563 - DNA, 18 bp, Artificial sequence
  synthetic polynucleotide sequence
tacagatgccagatgcca

SEQ ID NO: 13564 - DNA, 18 bp, Artificial sequence
  synthetic polynucleotide sequence
caggtccaaagatacgca

SEQ ID NO: 13565 - DNA, 18 bp, Artificial sequence
  synthetic polynucleotide sequence
ccttcagccactgcacca

SEQ ID NO: 13566 - DNA, 18 bp, Artificial sequence
  synthetic polynucleotide sequence
ccttcagccactgcacca

SEQ ID NO: 13567 - DNA, 18 bp, Artificial sequence
  synthetic polynucleotide sequence
cagtgacaccagcgagga

SEQ ID NO: 13568 - DNA, 18 bp, Artificial sequence
  synthetic polynucleotide sequence
tggccatggccagggaga

SEQ ID NO: 13569 - DNA, 18 bp, Artificial sequence
  synthetic polynucleotide sequence
catccattggaacgggaa

SEQ ID NO: 13570 - DNA, 18 bp, Artificial sequence
  synthetic polynucleotide sequence
atccaggtatggcagcca

SEQ ID NO: 13571 - DNA, 18 bp, Artificial sequence
  synthetic polynucleotide sequence
gaataggggagactccca

SEQ ID NO: 13572 - DNA, 18 bp, Artificial sequence
  synthetic polynucleotide sequence
ttaagccaccaagctcca

SEQ ID NO: 13573 - DNA, 18 bp, Artificial sequence
  synthetic polynucleotide sequence
acaagacgctgcaatgga

SEQ ID NO: 13574 - DNA, 18 bp, Artificial sequence
  synthetic polynucleotide sequence
accagcaagagaagagga

SEQ ID NO: 13575 - DNA, 18 bp, Artificial sequence
  synthetic polynucleotide sequence
cccgcatagctaccacca

SEQ ID NO: 13576 - DNA, 18 bp, Artificial sequence
  synthetic polynucleotide sequence
gggtagacttcggccaca

SEQ ID NO: 13577 - DNA, 18 bp, Artificial sequence
  synthetic polynucleotide sequence
ccagacaagcacacggga

SEQ ID NO: 13578 - DNA, 18 bp, Artificial sequence
  synthetic polynucleotide sequence
cccgaaggtcaccaagca

SEQ ID NO: 13579 - DNA, 18 bp, Artificial sequence
  synthetic polynucleotide sequence
tatcccactgcagggcca

SEQ ID NO: 13580 - DNA, 18 bp, Artificial sequence
  synthetic polynucleotide sequence
gtggcaactccaccgcca

SEQ ID NO: 13581 - DNA, 18 bp, Artificial sequence
  synthetic polynucleotide sequence
gcagatgccatgcaggca

SEQ ID NO: 13582 - DNA, 18 bp, Artificial sequence
  synthetic polynucleotide sequence
ggcagatcctcaacggca

SEQ ID NO: 13583 - DNA, 18 bp, Artificial sequence
  synthetic polynucleotide sequence
acacctcgtacagccgca

SEQ ID NO: 13584 - DNA, 18 bp, Artificial sequence
  synthetic polynucleotide sequence
acacctcgtacagccgca

SEQ ID NO: 13585 - DNA, 18 bp, Artificial sequence
  synthetic polynucleotide sequence
ggtggccactgacaagga

SEQ ID NO: 13586 - DNA, 18 bp, Artificial sequence
  synthetic polynucleotide sequence
agcgtcaccagctccaca

SEQ ID NO: 13587 - DNA, 18 bp, Artificial sequence
  synthetic polynucleotide sequence
caccctcaccacccagca

SEQ ID NO: 13588 - DNA, 18 bp, Artificial sequence
  synthetic polynucleotide sequence
aacagcaccaccccacca

SEQ ID NO: 13589 - DNA, 18 bp, Artificial sequence
  synthetic polynucleotide sequence
gaagctgtgggtggagca

SEQ ID NO: 13590 - DNA, 18 bp, Artificial sequence
  synthetic polynucleotide sequence
ctattcaaccggaccgca

SEQ ID NO: 13591 - DNA, 19 bp, Artificial sequence
  synthetic polynucleotide sequence
ccatccatgccaacacaga

SEQ ID NO: 13592 - DNA, 19 bp, Artificial sequence
  synthetic polynucleotide sequence
ccactatccctgcagcaca

SEQ ID NO: 13593 - DNA, 18 bp, Artificial sequence
  synthetic polynucleotide sequence
gcgaggagaaacctgcca

SEQ ID NO: 13594 - DNA, 18 bp, Artificial sequence
  synthetic polynucleotide sequence
acctcacaaggagccaca

SEQ ID NO: 13595 - DNA, 18 bp, Artificial sequence
  synthetic polynucleotide sequence
gggtgtcaacaggatcca

SEQ ID NO: 13596 - DNA, 18 bp, Artificial sequence
  synthetic polynucleotide sequence
acctgagtgccagagtga

SEQ ID NO: 13597 - DNA, 18 bp, Artificial sequence
  synthetic polynucleotide sequence
gcttgaccagaggcccca

SEQ ID NO: 13598 - DNA, 18 bp, Artificial sequence
  synthetic polynucleotide sequence
gcccggagaaggaaagca

SEQ ID NO: 13599 - DNA, 18 bp, Artificial sequence
  synthetic polynucleotide sequence
ctgcctccaccgtcacca

SEQ ID NO: 13600 - DNA, 18 bp, Artificial sequence
  synthetic polynucleotide sequence
gcaaggagcccatgacca

SEQ ID NO: 13601 - DNA, 16 bp, Artificial sequence
  synthetic polynucleotide sequence
ggcgtatcagctggca

SEQ ID NO: 13602 - DNA, 16 bp, Artificial sequence
  synthetic polynucleotide sequence
ggcgtatcagctggca

SEQ ID NO: 13603 - DNA, 19 bp, Artificial sequence
  synthetic polynucleotide sequence
gcagaataccgaaggcaga

SEQ ID NO: 13604 - DNA, 18 bp, Artificial sequence
  synthetic polynucleotide sequence
gcaacgcactgaagggga

SEQ ID NO: 13605 - DNA, 18 bp, Artificial sequence
  synthetic polynucleotide sequence
ggagcggagtacaggaga

SEQ ID NO: 13606 - DNA, 18 bp, Artificial sequence
  synthetic polynucleotide sequence
acagcggatgcttgggga

SEQ ID NO: 13607 - DNA, 18 bp, Artificial sequence
  synthetic polynucleotide sequence
tccacaggacagaagcca

SEQ ID NO: 13608 - DNA, 18 bp, Artificial sequence
  synthetic polynucleotide sequence
gtcgatgacactgacgca

SEQ ID NO: 13609 - DNA, 18 bp, Artificial sequence
  synthetic polynucleotide sequence
tcaacctggagcagcgca

SEQ ID NO: 13610 - DNA, 18 bp, Artificial sequence
  synthetic polynucleotide sequence
cgcggttgtaggcccaca

SEQ ID NO: 13611 - DNA, 18 bp, Artificial sequence
  synthetic polynucleotide sequence
cacactggacaacccgga

SEQ ID NO: 13612 - DNA, 18 bp, Artificial sequence
  synthetic polynucleotide sequence
ctctagccagcacgggca

SEQ ID NO: 13613 - DNA, 18 bp, Artificial sequence
  synthetic polynucleotide sequence
agttgagtaaggcccaca

SEQ ID NO: 13614 - DNA, 18 bp, Artificial sequence
  synthetic polynucleotide sequence
gatgccaggagagtggga

SEQ ID NO: 13615 - DNA, 18 bp, Artificial sequence
  synthetic polynucleotide sequence
tttaagcccaggccacca

SEQ ID NO: 13616 - DNA, 18 bp, Artificial sequence
  synthetic polynucleotide sequence
gccttgatggcaccacca

SEQ ID NO: 13617 - DNA, 18 bp, Artificial sequence
  synthetic polynucleotide sequence
ggatcaccttcaccggga

SEQ ID NO: 13618 - DNA, 18 bp, Artificial sequence
  synthetic polynucleotide sequence
cgtggctaacctcacgga

SEQ ID NO: 13619 - DNA, 18 bp, Artificial sequence
  synthetic polynucleotide sequence
gcgaatacactgtcgcaa

SEQ ID NO: 13620 - DNA, 18 bp, Artificial sequence
  synthetic polynucleotide sequence
gcgaatacactgtcgcaa

SEQ ID NO: 13621 - DNA, 18 bp, Artificial sequence
  synthetic polynucleotide sequence
cccaaggccttcctacca

SEQ ID NO: 13622 - DNA, 18 bp, Artificial sequence
  synthetic polynucleotide sequence
ctgggcccaccacctgca

SEQ ID NO: 13623 - DNA, 18 bp, Artificial sequence
  synthetic polynucleotide sequence
acgtgcagcacatccgca

SEQ ID NO: 13624 - DNA, 18 bp, Artificial sequence
  synthetic polynucleotide sequence
tgatggacagcacggcca

SEQ ID NO: 13625 - DNA, 18 bp, Artificial sequence
  synthetic polynucleotide sequence
ggaggaccagtcagacca

SEQ ID NO: 13626 - DNA, 18 bp, Artificial sequence
  synthetic polynucleotide sequence
gcccaaccccagctccga

SEQ ID NO: 13627 - DNA, 18 bp, Artificial sequence
  synthetic polynucleotide sequence
ggtcagataccaggccca

SEQ ID NO: 13628 - DNA, 18 bp, Artificial sequence
  synthetic polynucleotide sequence
ggtagggccactcccaga

SEQ ID NO: 13629 - DNA, 18 bp, Artificial sequence
  synthetic polynucleotide sequence
ctcaccgttccccaacca

SEQ ID NO: 13630 - DNA, 18 bp, Artificial sequence
  synthetic polynucleotide sequence
ggttaggaggagcgggga

SEQ ID NO: 13631 - DNA, 18 bp, Artificial sequence
  synthetic polynucleotide sequence
ggtggcataagcaaggca

SEQ ID NO: 13632 - DNA, 18 bp, Artificial sequence
  synthetic polynucleotide sequence
cctgggcatccataccca

SEQ ID NO: 13633 - DNA, 18 bp, Artificial sequence
  synthetic polynucleotide sequence
cggcaatacgctgaagca

SEQ ID NO: 13634 - DNA, 18 bp, Artificial sequence
  synthetic polynucleotide sequence
cccaggctgaggaagaga

SEQ ID NO: 13635 - DNA, 18 bp, Artificial sequence
  synthetic polynucleotide sequence
tctagagcccgcagctca

SEQ ID NO: 13636 - DNA, 18 bp, Artificial sequence
  synthetic polynucleotide sequence
ggtgctcgatcccaggca

SEQ ID NO: 13637 - DNA, 18 bp, Artificial sequence
  synthetic polynucleotide sequence
agcagtgacttccacgca

SEQ ID NO: 13638 - DNA, 18 bp, Artificial sequence
  synthetic polynucleotide sequence
agcagtgacttccacgca

SEQ ID NO: 13639 - DNA, 18 bp, Artificial sequence
  synthetic polynucleotide sequence
ggttctaagcccagagga

SEQ ID NO: 13640 - DNA, 18 bp, Artificial sequence
  synthetic polynucleotide sequence
actctgcgatggcaccga

SEQ ID NO: 13641 - DNA, 18 bp, Artificial sequence
  synthetic polynucleotide sequence
ggaggaagctcgtcggaa

SEQ ID NO: 13642 - DNA, 18 bp, Artificial sequence
  synthetic polynucleotide sequence
tggcggatgacagggaga

SEQ ID NO: 13643 - DNA, 18 bp, Artificial sequence
  synthetic polynucleotide sequence
gccagcaaagaggagcca

SEQ ID NO: 13644 - DNA, 18 bp, Artificial sequence
  synthetic polynucleotide sequence
gggatgtcccgtacagga

SEQ ID NO: 13645 - DNA, 18 bp, Artificial sequence
  synthetic polynucleotide sequence
tgaagcggagattgagga

SEQ ID NO: 13646 - DNA, 18 bp, Artificial sequence
  synthetic polynucleotide sequence
gcattgccataaccagca

SEQ ID NO: 13647 - DNA, 18 bp, Artificial sequence
  synthetic polynucleotide sequence
cagccagctggacagcaa

SEQ ID NO: 13648 - DNA, 18 bp, Artificial sequence
  synthetic polynucleotide sequence
aggcagcccttcagctca

SEQ ID NO: 13649 - DNA, 18 bp, Artificial sequence
  synthetic polynucleotide sequence
tttcgccacgcccaggca

SEQ ID NO: 13650 - DNA, 18 bp, Artificial sequence
  synthetic polynucleotide sequence
ccagtggagacatcggca

SEQ ID NO: 13651 - DNA, 18 bp, Artificial sequence
  synthetic polynucleotide sequence
tggccggacagcagagca

SEQ ID NO: 13652 - DNA, 18 bp, Artificial sequence
  synthetic polynucleotide sequence
gctcaaagacagcgccca

SEQ ID NO: 13653 - DNA, 18 bp, Artificial sequence
  synthetic polynucleotide sequence
cctcccccgaagacacca

SEQ ID NO: 13654 - DNA, 18 bp, Artificial sequence
  synthetic polynucleotide sequence
ggtcctggagagtgagga

SEQ ID NO: 13655 - DNA, 18 bp, Artificial sequence
  synthetic polynucleotide sequence
aagatggcagatacccca

SEQ ID NO: 13656 - DNA, 18 bp, Artificial sequence
  synthetic polynucleotide sequence
aagatggcagatacccca

SEQ ID NO: 13657 - DNA, 18 bp, Artificial sequence
  synthetic polynucleotide sequence
cgagtaccagctgaccga

SEQ ID NO: 13658 - DNA, 18 bp, Artificial sequence
  synthetic polynucleotide sequence
caatgtccacctggcgca

SEQ ID NO: 13659 - DNA, 18 bp, Artificial sequence
  synthetic polynucleotide sequence
agaccctatccacctgga

SEQ ID NO: 13660 - DNA, 18 bp, Artificial sequence
  synthetic polynucleotide sequence
gcaggagtagggagggca

SEQ ID NO: 13661 - DNA, 18 bp, Artificial sequence
  synthetic polynucleotide sequence
tacgccaaagaagggaga

SEQ ID NO: 13662 - DNA, 18 bp, Artificial sequence
  synthetic polynucleotide sequence
ggagacgtggagattgga

SEQ ID NO: 13663 - DNA, 18 bp, Artificial sequence
  synthetic polynucleotide sequence
ctcagaaccgacgccaga

SEQ ID NO: 13664 - DNA, 18 bp, Artificial sequence
  synthetic polynucleotide sequence
acctccaccaggggcaca

SEQ ID NO: 13665 - DNA, 18 bp, Artificial sequence
  synthetic polynucleotide sequence
tctggcaagcggtggaga

SEQ ID NO: 13666 - DNA, 18 bp, Artificial sequence
  synthetic polynucleotide sequence
tgaagccttggagcggga

SEQ ID NO: 13667 - DNA, 18 bp, Artificial sequence
  synthetic polynucleotide sequence
ggcctgcagcaccttgca

SEQ ID NO: 13668 - DNA, 18 bp, Artificial sequence
  synthetic polynucleotide sequence
gatgaagagcgacgagca

SEQ ID NO: 13669 - DNA, 18 bp, Artificial sequence
  synthetic polynucleotide sequence
gacagtacagttgggcca

SEQ ID NO: 13670 - DNA, 18 bp, Artificial sequence
  synthetic polynucleotide sequence
cgggtggacgtggacaca

SEQ ID NO: 13671 - DNA, 18 bp, Artificial sequence
  synthetic polynucleotide sequence
tgtacaagcagacaccca

SEQ ID NO: 13672 - DNA, 18 bp, Artificial sequence
  synthetic polynucleotide sequence
ccccaaaggcagaagcca

SEQ ID NO: 13673 - DNA, 18 bp, Artificial sequence
  synthetic polynucleotide sequence
gcaggcatccatggcgca

SEQ ID NO: 13674 - DNA, 18 bp, Artificial sequence
  synthetic polynucleotide sequence
gcaggcatccatggcgca

SEQ ID NO: 13675 - DNA, 18 bp, Artificial sequence
  synthetic polynucleotide sequence
cctgtagccccaacacca

SEQ ID NO: 13676 - DNA, 18 bp, Artificial sequence
  synthetic polynucleotide sequence
acaagctggacaggcgca

SEQ ID NO: 13677 - DNA, 18 bp, Artificial sequence
  synthetic polynucleotide sequence
cgaggcagcaactggaga

SEQ ID NO: 13678 - DNA, 18 bp, Artificial sequence
  synthetic polynucleotide sequence
gcgctcccgctgacagca

SEQ ID NO: 13679 - DNA, 18 bp, Artificial sequence
  synthetic polynucleotide sequence
ggcccacctccagaccca

SEQ ID NO: 13680 - DNA, 18 bp, Artificial sequence
  synthetic polynucleotide sequence
acatcctgagcagccgga

SEQ ID NO: 13681 - DNA, 18 bp, Artificial sequence
  synthetic polynucleotide sequence
ggctcatctgcagaccca

SEQ ID NO: 13682 - DNA, 18 bp, Artificial sequence
  synthetic polynucleotide sequence
tgctacacagcagccaga

SEQ ID NO: 13683 - DNA, 18 bp, Artificial sequence
  synthetic polynucleotide sequence
gcacccacacaggggaga

SEQ ID NO: 13684 - DNA, 18 bp, Artificial sequence
  synthetic polynucleotide sequence
ggagggacatgcgggaga

SEQ ID NO: 13685 - DNA, 18 bp, Artificial sequence
  synthetic polynucleotide sequence
ccagggccatgtgacgga

SEQ ID NO: 13686 - DNA, 18 bp, Artificial sequence
  synthetic polynucleotide sequence
cggagtggtggccagcca

SEQ ID NO: 13687 - DNA, 18 bp, Artificial sequence
  synthetic polynucleotide sequence
ggcatgcctgtcccagca

SEQ ID NO: 13688 - DNA, 18 bp, Artificial sequence
  synthetic polynucleotide sequence
cagcaggcgttccaccaa

SEQ ID NO: 13689 - DNA, 18 bp, Artificial sequence
  synthetic polynucleotide sequence
gcctgagactgtccgaga

SEQ ID NO: 13690 - DNA, 18 bp, Artificial sequence
  synthetic polynucleotide sequence
ggctgggacttcagccaa

SEQ ID NO: 13691 - DNA, 18 bp, Artificial sequence
  synthetic polynucleotide sequence
gccactgttgccacacca

SEQ ID NO: 13692 - DNA, 18 bp, Artificial sequence
  synthetic polynucleotide sequence
gccactgttgccacacca

SEQ ID NO: 13693 - DNA, 18 bp, Artificial sequence
  synthetic polynucleotide sequence
caagcagggggtcaccga

SEQ ID NO: 13694 - DNA, 18 bp, Artificial sequence
  synthetic polynucleotide sequence
aagccacaccttgtacca

SEQ ID NO: 13695 - DNA, 18 bp, Artificial sequence
  synthetic polynucleotide sequence
gcgaggctgtggtgagca

SEQ ID NO: 13696 - DNA, 18 bp, Artificial sequence
  synthetic polynucleotide sequence
ccccggaggtgaccgcga

SEQ ID NO: 13697 - DNA, 18 bp, Artificial sequence
  synthetic polynucleotide sequence
tgatgatgcccgcacgga

SEQ ID NO: 13698 - DNA, 18 bp, Artificial sequence
  synthetic polynucleotide sequence
gcacctccaccatgacca

SEQ ID NO: 13699 - DNA, 18 bp, Artificial sequence
  synthetic polynucleotide sequence
ggctaccactgcgagaca

SEQ ID NO: 13700 - DNA, 18 bp, Artificial sequence
  synthetic polynucleotide sequence
taggtgaccgcgtagcca

SEQ ID NO: 13701 - DNA, 18 bp, Artificial sequence
  synthetic polynucleotide sequence
cagaggacgaggagagca

SEQ ID NO: 13702 - DNA, 18 bp, Artificial sequence
  synthetic polynucleotide sequence
tggccgaatactgcacca

SEQ ID NO: 13703 - DNA, 18 bp, Artificial sequence
  synthetic polynucleotide sequence
gggatctggccaggtgca

SEQ ID NO: 13704 - DNA, 18 bp, Artificial sequence
  synthetic polynucleotide sequence
agcccaagagccaggaga

SEQ ID NO: 13705 - DNA, 18 bp, Artificial sequence
  synthetic polynucleotide sequence
tctgtcagacagggcaga

SEQ ID NO: 13706 - DNA, 18 bp, Artificial sequence
  synthetic polynucleotide sequence
cgcggtgcgcgaccggga

SEQ ID NO: 13707 - DNA, 18 bp, Artificial sequence
  synthetic polynucleotide sequence
ggaggccgcattcccgga

SEQ ID NO: 13708 - DNA, 18 bp, Artificial sequence
  synthetic polynucleotide sequence
ccaggcatgatgggccca

SEQ ID NO: 13709 - DNA, 18 bp, Artificial sequence
  synthetic polynucleotide sequence
gggtaatcagggacctga

SEQ ID NO: 13710 - DNA, 18 bp, Artificial sequence
  synthetic polynucleotide sequence
gggtaatcagggacctga

SEQ ID NO: 13711 - DNA, 18 bp, Artificial sequence
  synthetic polynucleotide sequence
ctcagaggcttcagccca

SEQ ID NO: 13712 - DNA, 18 bp, Artificial sequence
  synthetic polynucleotide sequence
gccaaccaaagacagcga

SEQ ID NO: 13713 - DNA, 19 bp, Artificial sequence
  synthetic polynucleotide sequence
gaggtacccaagagtggca

SEQ ID NO: 13714 - DNA, 16 bp, Artificial sequence
  synthetic polynucleotide sequence
ttccgcaggaccacga

SEQ ID NO: 13715 - DNA, 18 bp, Artificial sequence
  synthetic polynucleotide sequence
gacatgctgaagaacgca

SEQ ID NO: 13716 - DNA, 18 bp, Artificial sequence
  synthetic polynucleotide sequence
tcctcggccagcccctga

SEQ ID NO: 13717 - DNA, 18 bp, Artificial sequence
  synthetic polynucleotide sequence
agggtcagaaagtgcaga

SEQ ID NO: 13718 - DNA, 18 bp, Artificial sequence
  synthetic polynucleotide sequence
tcatagagccacacctga

SEQ ID NO: 13719 - DNA, 18 bp, Artificial sequence
  synthetic polynucleotide sequence
gcagacatgtccaaggaa

SEQ ID NO: 13720 - DNA, 18 bp, Artificial sequence
  synthetic polynucleotide sequence
agtcgccatctccacaca

SEQ ID NO: 13721 - DNA, 18 bp, Artificial sequence
  synthetic polynucleotide sequence
aaggacagatccacacca

SEQ ID NO: 13722 - DNA, 18 bp, Artificial sequence
  synthetic polynucleotide sequence
gaagcctggttcagccca

SEQ ID NO: 13723 - DNA, 18 bp, Artificial sequence
  synthetic polynucleotide sequence
ctcagcagcagcatggca

SEQ ID NO: 13724 - DNA, 18 bp, Artificial sequence
  synthetic polynucleotide sequence
caggctctcgacagggca

SEQ ID NO: 13725 - DNA, 18 bp, Artificial sequence
  synthetic polynucleotide sequence
aagaggtgaaggctgcta

SEQ ID NO: 13726 - DNA, 18 bp, Artificial sequence
  synthetic polynucleotide sequence
cgtggatcagcgtcgcca

SEQ ID NO: 13727 - DNA, 18 bp, Artificial sequence
  synthetic polynucleotide sequence
ggaagctgggcatcagga

SEQ ID NO: 13728 - DNA, 18 bp, Artificial sequence
  synthetic polynucleotide sequence
ggaagctgggcatcagga

SEQ ID NO: 13729 - DNA, 18 bp, Artificial sequence
  synthetic polynucleotide sequence
gacagccctgaaagggaa

SEQ ID NO: 13730 - DNA, 18 bp, Artificial sequence
  synthetic polynucleotide sequence
agatcacgggagcagaca

SEQ ID NO: 13731 - DNA, 18 bp, Artificial sequence
  synthetic polynucleotide sequence
gtcccagatgaggcagga

SEQ ID NO: 13732 - DNA, 18 bp, Artificial sequence
  synthetic polynucleotide sequence
acactgaggggatccaga

SEQ ID NO: 13733 - DNA, 18 bp, Artificial sequence
  synthetic polynucleotide sequence
ttgtggagaggcgacgga

SEQ ID NO: 13734 - DNA, 18 bp, Artificial sequence
  synthetic polynucleotide sequence
gtgagatgacagactgca

SEQ ID NO: 13735 - DNA, 18 bp, Artificial sequence
  synthetic polynucleotide sequence
gtcagcgtcagaagagga

SEQ ID NO: 13736 - DNA, 18 bp, Artificial sequence
  synthetic polynucleotide sequence
agggcctctgagagtcca

SEQ ID NO: 13737 - DNA, 18 bp, Artificial sequence
  synthetic polynucleotide sequence
ggcactcacaagggagca

SEQ ID NO: 13738 - DNA, 18 bp, Artificial sequence
  synthetic polynucleotide sequence
gctccaggtacaggcgga

SEQ ID NO: 13739 - DNA, 18 bp, Artificial sequence
  synthetic polynucleotide sequence
gccagtcatggaccacca

SEQ ID NO: 13740 - DNA, 18 bp, Artificial sequence
  synthetic polynucleotide sequence
gccgagagcccttcagca

SEQ ID NO: 13741 - DNA, 18 bp, Artificial sequence
  synthetic polynucleotide sequence
ggacggggttgaggggga

SEQ ID NO: 13742 - DNA, 18 bp, Artificial sequence
  synthetic polynucleotide sequence
cgacagccgccagcggaa

SEQ ID NO: 13743 - DNA, 18 bp, Artificial sequence
  synthetic polynucleotide sequence
ggcagtccccagatggca

SEQ ID NO: 13744 - DNA, 18 bp, Artificial sequence
  synthetic polynucleotide sequence
ctctacacgtcagcacca

SEQ ID NO: 13745 - DNA, 18 bp, Artificial sequence
  synthetic polynucleotide sequence
acggtcttccgacagaga

SEQ ID NO: 13746 - DNA, 18 bp, Artificial sequence
  synthetic polynucleotide sequence
acggtcttccgacagaga

SEQ ID NO: 13747 - DNA, 18 bp, Artificial sequence
  synthetic polynucleotide sequence
ggaccgttatgaagcaga

SEQ ID NO: 13748 - DNA, 18 bp, Artificial sequence
  synthetic polynucleotide sequence
acgggtcatgggcgtcga

SEQ ID NO: 13749 - DNA, 18 bp, Artificial sequence
  synthetic polynucleotide sequence
agagaggcatgttggaga

SEQ ID NO: 13750 - DNA, 18 bp, Artificial sequence
  synthetic polynucleotide sequence
gtgcggccaatgatgcaa

SEQ ID NO: 13751 - DNA, 18 bp, Artificial sequence
  synthetic polynucleotide sequence
gggagttgctggaagcca

SEQ ID NO: 13752 - DNA, 18 bp, Artificial sequence
  synthetic polynucleotide sequence
tcaatccccagcagtgga

SEQ ID NO: 13753 - DNA, 18 bp, Artificial sequence
  synthetic polynucleotide sequence
cgccatccacgtgcacca

SEQ ID NO: 13754 - DNA, 18 bp, Artificial sequence
  synthetic polynucleotide sequence
agaggctgccgtcgcgga

SEQ ID NO: 13755 - DNA, 18 bp, Artificial sequence
  synthetic polynucleotide sequence
cctggccagttcacagga

SEQ ID NO: 13756 - DNA, 18 bp, Artificial sequence
  synthetic polynucleotide sequence
atccaggcttgggcacca

SEQ ID NO: 13757 - DNA, 18 bp, Artificial sequence
  synthetic polynucleotide sequence
ccacgtaggtgatgggga

SEQ ID NO: 13758 - DNA, 18 bp, Artificial sequence
  synthetic polynucleotide sequence
gatcacactgctccggca

SEQ ID NO: 13759 - DNA, 18 bp, Artificial sequence
  synthetic polynucleotide sequence
ctcagtgacagctccaca

SEQ ID NO: 13760 - DNA, 18 bp, Artificial sequence
  synthetic polynucleotide sequence
gcccggagaaatcggaga

SEQ ID NO: 13761 - DNA, 18 bp, Artificial sequence
  synthetic polynucleotide sequence
tgggtcctccgggagaca

SEQ ID NO: 13762 - DNA, 18 bp, Artificial sequence
  synthetic polynucleotide sequence
gccccagaacgaagacga

SEQ ID NO: 13763 - DNA, 18 bp, Artificial sequence
  synthetic polynucleotide sequence
ccctcctccactcaggga

SEQ ID NO: 13764 - DNA, 18 bp, Artificial sequence
  synthetic polynucleotide sequence
ccctcctccactcaggga

SEQ ID NO: 13765 - DNA, 18 bp, Artificial sequence
  synthetic polynucleotide sequence
gcaagccggaagtcacca

SEQ ID NO: 13766 - DNA, 18 bp, Artificial sequence
  synthetic polynucleotide sequence
tctcagagcccagcccca

SEQ ID NO: 13767 - DNA, 18 bp, Artificial sequence
  synthetic polynucleotide sequence
gtgggtcccagatggaga

SEQ ID NO: 13768 - DNA, 18 bp, Artificial sequence
  synthetic polynucleotide sequence
cctgagggcagtcacaca

SEQ ID NO: 13769 - DNA, 18 bp, Artificial sequence
  synthetic polynucleotide sequence
agccgaatgccgtaggca

SEQ ID NO: 13770 - DNA, 18 bp, Artificial sequence
  synthetic polynucleotide sequence
tgcctccagaatccagga

SEQ ID NO: 13771 - DNA, 18 bp, Artificial sequence
  synthetic polynucleotide sequence
cctcctaggcaacccaca

SEQ ID NO: 13772 - DNA, 18 bp, Artificial sequence
  synthetic polynucleotide sequence
aagggagggctttcagga

SEQ ID NO: 13773 - DNA, 18 bp, Artificial sequence
  synthetic polynucleotide sequence
cctgatacccctccacca

SEQ ID NO: 13774 - DNA, 18 bp, Artificial sequence
  synthetic polynucleotide sequence
ggagctggaggatgagca

SEQ ID NO: 13775 - DNA, 18 bp, Artificial sequence
  synthetic polynucleotide sequence
cgggacacagcagctgca

SEQ ID NO: 13776 - DNA, 18 bp, Artificial sequence
  synthetic polynucleotide sequence
cacccgctacgtgaccga

SEQ ID NO: 13777 - DNA, 18 bp, Artificial sequence
  synthetic polynucleotide sequence
acaccgccactcctggga

SEQ ID NO: 13778 - DNA, 18 bp, Artificial sequence
  synthetic polynucleotide sequence
atggccagtgcaccagca

SEQ ID NO: 13779 - DNA, 18 bp, Artificial sequence
  synthetic polynucleotide sequence
gatggaggggaaggctga

SEQ ID NO: 13780 - DNA, 18 bp, Artificial sequence
  synthetic polynucleotide sequence
ctgcccacggtctcacca

SEQ ID NO: 13781 - DNA, 18 bp, Artificial sequence
  synthetic polynucleotide sequence
gttaggggcatgggggca

SEQ ID NO: 13782 - DNA, 18 bp, Artificial sequence
  synthetic polynucleotide sequence
gttaggggcatgggggca

SEQ ID NO: 13783 - DNA, 18 bp, Artificial sequence
  synthetic polynucleotide sequence
gaggtggaccgcacggaa

SEQ ID NO: 13784 - DNA, 18 bp, Artificial sequence
  synthetic polynucleotide sequence
gcagtaatataccgcgga

SEQ ID NO: 13785 - DNA, 18 bp, Artificial sequence
  synthetic polynucleotide sequence
acatgaacggctcgccca

SEQ ID NO: 13786 - DNA, 18 bp, Artificial sequence
  synthetic polynucleotide sequence
ctcggacttgaccaccga

SEQ ID NO: 13787 - DNA, 18 bp, Artificial sequence
  synthetic polynucleotide sequence
gcctgcagtacagcccaa

SEQ ID NO: 13788 - DNA, 18 bp, Artificial sequence
  synthetic polynucleotide sequence
gctgagagtgcgatgcga

SEQ ID NO: 13789 - DNA, 18 bp, Artificial sequence
  synthetic polynucleotide sequence
agcccaggccaaagcgca

SEQ ID NO: 13790 - DNA, 18 bp, Artificial sequence
  synthetic polynucleotide sequence
gcaggtgaggggagggca

SEQ ID NO: 13791 - DNA, 18 bp, Artificial sequence
  synthetic polynucleotide sequence
caagacggagctgcagca

SEQ ID NO: 13792 - DNA, 18 bp, Artificial sequence
  synthetic polynucleotide sequence
cgaactcgtggacgtcga

SEQ ID NO: 13793 - DNA, 18 bp, Artificial sequence
  synthetic polynucleotide sequence
gggatggaagggacccca

SEQ ID NO: 13794 - DNA, 18 bp, Artificial sequence
  synthetic polynucleotide sequence
cgactacaccgaccacca

SEQ ID NO: 13795 - DNA, 18 bp, Artificial sequence
  synthetic polynucleotide sequence
agcgcaagtgtgcccgca

SEQ ID NO: 13796 - DNA, 18 bp, Artificial sequence
  synthetic polynucleotide sequence
ccagatgcccaaccccaa

SEQ ID NO: 13797 - DNA, 18 bp, Artificial sequence
  synthetic polynucleotide sequence
atggaagactcgtggaca

SEQ ID NO: 13798 - DNA, 18 bp, Artificial sequence
  synthetic polynucleotide sequence
gagagctgctgaagcgga

SEQ ID NO: 13799 - DNA, 18 bp, Artificial sequence
  synthetic polynucleotide sequence
ctcggaggcccataagga

SEQ ID NO: 13800 - DNA, 18 bp, Artificial sequence
  synthetic polynucleotide sequence
ctcggaggcccataagga

SEQ ID NO: 13801 - DNA, 18 bp, Artificial sequence
  synthetic polynucleotide sequence
cacttgcgctggcacaca

SEQ ID NO: 13802 - DNA, 18 bp, Artificial sequence
  synthetic polynucleotide sequence
agcgcttggagcagagca

SEQ ID NO: 13803 - DNA, 18 bp, Artificial sequence
  synthetic polynucleotide sequence
gggaaggaggaagagaca

SEQ ID NO: 13804 - DNA, 18 bp, Artificial sequence
  synthetic polynucleotide sequence
cccggaaggcagcttgga

SEQ ID NO: 13805 - DNA, 18 bp, Artificial sequence
  synthetic polynucleotide sequence
acaacgggatcttccaga

SEQ ID NO: 13806 - DNA, 18 bp, Artificial sequence
  synthetic polynucleotide sequence
tccggcacacgttgggga

SEQ ID NO: 13807 - DNA, 18 bp, Artificial sequence
  synthetic polynucleotide sequence
cacgacgggcgtcaagga

SEQ ID NO: 13808 - DNA, 18 bp, Artificial sequence
  synthetic polynucleotide sequence
cgtcatcgccacagtgca

SEQ ID NO: 13809 - DNA, 18 bp, Artificial sequence
  synthetic polynucleotide sequence
gaacggctacaagggcta

SEQ ID NO: 13810 - DNA, 18 bp, Artificial sequence
  synthetic polynucleotide sequence
tccacgaaggcggtgtca

SEQ ID NO: 13811 - DNA, 18 bp, Artificial sequence
  synthetic polynucleotide sequence
aaccacgaactggaggca

SEQ ID NO: 13812 - DNA, 18 bp, Artificial sequence
  synthetic polynucleotide sequence
cagcagcaacagcagcca

SEQ ID NO: 13813 - DNA, 18 bp, Artificial sequence
  synthetic polynucleotide sequence
gcctgtcccagaatggca

SEQ ID NO: 13814 - DNA, 18 bp, Artificial sequence
  synthetic polynucleotide sequence
cccaccttaccaagggga

SEQ ID NO: 13815 - DNA, 18 bp, Artificial sequence
  synthetic polynucleotide sequence
cccatgaccttgaccgga

SEQ ID NO: 13816 - DNA, 18 bp, Artificial sequence
  synthetic polynucleotide sequence
agccaggcaccctaacca

SEQ ID NO: 13817 - DNA, 18 bp, Artificial sequence
  synthetic polynucleotide sequence
ccggcagttggatcacca

SEQ ID NO: 13818 - DNA, 18 bp, Artificial sequence
  synthetic polynucleotide sequence
ccggcagttggatcacca

SEQ ID NO: 13819 - DNA, 18 bp, Artificial sequence
  synthetic polynucleotide sequence
gtgcggagacagagacca

SEQ ID NO: 13820 - DNA, 18 bp, Artificial sequence
  synthetic polynucleotide sequence
cacctcctgagagagcca

SEQ ID NO: 13821 - DNA, 18 bp, Artificial sequence
  synthetic polynucleotide sequence
cttgaagacctggagcaa

SEQ ID NO: 13822 - DNA, 18 bp, Artificial sequence
  synthetic polynucleotide sequence
agtgtggagggtgaagca

SEQ ID NO: 13823 - DNA, 18 bp, Artificial sequence
  synthetic polynucleotide sequence
aagcgcctggaggcagga

SEQ ID NO: 13824 - DNA, 18 bp, Artificial sequence
  synthetic polynucleotide sequence
gctggtccagctggccga

SEQ ID NO: 13825 - DNA, 18 bp, Artificial sequence
  synthetic polynucleotide sequence
ggggaccaaaaaggggca

SEQ ID NO: 13826 - DNA, 18 bp, Artificial sequence
  synthetic polynucleotide sequence
tgggatggtccccagcca

SEQ ID NO: 13827 - DNA, 18 bp, Artificial sequence
  synthetic polynucleotide sequence
gcaaaagccagcagcgga

SEQ ID NO: 13828 - DNA, 18 bp, Artificial sequence
  synthetic polynucleotide sequence
ctgacgagcttgaaggca

SEQ ID NO: 13829 - DNA, 18 bp, Artificial sequence
  synthetic polynucleotide sequence
agtcaacgacaggaggga

SEQ ID NO: 13830 - DNA, 18 bp, Artificial sequence
  synthetic polynucleotide sequence
ctgagaccgttcagcgga

SEQ ID NO: 13831 - DNA, 18 bp, Artificial sequence
  synthetic polynucleotide sequence
ggcctgacggtctccaca

SEQ ID NO: 13832 - DNA, 18 bp, Artificial sequence
  synthetic polynucleotide sequence
cttcacgggccacaagga

SEQ ID NO: 13833 - DNA, 18 bp, Artificial sequence
  synthetic polynucleotide sequence
ttgggtcggcagcagcca

SEQ ID NO: 13834 - DNA, 18 bp, Artificial sequence
  synthetic polynucleotide sequence
cccaagtcccagggctga

SEQ ID NO: 13835 - DNA, 18 bp, Artificial sequence
  synthetic polynucleotide sequence
tgcgaggagtgaatggca

SEQ ID NO: 13836 - DNA, 18 bp, Artificial sequence
  synthetic polynucleotide sequence
tgcgaggagtgaatggca

SEQ ID NO: 13837 - DNA, 18 bp, Artificial sequence
  synthetic polynucleotide sequence
aggctggggaggaggaca

SEQ ID NO: 13838 - DNA, 18 bp, Artificial sequence
  synthetic polynucleotide sequence
agccacgtacacggccga

SEQ ID NO: 13839 - DNA, 18 bp, Artificial sequence
  synthetic polynucleotide sequence
ggttgaaaaggctgcaga

SEQ ID NO: 13840 - DNA, 18 bp, Artificial sequence
  synthetic polynucleotide sequence
gaggggcactatctgaca

SEQ ID NO: 13841 - DNA, 18 bp, Artificial sequence
  synthetic polynucleotide sequence
tacaagggccagaagcta

SEQ ID NO: 13842 - DNA, 18 bp, Artificial sequence
  synthetic polynucleotide sequence
tatagacagtccacccga

SEQ ID NO: 13843 - DNA, 18 bp, Artificial sequence
  synthetic polynucleotide sequence
aggagagctggaccgaca

SEQ ID NO: 13844 - DNA, 18 bp, Artificial sequence
  synthetic polynucleotide sequence
cacctaatgaagcggcca

SEQ ID NO: 13845 - DNA, 18 bp, Artificial sequence
  synthetic polynucleotide sequence
cggtggttccaagcgcaa

SEQ ID NO: 13846 - DNA, 18 bp, Artificial sequence
  synthetic polynucleotide sequence
aggggatgtgggcaggca

SEQ ID NO: 13847 - DNA, 18 bp, Artificial sequence
  synthetic polynucleotide sequence
tgggcagcagatggcaca

SEQ ID NO: 13848 - DNA, 18 bp, Artificial sequence
  synthetic polynucleotide sequence
tatacgctggagcggcga

SEQ ID NO: 13849 - DNA, 18 bp, Artificial sequence
  synthetic polynucleotide sequence
aaggcgaccacgggcaca

SEQ ID NO: 13850 - DNA, 18 bp, Artificial sequence
  synthetic polynucleotide sequence
tgcactcgcacctgggca

SEQ ID NO: 13851 - DNA, 18 bp, Artificial sequence
  synthetic polynucleotide sequence
ccccaccgttgagggaca

SEQ ID NO: 13852 - DNA, 18 bp, Artificial sequence
  synthetic polynucleotide sequence
ctgcacacctaccgcgga

SEQ ID NO: 13853 - DNA, 18 bp, Artificial sequence
  synthetic polynucleotide sequence
gcagagaccggatgagga

SEQ ID NO: 13854 - DNA, 18 bp, Artificial sequence
  synthetic polynucleotide sequence
gcagagaccggatgagga

SEQ ID NO: 13855 - DNA, 19 bp, Artificial sequence
  synthetic polynucleotide sequence
ccgagaacaacttcacgga

SEQ ID NO: 13856 - DNA, 18 bp, Artificial sequence
  synthetic polynucleotide sequence
gagacctggtggccaaga

SEQ ID NO: 13857 - DNA, 18 bp, Artificial sequence
  synthetic polynucleotide sequence
cgaggcagggactcgcaa

SEQ ID NO: 13858 - DNA, 18 bp, Artificial sequence
  synthetic polynucleotide sequence
ctccacccaccacacgca

SEQ ID NO: 13859 - DNA, 18 bp, Artificial sequence
  synthetic polynucleotide sequence
tgactccctgggaagaga

SEQ ID NO: 13860 - DNA, 18 bp, Artificial sequence
  synthetic polynucleotide sequence
gtcccacagacagggtca

SEQ ID NO: 13861 - DNA, 21 bp, Artificial sequence
  synthetic polynucleotide sequence
ctacagactcctggaacagca

SEQ ID NO: 13862 - DNA, 17 bp, Artificial sequence
  synthetic polynucleotide sequence
gtggggaaaggcagcca

SEQ ID NO: 13863 - DNA, 18 bp, Artificial sequence
  synthetic polynucleotide sequence
ggtacaatggaacggtca

SEQ ID NO: 13864 - DNA, 18 bp, Artificial sequence
  synthetic polynucleotide sequence
acacacagaatgcaggga

SEQ ID NO: 13865 - DNA, 18 bp, Artificial sequence
  synthetic polynucleotide sequence
ggacatgtcactgccaca

SEQ ID NO: 13866 - DNA, 18 bp, Artificial sequence
  synthetic polynucleotide sequence
aacgccaaactgctctca

SEQ ID NO: 13867 - DNA, 18 bp, Artificial sequence
  synthetic polynucleotide sequence
tgacagagcatgcaagga

SEQ ID NO: 13868 - DNA, 18 bp, Artificial sequence
  synthetic polynucleotide sequence
agaggaagacagcccaga

SEQ ID NO: 13869 - DNA, 18 bp, Artificial sequence
  synthetic polynucleotide sequence
ctggccatcagagccaca

SEQ ID NO: 13870 - DNA, 18 bp, Artificial sequence
  synthetic polynucleotide sequence
cttcagtcagggaggaca

SEQ ID NO: 13871 - DNA, 18 bp, Artificial sequence
  synthetic polynucleotide sequence
ctcggtacacaagtgaca

SEQ ID NO: 13872 - DNA, 18 bp, Artificial sequence
  synthetic polynucleotide sequence
ctcggtacacaagtgaca

SEQ ID NO: 13873 - DNA, 18 bp, Artificial sequence
  synthetic polynucleotide sequence
ggatctgctcagacgcca

SEQ ID NO: 13874 - DNA, 18 bp, Artificial sequence
  synthetic polynucleotide sequence
aacctggtcactgccaca

SEQ ID NO: 13875 - DNA, 20 bp, Artificial sequence
  synthetic polynucleotide sequence
taccaccaggacaacagaga

SEQ ID NO: 13876 - DNA, 20 bp, Artificial sequence
  synthetic polynucleotide sequence
gatgagtaggcaatgtggca

SEQ ID NO: 13877 - DNA, 18 bp, Artificial sequence
  synthetic polynucleotide sequence
ccccagtgacaaagggca

SEQ ID NO: 13878 - DNA, 18 bp, Artificial sequence
  synthetic polynucleotide sequence
cttggagatgccgcgaca

SEQ ID NO: 13879 - DNA, 18 bp, Artificial sequence
  synthetic polynucleotide sequence
tgaagaccactccagcga

SEQ ID NO: 13880 - DNA, 18 bp, Artificial sequence
  synthetic polynucleotide sequence
accaccacctttgagcca

SEQ ID NO: 13881 - DNA, 18 bp, Artificial sequence
  synthetic polynucleotide sequence
ctccaacgacctccacca

SEQ ID NO: 13882 - DNA, 18 bp, Artificial sequence
  synthetic polynucleotide sequence
cgccacagcaggagcaga

SEQ ID NO: 13883 - DNA, 18 bp, Artificial sequence
  synthetic polynucleotide sequence
aatgccggagcccacaga

SEQ ID NO: 13884 - DNA, 18 bp, Artificial sequence
  synthetic polynucleotide sequence
gtgacaccgggtctagga

SEQ ID NO: 13885 - DNA, 18 bp, Artificial sequence
  synthetic polynucleotide sequence
tcagaagggagaagacca

SEQ ID NO: 13886 - DNA, 18 bp, Artificial sequence
  synthetic polynucleotide sequence
agcggctcctagatgaca

SEQ ID NO: 13887 - DNA, 18 bp, Artificial sequence
  synthetic polynucleotide sequence
ctgaagggtcaagcagga

SEQ ID NO: 13888 - DNA, 18 bp, Artificial sequence
  synthetic polynucleotide sequence
cagctccaacacagccca

SEQ ID NO: 13889 - DNA, 18 bp, Artificial sequence
  synthetic polynucleotide sequence
gtactgcgagatggacga

SEQ ID NO: 13890 - DNA, 18 bp, Artificial sequence
  synthetic polynucleotide sequence
gtactgcgagatggacga

SEQ ID NO: 13891 - DNA, 18 bp, Artificial sequence
  synthetic polynucleotide sequence
cagagacagcaagaccca

SEQ ID NO: 13892 - DNA, 18 bp, Artificial sequence
  synthetic polynucleotide sequence
cactgtccaacactgcca

SEQ ID NO: 13893 - DNA, 18 bp, Artificial sequence
  synthetic polynucleotide sequence
aagggcatgcgaacccga

SEQ ID NO: 13894 - DNA, 18 bp, Artificial sequence
  synthetic polynucleotide sequence
ttccgaccactgggacca

SEQ ID NO: 13895 - DNA, 18 bp, Artificial sequence
  synthetic polynucleotide sequence
tcgggaccaagagcagga

SEQ ID NO: 13896 - DNA, 18 bp, Artificial sequence
  synthetic polynucleotide sequence
gcagttatcagggacgca

SEQ ID NO: 13897 - DNA, 18 bp, Artificial sequence
  synthetic polynucleotide sequence
cgtggagaacgctgcaga

SEQ ID NO: 13898 - DNA, 18 bp, Artificial sequence
  synthetic polynucleotide sequence
tccaagacatccgaagca

SEQ ID NO: 13899 - DNA, 18 bp, Artificial sequence
  synthetic polynucleotide sequence
tggacagccaggactcca

SEQ ID NO: 13900 - DNA, 18 bp, Artificial sequence
  synthetic polynucleotide sequence
tggggacaactggagtga

SEQ ID NO: 13901 - DNA, 18 bp, Artificial sequence
  synthetic polynucleotide sequence
ccctgcacctgctgggca

SEQ ID NO: 13902 - DNA, 18 bp, Artificial sequence
  synthetic polynucleotide sequence
cgggcattcagaagctca

SEQ ID NO: 13903 - DNA, 18 bp, Artificial sequence
  synthetic polynucleotide sequence
ggcagcttccccatggaa

SEQ ID NO: 13904 - DNA, 18 bp, Artificial sequence
  synthetic polynucleotide sequence
caaccaaggactactgca

SEQ ID NO: 13905 - DNA, 18 bp, Artificial sequence
  synthetic polynucleotide sequence
acaccttgcaatccacca

SEQ ID NO: 13906 - DNA, 18 bp, Artificial sequence
  synthetic polynucleotide sequence
cctccgtggacccagaca

SEQ ID NO: 13907 - DNA, 18 bp, Artificial sequence
  synthetic polynucleotide sequence
gtgcttcccgccacagca

SEQ ID NO: 13908 - DNA, 18 bp, Artificial sequence
  synthetic polynucleotide sequence
gtgcttcccgccacagca

SEQ ID NO: 13909 - DNA, 18 bp, Artificial sequence
  synthetic polynucleotide sequence
aagcagccctgccagcca

SEQ ID NO: 13910 - DNA, 18 bp, Artificial sequence
  synthetic polynucleotide sequence
tgggcagggctcagggca

SEQ ID NO: 13911 - DNA, 18 bp, Artificial sequence
  synthetic polynucleotide sequence
ctgagcaaggatacacca

SEQ ID NO: 13912 - DNA, 18 bp, Artificial sequence
  synthetic polynucleotide sequence
ggagtgaccgttgaagga

SEQ ID NO: 13913 - DNA, 18 bp, Artificial sequence
  synthetic polynucleotide sequence
cgcctacaggtgtgagga

SEQ ID NO: 13914 - DNA, 18 bp, Artificial sequence
  synthetic polynucleotide sequence
agagggacatgacaccca

SEQ ID NO: 13915 - DNA, 18 bp, Artificial sequence
  synthetic polynucleotide sequence
gaagggagaagctgagca

SEQ ID NO: 13916 - DNA, 18 bp, Artificial sequence
  synthetic polynucleotide sequence
actaggcccacaagagca

SEQ ID NO: 13917 - DNA, 18 bp, Artificial sequence
  synthetic polynucleotide sequence
ctgaccaggcctcaccaa

SEQ ID NO: 13918 - DNA, 18 bp, Artificial sequence
  synthetic polynucleotide sequence
ctggttgcagacccagca

SEQ ID NO: 13919 - DNA, 18 bp, Artificial sequence
  synthetic polynucleotide sequence
tctccccgcagctcagca

SEQ ID NO: 13920 - DNA, 18 bp, Artificial sequence
  synthetic polynucleotide sequence
ggagcatgagggcaggaa

SEQ ID NO: 13921 - DNA, 18 bp, Artificial sequence
  synthetic polynucleotide sequence
ccttgagggaagccggca

SEQ ID NO: 13922 - DNA, 18 bp, Artificial sequence
  synthetic polynucleotide sequence
gccactgtgagatccgaa

SEQ ID NO: 13923 - DNA, 18 bp, Artificial sequence
  synthetic polynucleotide sequence
aagtcccgctggagagca

SEQ ID NO: 13924 - DNA, 18 bp, Artificial sequence
  synthetic polynucleotide sequence
ggctctcagaggcagaga

SEQ ID NO: 13925 - DNA, 18 bp, Artificial sequence
  synthetic polynucleotide sequence
agcagacttccacgggga

SEQ ID NO: 13926 - DNA, 18 bp, Artificial sequence
  synthetic polynucleotide sequence
agcagacttccacgggga

SEQ ID NO: 13927 - DNA, 18 bp, Artificial sequence
  synthetic polynucleotide sequence
tccagctcaagcgggaga

SEQ ID NO: 13928 - DNA, 18 bp, Artificial sequence
  synthetic polynucleotide sequence
cggaacttgtcccgcaga

SEQ ID NO: 13929 - DNA, 18 bp, Artificial sequence
  synthetic polynucleotide sequence
ggaagggaagagcaccga

SEQ ID NO: 13930 - DNA, 18 bp, Artificial sequence
  synthetic polynucleotide sequence
cgttcaagggctccagca

SEQ ID NO: 13931 - DNA, 18 bp, Artificial sequence
  synthetic polynucleotide sequence
ggttgcacggtcgacgaa

SEQ ID NO: 13932 - DNA, 18 bp, Artificial sequence
  synthetic polynucleotide sequence
gcttctccagcgcacaga

SEQ ID NO: 13933 - DNA, 18 bp, Artificial sequence
  synthetic polynucleotide sequence
ggatggatggcatcgcca

SEQ ID NO: 13934 - DNA, 18 bp, Artificial sequence
  synthetic polynucleotide sequence
aggtggtcagctcaggca

SEQ ID NO: 13935 - DNA, 18 bp, Artificial sequence
  synthetic polynucleotide sequence
agcagctcgaggccagga

SEQ ID NO: 13936 - DNA, 18 bp, Artificial sequence
  synthetic polynucleotide sequence
gcagagccaagcacgcca

SEQ ID NO: 13937 - DNA, 18 bp, Artificial sequence
  synthetic polynucleotide sequence
tccacatccacccaacca

SEQ ID NO: 13938 - DNA, 18 bp, Artificial sequence
  synthetic polynucleotide sequence
gatcatccaggagcggaa

SEQ ID NO: 13939 - DNA, 18 bp, Artificial sequence
  synthetic polynucleotide sequence
caggagcctggtgagcca

SEQ ID NO: 13940 - DNA, 18 bp, Artificial sequence
  synthetic polynucleotide sequence
tacccacatctcccgcca

SEQ ID NO: 13941 - DNA, 18 bp, Artificial sequence
  synthetic polynucleotide sequence
agctggcggcacaggaca

SEQ ID NO: 13942 - DNA, 18 bp, Artificial sequence
  synthetic polynucleotide sequence
gtcaatggagcccaccga

SEQ ID NO: 13943 - DNA, 18 bp, Artificial sequence
  synthetic polynucleotide sequence
caacatgcccgttaacca

SEQ ID NO: 13944 - DNA, 18 bp, Artificial sequence
  synthetic polynucleotide sequence
caacatgcccgttaacca

SEQ ID NO: 13945 - DNA, 18 bp, Artificial sequence
  synthetic polynucleotide sequence
gctcaggaagcctggaga

SEQ ID NO: 13946 - DNA, 18 bp, Artificial sequence
  synthetic polynucleotide sequence
agctcgcagcccaaggaa

SEQ ID NO: 13947 - DNA, 18 bp, Artificial sequence
  synthetic polynucleotide sequence
cagggaggggagctggca

SEQ ID NO: 13948 - DNA, 18 bp, Artificial sequence
  synthetic polynucleotide sequence
ctcagcacagttaggcca

SEQ ID NO: 13949 - DNA, 18 bp, Artificial sequence
  synthetic polynucleotide sequence
ggtcagctgatggggaca

SEQ ID NO: 13950 - DNA, 18 bp, Artificial sequence
  synthetic polynucleotide sequence
agctgtcagagaggccca

SEQ ID NO: 13951 - DNA, 18 bp, Artificial sequence
  synthetic polynucleotide sequence
gtggccacctatggagca

SEQ ID NO: 13952 - DNA, 18 bp, Artificial sequence
  synthetic polynucleotide sequence
gcaggtcacaggtgagca

SEQ ID NO: 13953 - DNA, 18 bp, Artificial sequence
  synthetic polynucleotide sequence
cagagagagagaacggga

SEQ ID NO: 13954 - DNA, 18 bp, Artificial sequence
  synthetic polynucleotide sequence
cctgctggaactacgaga

SEQ ID NO: 13955 - DNA, 18 bp, Artificial sequence
  synthetic polynucleotide sequence
tcaggaacacctggggga

SEQ ID NO: 13956 - DNA, 18 bp, Artificial sequence
  synthetic polynucleotide sequence
gatgtaccctagcccgca

SEQ ID NO: 13957 - DNA, 18 bp, Artificial sequence
  synthetic polynucleotide sequence
gcttcagctgcacgccca

SEQ ID NO: 13958 - DNA, 18 bp, Artificial sequence
  synthetic polynucleotide sequence
cctgccacttccacggaa

SEQ ID NO: 13959 - DNA, 18 bp, Artificial sequence
  synthetic polynucleotide sequence
tgggcacagagctgggaa

SEQ ID NO: 13960 - DNA, 18 bp, Artificial sequence
  synthetic polynucleotide sequence
agcagcgcctcatggaga

SEQ ID NO: 13961 - DNA, 18 bp, Artificial sequence
  synthetic polynucleotide sequence
gcatgagggtaggcccga

SEQ ID NO: 13962 - DNA, 18 bp, Artificial sequence
  synthetic polynucleotide sequence
gcatgagggtaggcccga

SEQ ID NO: 13963 - DNA, 18 bp, Artificial sequence
  synthetic polynucleotide sequence
atcctacgcggagagcca

SEQ ID NO: 13964 - DNA, 18 bp, Artificial sequence
  synthetic polynucleotide sequence
agccggagccggagccga

SEQ ID NO: 13965 - DNA, 18 bp, Artificial sequence
  synthetic polynucleotide sequence
gcagagatgtctgacaca

SEQ ID NO: 13966 - DNA, 18 bp, Artificial sequence
  synthetic polynucleotide sequence
gccattcagtacagccca

SEQ ID NO: 13967 - DNA, 18 bp, Artificial sequence
  synthetic polynucleotide sequence
aggggcgtgaatcccaga

SEQ ID NO: 13968 - DNA, 18 bp, Artificial sequence
  synthetic polynucleotide sequence
cattgatgagaggggcca

SEQ ID NO: 13969 - DNA, 18 bp, Artificial sequence
  synthetic polynucleotide sequence
ctgactcctcagacccca

SEQ ID NO: 13970 - DNA, 18 bp, Artificial sequence
  synthetic polynucleotide sequence
cataggccaccacgggga

SEQ ID NO: 13971 - DNA, 18 bp, Artificial sequence
  synthetic polynucleotide sequence
agggaaggcgaatcccca

SEQ ID NO: 13972 - DNA, 18 bp, Artificial sequence
  synthetic polynucleotide sequence
acaaggcagaggctccca

SEQ ID NO: 13973 - DNA, 18 bp, Artificial sequence
  synthetic polynucleotide sequence
gctggggagcagtactga

SEQ ID NO: 13974 - DNA, 18 bp, Artificial sequence
  synthetic polynucleotide sequence
ggctgcagaagcaacaga

SEQ ID NO: 13975 - DNA, 18 bp, Artificial sequence
  synthetic polynucleotide sequence
ctgccgtgtccaccagca

SEQ ID NO: 13976 - DNA, 18 bp, Artificial sequence
  synthetic polynucleotide sequence
agcatggtggccgcacca

SEQ ID NO: 13977 - DNA, 18 bp, Artificial sequence
  synthetic polynucleotide sequence
tggcactgcactccagga

SEQ ID NO: 13978 - DNA, 18 bp, Artificial sequence
  synthetic polynucleotide sequence
cactggacagttccagca

SEQ ID NO: 13979 - DNA, 18 bp, Artificial sequence
  synthetic polynucleotide sequence
gccgttctgacacccaca

SEQ ID NO: 13980 - DNA, 18 bp, Artificial sequence
  synthetic polynucleotide sequence
gccgttctgacacccaca

SEQ ID NO: 13981 - DNA, 18 bp, Artificial sequence
  synthetic polynucleotide sequence
ctgtcagtccagccgcca

SEQ ID NO: 13982 - DNA, 18 bp, Artificial sequence
  synthetic polynucleotide sequence
cggttggaaggatcagga

SEQ ID NO: 13983 - DNA, 18 bp, Artificial sequence
  synthetic polynucleotide sequence
ccacccgttcgaagagga

SEQ ID NO: 13984 - DNA, 18 bp, Artificial sequence
  synthetic polynucleotide sequence
tggctcaggagacccgga

SEQ ID NO: 13985 - DNA, 18 bp, Artificial sequence
  synthetic polynucleotide sequence
ggccgtggaacaggccga

SEQ ID NO: 13986 - DNA, 18 bp, Artificial sequence
  synthetic polynucleotide sequence
ccacttggaggcagtcca

SEQ ID NO: 13987 - DNA, 18 bp, Artificial sequence
  synthetic polynucleotide sequence
agcagttgtggcacagca

SEQ ID NO: 13988 - DNA, 18 bp, Artificial sequence
  synthetic polynucleotide sequence
ccaggaagcccaagtgca

SEQ ID NO: 13989 - DNA, 18 bp, Artificial sequence
  synthetic polynucleotide sequence
atccgcacgaaggtccaa

SEQ ID NO: 13990 - DNA, 18 bp, Artificial sequence
  synthetic polynucleotide sequence
cctggaccgagaccggga

SEQ ID NO: 13991 - DNA, 18 bp, Artificial sequence
  synthetic polynucleotide sequence
tctctcccgagacagcga

SEQ ID NO: 13992 - DNA, 18 bp, Artificial sequence
  synthetic polynucleotide sequence
cctccacctcgtcgcaga

SEQ ID NO: 13993 - DNA, 18 bp, Artificial sequence
  synthetic polynucleotide sequence
tggaacaggtagcggcga

SEQ ID NO: 13994 - DNA, 18 bp, Artificial sequence
  synthetic polynucleotide sequence
agcaggtctcggtcccga

SEQ ID NO: 13995 - DNA, 18 bp, Artificial sequence
  synthetic polynucleotide sequence
cctgctgcgtgagcgaga

SEQ ID NO: 13996 - DNA, 18 bp, Artificial sequence
  synthetic polynucleotide sequence
gtgtggcgaaaagggaca

SEQ ID NO: 13997 - DNA, 18 bp, Artificial sequence
  synthetic polynucleotide sequence
tagcggtggcagccccca

SEQ ID NO: 13998 - DNA, 18 bp, Artificial sequence
  synthetic polynucleotide sequence
tagcggtggcagccccca

SEQ ID NO: 13999 - DNA, 18 bp, Artificial sequence
  synthetic polynucleotide sequence
gcagcagtacccagggca

SEQ ID NO: 14000 - DNA, 18 bp, Artificial sequence
  synthetic polynucleotide sequence
acctggaccaccctgtga

SEQ ID NO: 14001 - DNA, 18 bp, Artificial sequence
  synthetic polynucleotide sequence
ccagcagtactaccccga

SEQ ID NO: 14002 - DNA, 18 bp, Artificial sequence
  synthetic polynucleotide sequence
cgtggactcctcgaagga

SEQ ID NO: 14003 - DNA, 18 bp, Artificial sequence
  synthetic polynucleotide sequence
gcgatcaggggatagtga

SEQ ID NO: 14004 - DNA, 18 bp, Artificial sequence
  synthetic polynucleotide sequence
ctctgaggcctggccgga

SEQ ID NO: 14005 - DNA, 18 bp, Artificial sequence
  synthetic polynucleotide sequence
gccacaagcatggaccca

SEQ ID NO: 14006 - DNA, 18 bp, Artificial sequence
  synthetic polynucleotide sequence
agggggtcaggggacaca

SEQ ID NO: 14007 - DNA, 18 bp, Artificial sequence
  synthetic polynucleotide sequence
gcagggctcaccaaacca

SEQ ID NO: 14008 - DNA, 18 bp, Artificial sequence
  synthetic polynucleotide sequence
ggggattcacaggaggca

SEQ ID NO: 14009 - DNA, 18 bp, Artificial sequence
  synthetic polynucleotide sequence
agatctgcagctggcgca

SEQ ID NO: 14010 - DNA, 18 bp, Artificial sequence
  synthetic polynucleotide sequence
ctgcaagagcacagggca

SEQ ID NO: 14011 - DNA, 18 bp, Artificial sequence
  synthetic polynucleotide sequence
agcaggccaacaagcaca

SEQ ID NO: 14012 - DNA, 18 bp, Artificial sequence
  synthetic polynucleotide sequence
cggagccgctcagcagga

SEQ ID NO: 14013 - DNA, 18 bp, Artificial sequence
  synthetic polynucleotide sequence
aggagttgatgaaggcca

SEQ ID NO: 14014 - DNA, 18 bp, Artificial sequence
  synthetic polynucleotide sequence
cccatgggcggacgacca

SEQ ID NO: 14015 - DNA, 18 bp, Artificial sequence
  synthetic polynucleotide sequence
cgatggagggaagggtca

SEQ ID NO: 14016 - DNA, 18 bp, Artificial sequence
  synthetic polynucleotide sequence
cgatggagggaagggtca

SEQ ID NO: 14017 - DNA, 18 bp, Artificial sequence
  synthetic polynucleotide sequence
aggcagctccaaacagca

SEQ ID NO: 14018 - DNA, 18 bp, Artificial sequence
  synthetic polynucleotide sequence
cgcggaggacttggccga

SEQ ID NO: 14019 - DNA, 18 bp, Artificial sequence
  synthetic polynucleotide sequence
ccgggaggagaatgccaa

SEQ ID NO: 14020 - DNA, 18 bp, Artificial sequence
  synthetic polynucleotide sequence
actggaggagctggcaga

SEQ ID NO: 14021 - DNA, 18 bp, Artificial sequence
  synthetic polynucleotide sequence
acagctgcgccaacccca

SEQ ID NO: 14022 - DNA, 18 bp, Artificial sequence
  synthetic polynucleotide sequence
gtccatccagctgaggca

SEQ ID NO: 14023 - DNA, 18 bp, Artificial sequence
  synthetic polynucleotide sequence
ccccagcccttaaaggca

SEQ ID NO: 14024 - DNA, 18 bp, Artificial sequence
  synthetic polynucleotide sequence
gctcaccttgaccaagca

SEQ ID NO: 14025 - DNA, 18 bp, Artificial sequence
  synthetic polynucleotide sequence
tgatgccaccgtcaacca

SEQ ID NO: 14026 - DNA, 18 bp, Artificial sequence
  synthetic polynucleotide sequence
cagcagcgcaggcagaga

SEQ ID NO: 14027 - DNA, 18 bp, Artificial sequence
  synthetic polynucleotide sequence
agcgtccttggcaccaga

SEQ ID NO: 14028 - DNA, 18 bp, Artificial sequence
  synthetic polynucleotide sequence
cgccaacagctgtgccaa

SEQ ID NO: 14029 - DNA, 18 bp, Artificial sequence
  synthetic polynucleotide sequence
gaccagccagttgggaga

SEQ ID NO: 14030 - DNA, 18 bp, Artificial sequence
  synthetic polynucleotide sequence
gtgtgacgggaaggagga

SEQ ID NO: 14031 - DNA, 18 bp, Artificial sequence
  synthetic polynucleotide sequence
agtccacctcatcgcaga

SEQ ID NO: 14032 - DNA, 18 bp, Artificial sequence
  synthetic polynucleotide sequence
caactggctgcaagggca

SEQ ID NO: 14033 - DNA, 18 bp, Artificial sequence
  synthetic polynucleotide sequence
cacagaggtggagggcca

SEQ ID NO: 14034 - DNA, 18 bp, Artificial sequence
  synthetic polynucleotide sequence
cacagaggtggagggcca

SEQ ID NO: 14035 - DNA, 18 bp, Artificial sequence
  synthetic polynucleotide sequence
agtgcaccagttgaggga

SEQ ID NO: 14036 - DNA, 18 bp, Artificial sequence
  synthetic polynucleotide sequence
gtcgtacccagaatggca

SEQ ID NO: 14037 - DNA, 20 bp, Artificial sequence
  synthetic polynucleotide sequence
ctactatgggaatgccacca

SEQ ID NO: 14038 - DNA, 18 bp, Artificial sequence
  synthetic polynucleotide sequence
tcaccaggcagcaacaga

SEQ ID NO: 14039 - DNA, 18 bp, Artificial sequence
  synthetic polynucleotide sequence
gatgcgagaggcagagga

SEQ ID NO: 14040 - DNA, 18 bp, Artificial sequence
  synthetic polynucleotide sequence
aagcgcctgcagtagcca

SEQ ID NO: 14041 - DNA, 18 bp, Artificial sequence
  synthetic polynucleotide sequence
cctcccatccaagcgcaa

SEQ ID NO: 14042 - DNA, 18 bp, Artificial sequence
  synthetic polynucleotide sequence
atagagcagcgggtggta

SEQ ID NO: 14043 - DNA, 18 bp, Artificial sequence
  synthetic polynucleotide sequence
tcccatccgtgcggcaga

SEQ ID NO: 14044 - DNA, 18 bp, Artificial sequence
  synthetic polynucleotide sequence
tcaggcgctgcaccagga

SEQ ID NO: 14045 - DNA, 18 bp, Artificial sequence
  synthetic polynucleotide sequence
gcatcacatagtcgcgga

SEQ ID NO: 14046 - DNA, 18 bp, Artificial sequence
  synthetic polynucleotide sequence
caaaggcttcgagcgcga

SEQ ID NO: 14047 - DNA, 18 bp, Artificial sequence
  synthetic polynucleotide sequence
ccgtagacgtgaatgcca

SEQ ID NO: 14048 - DNA, 18 bp, Artificial sequence
  synthetic polynucleotide sequence
tgggaaggacagagtcca

SEQ ID NO: 14049 - DNA, 18 bp, Artificial sequence
  synthetic polynucleotide sequence
acggatgggcgaacacga

SEQ ID NO: 14050 - DNA, 18 bp, Artificial sequence
  synthetic polynucleotide sequence
gtacctggcacacgagca

SEQ ID NO: 14051 - DNA, 18 bp, Artificial sequence
  synthetic polynucleotide sequence
cacacaactccaccgcga

SEQ ID NO: 14052 - DNA, 18 bp, Artificial sequence
  synthetic polynucleotide sequence
cacacaactccaccgcga

SEQ ID NO: 14053 - DNA, 18 bp, Artificial sequence
  synthetic polynucleotide sequence
aagacaggaacagagcca

SEQ ID NO: 14054 - DNA, 18 bp, Artificial sequence
  synthetic polynucleotide sequence
ggcatggcatggaagcca

SEQ ID NO: 14055 - DNA, 18 bp, Artificial sequence
  synthetic polynucleotide sequence
tgctgcaacggctgcaca

SEQ ID NO: 14056 - DNA, 18 bp, Artificial sequence
  synthetic polynucleotide sequence
cgcgaacggcgtgcagca

SEQ ID NO: 14057 - DNA, 18 bp, Artificial sequence
  synthetic polynucleotide sequence
accaggagacgcaactca

SEQ ID NO: 14058 - DNA, 18 bp, Artificial sequence
  synthetic polynucleotide sequence
gaagagccagcctttcga

SEQ ID NO: 14059 - DNA, 18 bp, Artificial sequence
  synthetic polynucleotide sequence
ggaggacattgcaaccta

SEQ ID NO: 14060 - DNA, 18 bp, Artificial sequence
  synthetic polynucleotide sequence
gccggtggacaagcggta

SEQ ID NO: 14061 - DNA, 18 bp, Artificial sequence
  synthetic polynucleotide sequence
ggcctatggcatcgacca

SEQ ID NO: 14062 - DNA, 18 bp, Artificial sequence
  synthetic polynucleotide sequence
ctgtgacccctcaggaca

SEQ ID NO: 14063 - DNA, 18 bp, Artificial sequence
  synthetic polynucleotide sequence
ccccttcccactggagga

SEQ ID NO: 14064 - DNA, 18 bp, Artificial sequence
  synthetic polynucleotide sequence
gggaagaaacagcccgaa

SEQ ID NO: 14065 - DNA, 18 bp, Artificial sequence
  synthetic polynucleotide sequence
agacatcagtggaagcca

SEQ ID NO: 14066 - DNA, 18 bp, Artificial sequence
  synthetic polynucleotide sequence
caaggggagagccatcca

SEQ ID NO: 14067 - DNA, 18 bp, Artificial sequence
  synthetic polynucleotide sequence
ggctgattggaggagcca

SEQ ID NO: 14068 - DNA, 18 bp, Artificial sequence
  synthetic polynucleotide sequence
gctgctgagcctcaagca

SEQ ID NO: 14069 - DNA, 18 bp, Artificial sequence
  synthetic polynucleotide sequence
acatcggcagttgcagca

SEQ ID NO: 14070 - DNA, 18 bp, Artificial sequence
  synthetic polynucleotide sequence
acatcggcagttgcagca

SEQ ID NO: 14071 - DNA, 18 bp, Artificial sequence
  synthetic polynucleotide sequence
gcacattacccacctgca

SEQ ID NO: 14072 - DNA, 18 bp, Artificial sequence
  synthetic polynucleotide sequence
ggcagagatctcagtgga

SEQ ID NO: 14073 - DNA, 18 bp, Artificial sequence
  synthetic polynucleotide sequence
ccggaaagaggcaactga

SEQ ID NO: 14074 - DNA, 18 bp, Artificial sequence
  synthetic polynucleotide sequence
cactaccaggcctcagga

SEQ ID NO: 14075 - DNA, 18 bp, Artificial sequence
  synthetic polynucleotide sequence
tcctggctcccaaggcca

SEQ ID NO: 14076 - DNA, 18 bp, Artificial sequence
  synthetic polynucleotide sequence
acagctccgacagcgcca

SEQ ID NO: 14077 - DNA, 18 bp, Artificial sequence
  synthetic polynucleotide sequence
cccacatcagcagccaga

SEQ ID NO: 14078 - DNA, 18 bp, Artificial sequence
  synthetic polynucleotide sequence
acccacctgatcgaggca

SEQ ID NO: 14079 - DNA, 18 bp, Artificial sequence
  synthetic polynucleotide sequence
cgtggtctccccaaggga

SEQ ID NO: 14080 - DNA, 18 bp, Artificial sequence
  synthetic polynucleotide sequence
tggccgacttgagcacga

SEQ ID NO: 14081 - DNA, 20 bp, Artificial sequence
  synthetic polynucleotide sequence
caggccatgtagctgagaga

SEQ ID NO: 14082 - DNA, 19 bp, Artificial sequence
  synthetic polynucleotide sequence
gatacagccatggcaagca

SEQ ID NO: 14083 - DNA, 18 bp, Artificial sequence
  synthetic polynucleotide sequence
gactctggcacactcgga

SEQ ID NO: 14084 - DNA, 18 bp, Artificial sequence
  synthetic polynucleotide sequence
ggaggtgattgagaggga

SEQ ID NO: 14085 - DNA, 18 bp, Artificial sequence
  synthetic polynucleotide sequence
gcatcagggcttccagca

SEQ ID NO: 14086 - DNA, 18 bp, Artificial sequence
  synthetic polynucleotide sequence
ctggcttgcaggaaggca

SEQ ID NO: 14087 - DNA, 18 bp, Artificial sequence
  synthetic polynucleotide sequence
acagagcccactatccga

SEQ ID NO: 14088 - DNA, 18 bp, Artificial sequence
  synthetic polynucleotide sequence
acagagcccactatccga

SEQ ID NO: 14089 - DNA, 18 bp, Artificial sequence
  synthetic polynucleotide sequence
gccagtgccagagccaga

SEQ ID NO: 14090 - DNA, 18 bp, Artificial sequence
  synthetic polynucleotide sequence
gccaacagtgggtcacca

SEQ ID NO: 14091 - DNA, 18 bp, Artificial sequence
  synthetic polynucleotide sequence
ccaagcgaggactgagca

SEQ ID NO: 14092 - DNA, 18 bp, Artificial sequence
  synthetic polynucleotide sequence
cagccagacccagaagga

SEQ ID NO: 14093 - DNA, 18 bp, Artificial sequence
  synthetic polynucleotide sequence
ggctcgaccagcttcaga

SEQ ID NO: 14094 - DNA, 18 bp, Artificial sequence
  synthetic polynucleotide sequence
agtaccaacggcctctga

SEQ ID NO: 14095 - DNA, 19 bp, Artificial sequence
  synthetic polynucleotide sequence
agtccgtgacagaggagaa

SEQ ID NO: 14096 - DNA, 18 bp, Artificial sequence
  synthetic polynucleotide sequence
gcattgtcccacagcaca

SEQ ID NO: 14097 - DNA, 18 bp, Artificial sequence
  synthetic polynucleotide sequence
ggccgaagtgcagagcaa

SEQ ID NO: 14098 - DNA, 18 bp, Artificial sequence
  synthetic polynucleotide sequence
gttgaactgggaccagga

SEQ ID NO: 14099 - DNA, 18 bp, Artificial sequence
  synthetic polynucleotide sequence
tggaggaatcaggggcca

SEQ ID NO: 14100 - DNA, 18 bp, Artificial sequence
  synthetic polynucleotide sequence
gaccgtggaaagggacca

SEQ ID NO: 14101 - DNA, 18 bp, Artificial sequence
  synthetic polynucleotide sequence
ggccatacccataaccga

SEQ ID NO: 14102 - DNA, 21 bp, Artificial sequence
  synthetic polynucleotide sequence
gagtaaaagagaacccagcca

SEQ ID NO: 14103 - DNA, 18 bp, Artificial sequence
  synthetic polynucleotide sequence
ggtccaactcagacagca

SEQ ID NO: 14104 - DNA, 18 bp, Artificial sequence
  synthetic polynucleotide sequence
gccacctctgatcagcca

SEQ ID NO: 14105 - DNA, 18 bp, Artificial sequence
  synthetic polynucleotide sequence
ggagccttaagactgcca

SEQ ID NO: 14106 - DNA, 18 bp, Artificial sequence
  synthetic polynucleotide sequence
ggagccttaagactgcca

SEQ ID NO: 14107 - DNA, 18 bp, Artificial sequence
  synthetic polynucleotide sequence
agcggaaccctgaagcca

SEQ ID NO: 14108 - DNA, 18 bp, Artificial sequence
  synthetic polynucleotide sequence
tccagcaggcttcggaca

SEQ ID NO: 14109 - DNA, 18 bp, Artificial sequence
  synthetic polynucleotide sequence
aggaggtgaaggaggcca

SEQ ID NO: 14110 - DNA, 18 bp, Artificial sequence
  synthetic polynucleotide sequence
ccgaggtgcagaagctca

SEQ ID NO: 14111 - DNA, 18 bp, Artificial sequence
  synthetic polynucleotide sequence
gccctcgtgctgagcaca

SEQ ID NO: 14112 - DNA, 18 bp, Artificial sequence
  synthetic polynucleotide sequence
tgcggctgatgcagggca

SEQ ID NO: 14113 - DNA, 18 bp, Artificial sequence
  synthetic polynucleotide sequence
ggcacaaaataccgtcga

SEQ ID NO: 14114 - DNA, 18 bp, Artificial sequence
  synthetic polynucleotide sequence
atcactgagccaggctga

SEQ ID NO: 14115 - DNA, 18 bp, Artificial sequence
  synthetic polynucleotide sequence
tgaagaggaacctcccga

SEQ ID NO: 14116 - DNA, 18 bp, Artificial sequence
  synthetic polynucleotide sequence
ggtccccacagattcaca

SEQ ID NO: 14117 - DNA, 18 bp, Artificial sequence
  synthetic polynucleotide sequence
caatcagacccacatcca

SEQ ID NO: 14118 - DNA, 18 bp, Artificial sequence
  synthetic polynucleotide sequence
ccccaggcactcagcgaa

SEQ ID NO: 14119 - DNA, 18 bp, Artificial sequence
  synthetic polynucleotide sequence
gagggtgaccccagccga

SEQ ID NO: 14120 - DNA, 18 bp, Artificial sequence
  synthetic polynucleotide sequence
acgacacctgccggacca

SEQ ID NO: 14121 - DNA, 18 bp, Artificial sequence
  synthetic polynucleotide sequence
ccaagccgcaccacgaca

SEQ ID NO: 14122 - DNA, 18 bp, Artificial sequence
  synthetic polynucleotide sequence
agtcctcaccgtccgaga

SEQ ID NO: 14123 - DNA, 18 bp, Artificial sequence
  synthetic polynucleotide sequence
tccagctcctccagcgca

SEQ ID NO: 14124 - DNA, 18 bp, Artificial sequence
  synthetic polynucleotide sequence
tccagctcctccagcgca

SEQ ID NO: 14125 - DNA, 18 bp, Artificial sequence
  synthetic polynucleotide sequence
gagagcagccacctacca

SEQ ID NO: 14126 - DNA, 18 bp, Artificial sequence
  synthetic polynucleotide sequence
ggaccatcagataagcca

SEQ ID NO: 14127 - DNA, 18 bp, Artificial sequence
  synthetic polynucleotide sequence
cacagttgggacaccaga

SEQ ID NO: 14128 - DNA, 18 bp, Artificial sequence
  synthetic polynucleotide sequence
aagaccaccagtcacaca

SEQ ID NO: 14129 - DNA, 18 bp, Artificial sequence
  synthetic polynucleotide sequence
aaggcccacagcagcaga

SEQ ID NO: 14130 - DNA, 18 bp, Artificial sequence
  synthetic polynucleotide sequence
aggtgaccacttgaccca

SEQ ID NO: 14131 - DNA, 18 bp, Artificial sequence
  synthetic polynucleotide sequence
ggaatcagacctccagga

SEQ ID NO: 14132 - DNA, 18 bp, Artificial sequence
  synthetic polynucleotide sequence
gatacagaaccagcccca

SEQ ID NO: 14133 - DNA, 18 bp, Artificial sequence
  synthetic polynucleotide sequence
agcagaagcgtcccgcga

SEQ ID NO: 14134 - DNA, 18 bp, Artificial sequence
  synthetic polynucleotide sequence
cggagctgaagggctgca

SEQ ID NO: 14135 - DNA, 18 bp, Artificial sequence
  synthetic polynucleotide sequence
acatactgctcggccaca

SEQ ID NO: 14136 - DNA, 18 bp, Artificial sequence
  synthetic polynucleotide sequence
aggcagcaggagaggcca

SEQ ID NO: 14137 - DNA, 18 bp, Artificial sequence
  synthetic polynucleotide sequence
cgccaactgggtaatcca

SEQ ID NO: 14138 - DNA, 18 bp, Artificial sequence
  synthetic polynucleotide sequence
gaccaaacagactccgca

SEQ ID NO: 14139 - DNA, 18 bp, Artificial sequence
  synthetic polynucleotide sequence
gtgtcaccagtgagcgca

SEQ ID NO: 14140 - DNA, 18 bp, Artificial sequence
  synthetic polynucleotide sequence
ctccgaggacaagcagga

SEQ ID NO: 14141 - DNA, 18 bp, Artificial sequence
  synthetic polynucleotide sequence
agagctgaagacccagca

SEQ ID NO: 14142 - DNA, 18 bp, Artificial sequence
  synthetic polynucleotide sequence
agagctgaagacccagca

SEQ ID NO: 14143 - DNA, 18 bp, Artificial sequence
  synthetic polynucleotide sequence
gcagccatgggcaaagca

SEQ ID NO: 14144 - DNA, 18 bp, Artificial sequence
  synthetic polynucleotide sequence
tggctcacatgccgacca

SEQ ID NO: 14145 - DNA, 18 bp, Artificial sequence
  synthetic polynucleotide sequence
gaaaacagccccagccaa

SEQ ID NO: 14146 - DNA, 18 bp, Artificial sequence
  synthetic polynucleotide sequence
agtccatcagtaccacca

SEQ ID NO: 14147 - DNA, 18 bp, Artificial sequence
  synthetic polynucleotide sequence
ccttgcctgaggacagga

SEQ ID NO: 14148 - DNA, 18 bp, Artificial sequence
  synthetic polynucleotide sequence
tctgagggtgccagcgca

SEQ ID NO: 14149 - DNA, 18 bp, Artificial sequence
  synthetic polynucleotide sequence
tggagaagcaggccgaca

SEQ ID NO: 14150 - DNA, 18 bp, Artificial sequence
  synthetic polynucleotide sequence
gcagggacagcagaagca

SEQ ID NO: 14151 - DNA, 18 bp, Artificial sequence
  synthetic polynucleotide sequence
tgatgagccagctaggaa

SEQ ID NO: 14152 - DNA, 18 bp, Artificial sequence
  synthetic polynucleotide sequence
gaaggggcaaggacccta

SEQ ID NO: 14153 - DNA, 18 bp, Artificial sequence
  synthetic polynucleotide sequence
cccctcctgctcggagca

SEQ ID NO: 14154 - DNA, 18 bp, Artificial sequence
  synthetic polynucleotide sequence
ggtgtgacaaaacggcca

SEQ ID NO: 14155 - DNA, 18 bp, Artificial sequence
  synthetic polynucleotide sequence
aatccgaaggtctgccga

SEQ ID NO: 14156 - DNA, 18 bp, Artificial sequence
  synthetic polynucleotide sequence
acctagagcagctcacga

SEQ ID NO: 14157 - DNA, 18 bp, Artificial sequence
  synthetic polynucleotide sequence
ctaggaggacgacggtga

SEQ ID NO: 14158 - DNA, 18 bp, Artificial sequence
  synthetic polynucleotide sequence
ggaacgtgggcaggagca

SEQ ID NO: 14159 - DNA, 18 bp, Artificial sequence
  synthetic polynucleotide sequence
caccggttggaggtgaca

SEQ ID NO: 14160 - DNA, 18 bp, Artificial sequence
  synthetic polynucleotide sequence
caccggttggaggtgaca

SEQ ID NO: 14161 - DNA, 18 bp, Artificial sequence
  synthetic polynucleotide sequence
aggaccctatgcgagcca

SEQ ID NO: 14162 - DNA, 18 bp, Artificial sequence
  synthetic polynucleotide sequence
aatcggtgacgatgggca

SEQ ID NO: 14163 - DNA, 18 bp, Artificial sequence
  synthetic polynucleotide sequence
cacggacaggaagccaga

SEQ ID NO: 14164 - DNA, 18 bp, Artificial sequence
  synthetic polynucleotide sequence
cacgctgtcagcagctga

SEQ ID NO: 14165 - DNA, 18 bp, Artificial sequence
  synthetic polynucleotide sequence
acccagtagctgcacaca

SEQ ID NO: 14166 - DNA, 18 bp, Artificial sequence
  synthetic polynucleotide sequence
ggcagcttctaggcgcaa

SEQ ID NO: 14167 - DNA, 18 bp, Artificial sequence
  synthetic polynucleotide sequence
gcagcaacagcaaaggaa

SEQ ID NO: 14168 - DNA, 18 bp, Artificial sequence
  synthetic polynucleotide sequence
cctttgggaacggagaca

SEQ ID NO: 14169 - DNA, 18 bp, Artificial sequence
  synthetic polynucleotide sequence
ccaactgccctggagtca

SEQ ID NO: 14170 - DNA, 18 bp, Artificial sequence
  synthetic polynucleotide sequence
acctccaatgccaacgca

SEQ ID NO: 14171 - DNA, 18 bp, Artificial sequence
  synthetic polynucleotide sequence
aaggcccaacgaagccta

SEQ ID NO: 14172 - DNA, 18 bp, Artificial sequence
  synthetic polynucleotide sequence
ggctgcttcaaacccgga

SEQ ID NO: 14173 - DNA, 18 bp, Artificial sequence
  synthetic polynucleotide sequence
gcaggcaagtgctcagga

SEQ ID NO: 14174 - DNA, 18 bp, Artificial sequence
  synthetic polynucleotide sequence
gaaacctgctccagccca

SEQ ID NO: 14175 - DNA, 18 bp, Artificial sequence
  synthetic polynucleotide sequence
agtgccgtccatgcagga

SEQ ID NO: 14176 - DNA, 18 bp, Artificial sequence
  synthetic polynucleotide sequence
gtgacagctccacggcca

SEQ ID NO: 14177 - DNA, 18 bp, Artificial sequence
  synthetic polynucleotide sequence
gtgaagcaagtgaggcca

SEQ ID NO: 14178 - DNA, 18 bp, Artificial sequence
  synthetic polynucleotide sequence
gtgaagcaagtgaggcca

SEQ ID NO: 14179 - DNA, 18 bp, Artificial sequence
  synthetic polynucleotide sequence
ctccaacctcgtgcccaa

SEQ ID NO: 14180 - DNA, 18 bp, Artificial sequence
  synthetic polynucleotide sequence
cgatggccactgagcgga

SEQ ID NO: 14181 - DNA, 18 bp, Artificial sequence
  synthetic polynucleotide sequence
ctggggactggaagacca

SEQ ID NO: 14182 - DNA, 18 bp, Artificial sequence
  synthetic polynucleotide sequence
tgaggctgcagcctgcca

SEQ ID NO: 14183 - DNA, 18 bp, Artificial sequence
  synthetic polynucleotide sequence
ggctcgtaatgccaagga

SEQ ID NO: 14184 - DNA, 18 bp, Artificial sequence
  synthetic polynucleotide sequence
accaggaaccataggcca

SEQ ID NO: 14185 - DNA, 18 bp, Artificial sequence
  synthetic polynucleotide sequence
ctacgaggagctgcagca

SEQ ID NO: 14186 - DNA, 18 bp, Artificial sequence
  synthetic polynucleotide sequence
cgcgacggtggtccagca

SEQ ID NO: 14187 - DNA, 18 bp, Artificial sequence
  synthetic polynucleotide sequence
gcagcccaaaggccagca

SEQ ID NO: 14188 - DNA, 18 bp, Artificial sequence
  synthetic polynucleotide sequence
ccattgggagggaaggca

SEQ ID NO: 14189 - DNA, 18 bp, Artificial sequence
  synthetic polynucleotide sequence
cgtctgcagcacagcgga

SEQ ID NO: 14190 - DNA, 18 bp, Artificial sequence
  synthetic polynucleotide sequence
gcatcctggatcgacaca

SEQ ID NO: 14191 - DNA, 18 bp, Artificial sequence
  synthetic polynucleotide sequence
ggatccgcagctccacca

SEQ ID NO: 14192 - DNA, 18 bp, Artificial sequence
  synthetic polynucleotide sequence
cgaagacctgcagcagga

SEQ ID NO: 14193 - DNA, 18 bp, Artificial sequence
  synthetic polynucleotide sequence
ccttggggcaggcgacca

SEQ ID NO: 14194 - DNA, 18 bp, Artificial sequence
  synthetic polynucleotide sequence
ccaagtggcagcgagtca

SEQ ID NO: 14195 - DNA, 18 bp, Artificial sequence
  synthetic polynucleotide sequence
ccaggtaggtgtcccgca

SEQ ID NO: 14196 - DNA, 18 bp, Artificial sequence
  synthetic polynucleotide sequence
ccaggtaggtgtcccgca

SEQ ID NO: 14197 - DNA, 18 bp, Artificial sequence
  synthetic polynucleotide sequence
ggccccacaaacagtgga

SEQ ID NO: 14198 - DNA, 18 bp, Artificial sequence
  synthetic polynucleotide sequence
tcacatggcacaccagca

SEQ ID NO: 14199 - DNA, 18 bp, Artificial sequence
  synthetic polynucleotide sequence
gccaacttccagagcaca

SEQ ID NO: 14200 - DNA, 18 bp, Artificial sequence
  synthetic polynucleotide sequence
gtccataccaggtcacga

SEQ ID NO: 14201 - DNA, 18 bp, Artificial sequence
  synthetic polynucleotide sequence
cacgcctcagactgagga

SEQ ID NO: 14202 - DNA, 18 bp, Artificial sequence
  synthetic polynucleotide sequence
ctttggagggccagggga

SEQ ID NO: 14203 - DNA, 18 bp, Artificial sequence
  synthetic polynucleotide sequence
gctgagcttcaccgagca

SEQ ID NO: 14204 - DNA, 18 bp, Artificial sequence
  synthetic polynucleotide sequence
caggcagcaggacggaca

SEQ ID NO: 14205 - DNA, 18 bp, Artificial sequence
  synthetic polynucleotide sequence
tgcaaactggtgccacca

SEQ ID NO: 14206 - DNA, 18 bp, Artificial sequence
  synthetic polynucleotide sequence
ggaggcagcaggtgagga

SEQ ID NO: 14207 - DNA, 18 bp, Artificial sequence
  synthetic polynucleotide sequence
ccctcagtctcggaagca

SEQ ID NO: 14208 - DNA, 18 bp, Artificial sequence
  synthetic polynucleotide sequence
aagcgagggcatgaccca

SEQ ID NO: 14209 - DNA, 18 bp, Artificial sequence
  synthetic polynucleotide sequence
gcaggactcagtcccaca

SEQ ID NO: 14210 - DNA, 18 bp, Artificial sequence
  synthetic polynucleotide sequence
acatggagagcacccgca

SEQ ID NO: 14211 - DNA, 18 bp, Artificial sequence
  synthetic polynucleotide sequence
cgtatcgagccgcatcca

SEQ ID NO: 14212 - DNA, 18 bp, Artificial sequence
  synthetic polynucleotide sequence
agctgaaagacgaggaca

SEQ ID NO: 14213 - DNA, 18 bp, Artificial sequence
  synthetic polynucleotide sequence
caaccgacgggtgaagga

SEQ ID NO: 14214 - DNA, 18 bp, Artificial sequence
  synthetic polynucleotide sequence
caaccgacgggtgaagga

SEQ ID NO: 14215 - DNA, 18 bp, Artificial sequence
  synthetic polynucleotide sequence
agtgctctccacccacca

SEQ ID NO: 14216 - DNA, 18 bp, Artificial sequence
  synthetic polynucleotide sequence
cacgcaccacgtaaggca

SEQ ID NO: 14217 - DNA, 18 bp, Artificial sequence
  synthetic polynucleotide sequence
ggggaagtagaacagcaa

SEQ ID NO: 14218 - DNA, 18 bp, Artificial sequence
  synthetic polynucleotide sequence
tggacggagaggtaagca

SEQ ID NO: 14219 - DNA, 18 bp, Artificial sequence
  synthetic polynucleotide sequence
gccacccattgtggacca

SEQ ID NO: 14220 - DNA, 18 bp, Artificial sequence
  synthetic polynucleotide sequence
ccctgggcattgcagaga

SEQ ID NO: 14221 - DNA, 18 bp, Artificial sequence
  synthetic polynucleotide sequence
gtggagctggacgaggaa

SEQ ID NO: 14222 - DNA, 18 bp, Artificial sequence
  synthetic polynucleotide sequence
gacaggccacttccagca

SEQ ID NO: 14223 - DNA, 18 bp, Artificial sequence
  synthetic polynucleotide sequence
ggaggaggttggcagcaa

SEQ ID NO: 14224 - DNA, 18 bp, Artificial sequence
  synthetic polynucleotide sequence
acacagtctgccggtcca

SEQ ID NO: 14225 - DNA, 18 bp, Artificial sequence
  synthetic polynucleotide sequence
ttacaggcatcgaaggca

SEQ ID NO: 14226 - DNA, 18 bp, Artificial sequence
  synthetic polynucleotide sequence
gtacggcccaaaacgcca

SEQ ID NO: 14227 - DNA, 18 bp, Artificial sequence
  synthetic polynucleotide sequence
cccacagaaccgtgggga

SEQ ID NO: 14228 - DNA, 18 bp, Artificial sequence
  synthetic polynucleotide sequence
cagcctgcgtggaagaga

SEQ ID NO: 14229 - DNA, 18 bp, Artificial sequence
  synthetic polynucleotide sequence
cctgcagtagagcgcgga

SEQ ID NO: 14230 - DNA, 18 bp, Artificial sequence
  synthetic polynucleotide sequence
gtggtcccggcaaggcaa

SEQ ID NO: 14231 - DNA, 18 bp, Artificial sequence
  synthetic polynucleotide sequence
cctgctcaagcacgggca

SEQ ID NO: 14232 - DNA, 18 bp, Artificial sequence
  synthetic polynucleotide sequence
cctgctcaagcacgggca

SEQ ID NO: 14233 - DNA, 18 bp, Artificial sequence
  synthetic polynucleotide sequence
ctacaaggcccagaccca

SEQ ID NO: 14234 - DNA, 18 bp, Artificial sequence
  synthetic polynucleotide sequence
tggacaccctgcagggca

SEQ ID NO: 14235 - DNA, 18 bp, Artificial sequence
  synthetic polynucleotide sequence
ggcgccactcatcacaga

SEQ ID NO: 14236 - DNA, 18 bp, Artificial sequence
  synthetic polynucleotide sequence
agctgaggtcgaggagga

SEQ ID NO: 14237 - DNA, 18 bp, Artificial sequence
  synthetic polynucleotide sequence
ggcaaagacttggaggga

SEQ ID NO: 14238 - DNA, 18 bp, Artificial sequence
  synthetic polynucleotide sequence
ctacctccacgccctcga

SEQ ID NO: 14239 - DNA, 18 bp, Artificial sequence
  synthetic polynucleotide sequence
tgagctcctggagcagca

SEQ ID NO: 14240 - DNA, 18 bp, Artificial sequence
  synthetic polynucleotide sequence
tgccgaacaccctggaca

SEQ ID NO: 14241 - DNA, 18 bp, Artificial sequence
  synthetic polynucleotide sequence
gcagcaggcagagaagga

SEQ ID NO: 14242 - DNA, 18 bp, Artificial sequence
  synthetic polynucleotide sequence
cattccacggtggggcca

SEQ ID NO: 14243 - DNA, 18 bp, Artificial sequence
  synthetic polynucleotide sequence
ggttggccaggtagcaga

SEQ ID NO: 14244 - DNA, 18 bp, Artificial sequence
  synthetic polynucleotide sequence
aagccgtcctgtccgaca

SEQ ID NO: 14245 - DNA, 18 bp, Artificial sequence
  synthetic polynucleotide sequence
acctgggtaggaggcgta

SEQ ID NO: 14246 - DNA, 18 bp, Artificial sequence
  synthetic polynucleotide sequence
caaggctggcgtggacga

SEQ ID NO: 14247 - DNA, 18 bp, Artificial sequence
  synthetic polynucleotide sequence
actccagcacgaggagga

SEQ ID NO: 14248 - DNA, 18 bp, Artificial sequence
  synthetic polynucleotide sequence
gcaggacttgcaggccca

SEQ ID NO: 14249 - DNA, 18 bp, Artificial sequence
  synthetic polynucleotide sequence
ttggcagctgaagcgcca

SEQ ID NO: 14250 - DNA, 18 bp, Artificial sequence
  synthetic polynucleotide sequence
ttggcagctgaagcgcca

SEQ ID NO: 14251 - DNA, 18 bp, Artificial sequence
  synthetic polynucleotide sequence
gccagtcacggatggaga

SEQ ID NO: 14252 - DNA, 18 bp, Artificial sequence
  synthetic polynucleotide sequence
ggaccccgttctcaggca

SEQ ID NO: 14253 - DNA, 18 bp, Artificial sequence
  synthetic polynucleotide sequence
ccttctcgccaacccgaa

SEQ ID NO: 14254 - DNA, 18 bp, Artificial sequence
  synthetic polynucleotide sequence
gagaaggcgtcaggggga

SEQ ID NO: 14255 - DNA, 18 bp, Artificial sequence
  synthetic polynucleotide sequence
gtaacctcagcatcgaca

SEQ ID NO: 14256 - DNA, 18 bp, Artificial sequence
  synthetic polynucleotide sequence
gaagacgaggagtcacca

SEQ ID NO: 14257 - DNA, 18 bp, Artificial sequence
  synthetic polynucleotide sequence
cgccagacagggaacaca

SEQ ID NO: 14258 - DNA, 18 bp, Artificial sequence
  synthetic polynucleotide sequence
agagcaccaggttcagga

SEQ ID NO: 14259 - DNA, 18 bp, Artificial sequence
  synthetic polynucleotide sequence
gatgaccagacccaggga

SEQ ID NO: 14260 - DNA, 18 bp, Artificial sequence
  synthetic polynucleotide sequence
ggacaaggaagtgcagca

SEQ ID NO: 14261 - DNA, 18 bp, Artificial sequence
  synthetic polynucleotide sequence
cacaatggctggcaccga

SEQ ID NO: 14262 - DNA, 18 bp, Artificial sequence
  synthetic polynucleotide sequence
cgacaagaccacagcgga

SEQ ID NO: 14263 - DNA, 18 bp, Artificial sequence
  synthetic polynucleotide sequence
ctgcagtggccaagcgca

SEQ ID NO: 14264 - DNA, 18 bp, Artificial sequence
  synthetic polynucleotide sequence
accccgtgtggaacgaga

SEQ ID NO: 14265 - DNA, 18 bp, Artificial sequence
  synthetic polynucleotide sequence
aatcagcgccttccacca

SEQ ID NO: 14266 - DNA, 18 bp, Artificial sequence
  synthetic polynucleotide sequence
gaccggggtcaaacgcaa

SEQ ID NO: 14267 - DNA, 18 bp, Artificial sequence
  synthetic polynucleotide sequence
ccgtgggcacatagcgca

SEQ ID NO: 14268 - DNA, 18 bp, Artificial sequence
  synthetic polynucleotide sequence
ccgtgggcacatagcgca

SEQ ID NO: 14269 - DNA, 18 bp, Artificial sequence
  synthetic polynucleotide sequence
gccagccatggatgagca

SEQ ID NO: 14270 - DNA, 18 bp, Artificial sequence
  synthetic polynucleotide sequence
tgtgaagtgcaaggccaa

SEQ ID NO: 14271 - DNA, 18 bp, Artificial sequence
  synthetic polynucleotide sequence
ccaaactccctggagcca

SEQ ID NO: 14272 - DNA, 18 bp, Artificial sequence
  synthetic polynucleotide sequence
cgaccatggattagccca

SEQ ID NO: 14273 - DNA, 18 bp, Artificial sequence
  synthetic polynucleotide sequence
ccagctgcaggaggacga

SEQ ID NO: 14274 - DNA, 18 bp, Artificial sequence
  synthetic polynucleotide sequence
ggagggcatgacaaggga

SEQ ID NO: 14275 - DNA, 18 bp, Artificial sequence
  synthetic polynucleotide sequence
gagacccaagcctcagca

SEQ ID NO: 14276 - DNA, 18 bp, Artificial sequence
  synthetic polynucleotide sequence
gagcctttaacagggcca

SEQ ID NO: 14277 - DNA, 18 bp, Artificial sequence
  synthetic polynucleotide sequence
taaggagccacaggagga

SEQ ID NO: 14278 - DNA, 18 bp, Artificial sequence
  synthetic polynucleotide sequence
tggagcagctggtagaga

SEQ ID NO: 14279 - DNA, 18 bp, Artificial sequence
  synthetic polynucleotide sequence
tgaacacggcgtcgggga

SEQ ID NO: 14280 - DNA, 18 bp, Artificial sequence
  synthetic polynucleotide sequence
cgatgccccgaagaagca

SEQ ID NO: 14281 - DNA, 18 bp, Artificial sequence
  synthetic polynucleotide sequence
ggagatgaggtcgtcgca

SEQ ID NO: 14282 - DNA, 18 bp, Artificial sequence
  synthetic polynucleotide sequence
gcatccagtcgctggaga

SEQ ID NO: 14283 - DNA, 18 bp, Artificial sequence
  synthetic polynucleotide sequence
ggaggtcaggtccaggga

SEQ ID NO: 14284 - DNA, 18 bp, Artificial sequence
  synthetic polynucleotide sequence
atctccagacccagggca

SEQ ID NO: 14285 - DNA, 18 bp, Artificial sequence
  synthetic polynucleotide sequence
gaagttctggaagcggca

SEQ ID NO: 14286 - DNA, 18 bp, Artificial sequence
  synthetic polynucleotide sequence
gaagttctggaagcggca

SEQ ID NO: 14287 - DNA, 18 bp, Artificial sequence
  synthetic polynucleotide sequence
gagggacatcaagggcga

SEQ ID NO: 14288 - DNA, 18 bp, Artificial sequence
  synthetic polynucleotide sequence
ccaccacgaccaccacga

SEQ ID NO: 14289 - DNA, 18 bp, Artificial sequence
  synthetic polynucleotide sequence
ggtagacggagtgcacca

SEQ ID NO: 14290 - DNA, 18 bp, Artificial sequence
  synthetic polynucleotide sequence
ctccagggaccaacctca

SEQ ID NO: 14291 - DNA, 18 bp, Artificial sequence
  synthetic polynucleotide sequence
gctcagcagcatccggaa

SEQ ID NO: 14292 - DNA, 18 bp, Artificial sequence
  synthetic polynucleotide sequence
cgtatgcgcacataggca

SEQ ID NO: 14293 - DNA, 18 bp, Artificial sequence
  synthetic polynucleotide sequence
agggcacggcctccggca

SEQ ID NO: 14294 - DNA, 18 bp, Artificial sequence
  synthetic polynucleotide sequence
cgctgagggcaggggtca

SEQ ID NO: 14295 - DNA, 19 bp, Artificial sequence
  synthetic polynucleotide sequence
gatgaggaagaagacccca

SEQ ID NO: 14296 - DNA, 17 bp, Artificial sequence
  synthetic polynucleotide sequence
ggtcatccccaaagcca

SEQ ID NO: 14297 - DNA, 18 bp, Artificial sequence
  synthetic polynucleotide sequence
cggtctccaccgtagcca

SEQ ID NO: 14298 - DNA, 18 bp, Artificial sequence
  synthetic polynucleotide sequence
cgaggaggctatggagga

SEQ ID NO: 14299 - DNA, 18 bp, Artificial sequence
  synthetic polynucleotide sequence
ggggctgagagctagaga

SEQ ID NO: 14300 - DNA, 18 bp, Artificial sequence
  synthetic polynucleotide sequence
taccaccccagagggaca

SEQ ID NO: 14301 - DNA, 18 bp, Artificial sequence
  synthetic polynucleotide sequence
cgggagctagctggccga

SEQ ID NO: 14302 - DNA, 18 bp, Artificial sequence
  synthetic polynucleotide sequence
tccaagcagtcacccaca

SEQ ID NO: 14303 - DNA, 18 bp, Artificial sequence
  synthetic polynucleotide sequence
tcgcacacttggggcaga

SEQ ID NO: 14304 - DNA, 18 bp, Artificial sequence
  synthetic polynucleotide sequence
tcgcacacttggggcaga

SEQ ID NO: 14305 - DNA, 18 bp, Artificial sequence
  synthetic polynucleotide sequence
gctcaggttccaccacca

SEQ ID NO: 14306 - DNA, 18 bp, Artificial sequence
  synthetic polynucleotide sequence
cgggggaggaactggaga

SEQ ID NO: 14307 - DNA, 18 bp, Artificial sequence
  synthetic polynucleotide sequence
agatccaggcctccacca

SEQ ID NO: 14308 - DNA, 18 bp, Artificial sequence
  synthetic polynucleotide sequence
tccgctgcacacaggcca

SEQ ID NO: 14309 - DNA, 18 bp, Artificial sequence
  synthetic polynucleotide sequence
caagctgatccccacaca

SEQ ID NO: 14310 - DNA, 18 bp, Artificial sequence
  synthetic polynucleotide sequence
acttcatggccaggcgga

SEQ ID NO: 14311 - DNA, 18 bp, Artificial sequence
  synthetic polynucleotide sequence
caaggaccccacctgcca

SEQ ID NO: 14312 - DNA, 18 bp, Artificial sequence
  synthetic polynucleotide sequence
cttggaccaggtgaagga

SEQ ID NO: 14313 - DNA, 18 bp, Artificial sequence
  synthetic polynucleotide sequence
ggagctcgaggagcagca

SEQ ID NO: 14314 - DNA, 18 bp, Artificial sequence
  synthetic polynucleotide sequence
ccacatgccaatcaagga

SEQ ID NO: 14315 - DNA, 18 bp, Artificial sequence
  synthetic polynucleotide sequence
ggggaatcgagtgaggga

SEQ ID NO: 14316 - DNA, 18 bp, Artificial sequence
  synthetic polynucleotide sequence
cctggagaccataatgca

SEQ ID NO: 14317 - DNA, 18 bp, Artificial sequence
  synthetic polynucleotide sequence
acgcattcaacagctcca

SEQ ID NO: 14318 - DNA, 18 bp, Artificial sequence
  synthetic polynucleotide sequence
ggaggaacagacccggaa

SEQ ID NO: 14319 - DNA, 18 bp, Artificial sequence
  synthetic polynucleotide sequence
tgactggagcacggggga

SEQ ID NO: 14320 - DNA, 18 bp, Artificial sequence
  synthetic polynucleotide sequence
ggggcagtacgatggcaa

SEQ ID NO: 14321 - DNA, 17 bp, Artificial sequence
  synthetic polynucleotide sequence
ctagaagccgacgcaca

SEQ ID NO: 14322 - DNA, 17 bp, Artificial sequence
  synthetic polynucleotide sequence
ctagaagccgacgcaca

SEQ ID NO: 14323 - DNA, 18 bp, Artificial sequence
  synthetic polynucleotide sequence
acatggaccgacagccaa

SEQ ID NO: 14324 - DNA, 18 bp, Artificial sequence
  synthetic polynucleotide sequence
agcgccgtcacctcacca

SEQ ID NO: 14325 - DNA, 18 bp, Artificial sequence
  synthetic polynucleotide sequence
ccgctctcagaaggccga

SEQ ID NO: 14326 - DNA, 18 bp, Artificial sequence
  synthetic polynucleotide sequence
agacagcagcccagccca

SEQ ID NO: 14327 - DNA, 18 bp, Artificial sequence
  synthetic polynucleotide sequence
ccaggttgtcccaccaga

SEQ ID NO: 14328 - DNA, 18 bp, Artificial sequence
  synthetic polynucleotide sequence
gccgtctctgaagcccca

SEQ ID NO: 14329 - DNA, 18 bp, Artificial sequence
  synthetic polynucleotide sequence
gacagtggacaggagcca

SEQ ID NO: 14330 - DNA, 18 bp, Artificial sequence
  synthetic polynucleotide sequence
gggcccagcatggagaga

SEQ ID NO: 14331 - DNA, 18 bp, Artificial sequence
  synthetic polynucleotide sequence
cggttgccggagtacaca

SEQ ID NO: 14332 - DNA, 18 bp, Artificial sequence
  synthetic polynucleotide sequence
ccgtgtgcactcgaagca

SEQ ID NO: 14333 - DNA, 18 bp, Artificial sequence
  synthetic polynucleotide sequence
gcaccagaattagagcca

SEQ ID NO: 14334 - DNA, 18 bp, Artificial sequence
  synthetic polynucleotide sequence
cagaaccagtcaggccca

SEQ ID NO: 14335 - DNA, 18 bp, Artificial sequence
  synthetic polynucleotide sequence
cagctagccgcagaggca

SEQ ID NO: 14336 - DNA, 18 bp, Artificial sequence
  synthetic polynucleotide sequence
cccatgaactgcccagga

SEQ ID NO: 14337 - DNA, 18 bp, Artificial sequence
  synthetic polynucleotide sequence
aggaaggtcccagcccca

SEQ ID NO: 14338 - DNA, 18 bp, Artificial sequence
  synthetic polynucleotide sequence
ggactggaatggacccaa

SEQ ID NO: 14339 - DNA, 18 bp, Artificial sequence
  synthetic polynucleotide sequence
actggagagatgagctca

SEQ ID NO: 14340 - DNA, 18 bp, Artificial sequence
  synthetic polynucleotide sequence
actggagagatgagctca

SEQ ID NO: 14341 - DNA, 18 bp, Artificial sequence
  synthetic polynucleotide sequence
aacctcaggattccgaga

SEQ ID NO: 14342 - DNA, 18 bp, Artificial sequence
  synthetic polynucleotide sequence
ggggtgaactgctgcaca

SEQ ID NO: 14343 - DNA, 18 bp, Artificial sequence
  synthetic polynucleotide sequence
atccctggactccggcca

SEQ ID NO: 14344 - DNA, 18 bp, Artificial sequence
  synthetic polynucleotide sequence
cggggactgtgatgacca

SEQ ID NO: 14345 - DNA, 18 bp, Artificial sequence
  synthetic polynucleotide sequence
gcctgtcccagaacagca

SEQ ID NO: 14346 - DNA, 18 bp, Artificial sequence
  synthetic polynucleotide sequence
gtagctgccggtgaagca

SEQ ID NO: 14347 - DNA, 18 bp, Artificial sequence
  synthetic polynucleotide sequence
aggtggaatcgaccagga

SEQ ID NO: 14348 - DNA, 18 bp, Artificial sequence
  synthetic polynucleotide sequence
agcagggcctccttcaga

SEQ ID NO: 14349 - DNA, 18 bp, Artificial sequence
  synthetic polynucleotide sequence
gcgtctaccagaagggga

SEQ ID NO: 14350 - DNA, 18 bp, Artificial sequence
  synthetic polynucleotide sequence
catgccacaggggcagga

SEQ ID NO: 14351 - DNA, 18 bp, Artificial sequence
  synthetic polynucleotide sequence
gagcctgaggtactagca

SEQ ID NO: 14352 - DNA, 18 bp, Artificial sequence
  synthetic polynucleotide sequence
tatggcactgcagcagca

SEQ ID NO: 14353 - DNA, 18 bp, Artificial sequence
  synthetic polynucleotide sequence
cgcccagaaggtcacaca

SEQ ID NO: 14354 - DNA, 18 bp, Artificial sequence
  synthetic polynucleotide sequence
cgctgatccggaagacca

SEQ ID NO: 14355 - DNA, 18 bp, Artificial sequence
  synthetic polynucleotide sequence
gccagtgatccacctgga

SEQ ID NO: 14356 - DNA, 18 bp, Artificial sequence
  synthetic polynucleotide sequence
caacctggaagcggcaga

SEQ ID NO: 14357 - DNA, 18 bp, Artificial sequence
  synthetic polynucleotide sequence
cagaccctgatgctagga

SEQ ID NO: 14358 - DNA, 18 bp, Artificial sequence
  synthetic polynucleotide sequence
cagaccctgatgctagga

SEQ ID NO: 14359 - DNA, 18 bp, Artificial sequence
  synthetic polynucleotide sequence
ccaacgactcacggagga

SEQ ID NO: 14360 - DNA, 18 bp, Artificial sequence
  synthetic polynucleotide sequence
tgccactggccaaggcca

SEQ ID NO: 14361 - DNA, 18 bp, Artificial sequence
  synthetic polynucleotide sequence
ccacgccagcttcggaga

SEQ ID NO: 14362 - DNA, 18 bp, Artificial sequence
  synthetic polynucleotide sequence
cggcgtttcgggcacgaa

SEQ ID NO: 14363 - DNA, 18 bp, Artificial sequence
  synthetic polynucleotide sequence
cctgaacagagcgcagga

SEQ ID NO: 14364 - DNA, 18 bp, Artificial sequence
  synthetic polynucleotide sequence
gcacacacagggcccaca

SEQ ID NO: 14365 - DNA, 18 bp, Artificial sequence
  synthetic polynucleotide sequence
catccgggctgataggga

SEQ ID NO: 14366 - DNA, 18 bp, Artificial sequence
  synthetic polynucleotide sequence
ggccccaggcacaccaca

SEQ ID NO: 14367 - DNA, 18 bp, Artificial sequence
  synthetic polynucleotide sequence
gccatcaccctccagcaa

SEQ ID NO: 14368 - DNA, 18 bp, Artificial sequence
  synthetic polynucleotide sequence
cactcggtgaggacccca

SEQ ID NO: 14369 - DNA, 18 bp, Artificial sequence
  synthetic polynucleotide sequence
acaagcgtagagacggca

SEQ ID NO: 14370 - DNA, 18 bp, Artificial sequence
  synthetic polynucleotide sequence
ccacatagtgcgagccaa

SEQ ID NO: 14371 - DNA, 18 bp, Artificial sequence
  synthetic polynucleotide sequence
ggagctgtcaccactgga

SEQ ID NO: 14372 - DNA, 18 bp, Artificial sequence
  synthetic polynucleotide sequence
ggactgagattgccccca

SEQ ID NO: 14373 - DNA, 18 bp, Artificial sequence
  synthetic polynucleotide sequence
accttcagtgggcaagga

SEQ ID NO: 14374 - DNA, 18 bp, Artificial sequence
  synthetic polynucleotide sequence
agacctggatgcggcaga

SEQ ID NO: 14375 - DNA, 18 bp, Artificial sequence
  synthetic polynucleotide sequence
ggtatgcagtcacagcga

SEQ ID NO: 14376 - DNA, 18 bp, Artificial sequence
  synthetic polynucleotide sequence
ggtatgcagtcacagcga

SEQ ID NO: 14377 - DNA, 19 bp, Artificial sequence
  synthetic polynucleotide sequence
cagttcatcccagcacgga

SEQ ID NO: 14378 - DNA, 18 bp, Artificial sequence
  synthetic polynucleotide sequence
actgggtacactggacaa

SEQ ID NO: 14379 - DNA, 18 bp, Artificial sequence
  synthetic polynucleotide sequence
ccccatccagcttcagga

SEQ ID NO: 14380 - DNA, 18 bp, Artificial sequence
  synthetic polynucleotide sequence
gcaccgggcttgctgaca

SEQ ID NO: 14381 - DNA, 18 bp, Artificial sequence
  synthetic polynucleotide sequence
aagtacttccagcggcaa

SEQ ID NO: 14382 - DNA, 18 bp, Artificial sequence
  synthetic polynucleotide sequence
ccctacacttcaaccgca

SEQ ID NO: 14383 - DNA, 18 bp, Artificial sequence
  synthetic polynucleotide sequence
tacccgcgatacaggcca

SEQ ID NO: 14384 - DNA, 18 bp, Artificial sequence
  synthetic polynucleotide sequence
ggcacacttggaaccaga

SEQ ID NO: 14385 - DNA, 18 bp, Artificial sequence
  synthetic polynucleotide sequence
acgaccagtagcccagca

SEQ ID NO: 14386 - DNA, 18 bp, Artificial sequence
  synthetic polynucleotide sequence
gtggctgtaggagcagga

SEQ ID NO: 14387 - DNA, 18 bp, Artificial sequence
  synthetic polynucleotide sequence
cccctctctccagcagca

SEQ ID NO: 14388 - DNA, 18 bp, Artificial sequence
  synthetic polynucleotide sequence
ccaagccagaggaggcaa

SEQ ID NO: 14389 - DNA, 18 bp, Artificial sequence
  synthetic polynucleotide sequence
gtggaaggtcccacagca

SEQ ID NO: 14390 - DNA, 18 bp, Artificial sequence
  synthetic polynucleotide sequence
gtaccagtcagtggccaa

SEQ ID NO: 14391 - DNA, 18 bp, Artificial sequence
  synthetic polynucleotide sequence
tgcagccaacacaggcca

SEQ ID NO: 14392 - DNA, 18 bp, Artificial sequence
  synthetic polynucleotide sequence
cgtcctcggaagtaccca

SEQ ID NO: 14393 - DNA, 18 bp, Artificial sequence
  synthetic polynucleotide sequence
gacattaggcagcgccca

SEQ ID NO: 14394 - DNA, 18 bp, Artificial sequence
  synthetic polynucleotide sequence
gacattaggcagcgccca

SEQ ID NO: 14395 - DNA, 18 bp, Artificial sequence
  synthetic polynucleotide sequence
tcgcccacttgaggcaga

SEQ ID NO: 14396 - DNA, 18 bp, Artificial sequence
  synthetic polynucleotide sequence
ataagcggctcgcggtca

SEQ ID NO: 14397 - DNA, 18 bp, Artificial sequence
  synthetic polynucleotide sequence
gcaagtgcgagagcggaa

SEQ ID NO: 14398 - DNA, 18 bp, Artificial sequence
  synthetic polynucleotide sequence
tgggggtctccaaccaca

SEQ ID NO: 14399 - DNA, 18 bp, Artificial sequence
  synthetic polynucleotide sequence
ggagcagcaagtccgaga

SEQ ID NO: 14400 - DNA, 18 bp, Artificial sequence
  synthetic polynucleotide sequence
gccaaggagagaggggga

SEQ ID NO: 14401 - DNA, 18 bp, Artificial sequence
  synthetic polynucleotide sequence
gcggtcgagggaaaagca

SEQ ID NO: 14402 - DNA, 18 bp, Artificial sequence
  synthetic polynucleotide sequence
cactgtcatcggaaggaa

SEQ ID NO: 14403 - DNA, 18 bp, Artificial sequence
  synthetic polynucleotide sequence
cctctccctcaccaccaa

SEQ ID NO: 14404 - DNA, 18 bp, Artificial sequence
  synthetic polynucleotide sequence
gctgtgggcatggaccca

SEQ ID NO: 14405 - DNA, 18 bp, Artificial sequence
  synthetic polynucleotide sequence
ctatggagtgagccgaca

SEQ ID NO: 14406 - DNA, 18 bp, Artificial sequence
  synthetic polynucleotide sequence
cgctacacacgacgggca

SEQ ID NO: 14407 - DNA, 18 bp, Artificial sequence
  synthetic polynucleotide sequence
agagagggctggagcgca

SEQ ID NO: 14408 - DNA, 18 bp, Artificial sequence
  synthetic polynucleotide sequence
ggagcagaaacgtcgcca

SEQ ID NO: 14409 - DNA, 18 bp, Artificial sequence
  synthetic polynucleotide sequence
ggcccataagcaggagca

SEQ ID NO: 14410 - DNA, 18 bp, Artificial sequence
  synthetic polynucleotide sequence
ccacactcatccgcacca

SEQ ID NO: 14411 - DNA, 18 bp, Artificial sequence
  synthetic polynucleotide sequence
ggtacactaagcgccaga

SEQ ID NO: 14412 - DNA, 18 bp, Artificial sequence
  synthetic polynucleotide sequence
ggtacactaagcgccaga

SEQ ID NO: 14413 - DNA, 18 bp, Artificial sequence
  synthetic polynucleotide sequence
tccaaacgctgcagccca

SEQ ID NO: 14414 - DNA, 18 bp, Artificial sequence
  synthetic polynucleotide sequence
taggctcatcagcggaga

SEQ ID NO: 14415 - DNA, 18 bp, Artificial sequence
  synthetic polynucleotide sequence
gactgtctggcaccacga

SEQ ID NO: 14416 - DNA, 18 bp, Artificial sequence
  synthetic polynucleotide sequence
gcggcaagagactaagca

SEQ ID NO: 14417 - DNA, 18 bp, Artificial sequence
  synthetic polynucleotide sequence
gtgaggacagcagcgaca

SEQ ID NO: 14418 - DNA, 18 bp, Artificial sequence
  synthetic polynucleotide sequence
gagactgggatggcgcca

SEQ ID NO: 14419 - DNA, 18 bp, Artificial sequence
  synthetic polynucleotide sequence
gggggtgctgtagaagca

SEQ ID NO: 14420 - DNA, 18 bp, Artificial sequence
  synthetic polynucleotide sequence
cgcaagctgttcccgaga

SEQ ID NO: 14421 - DNA, 18 bp, Artificial sequence
  synthetic polynucleotide sequence
ggcagccaacaacccaga

SEQ ID NO: 14422 - DNA, 18 bp, Artificial sequence
  synthetic polynucleotide sequence
ccagcaagactgaggcca

SEQ ID NO: 14423 - DNA, 18 bp, Artificial sequence
  synthetic polynucleotide sequence
ggaccgtggccaccgcga

SEQ ID NO: 14424 - DNA, 18 bp, Artificial sequence
  synthetic polynucleotide sequence
ccacgctacaagctggta

SEQ ID NO: 14425 - DNA, 18 bp, Artificial sequence
  synthetic polynucleotide sequence
ggtgcagacacatccaca

SEQ ID NO: 14426 - DNA, 18 bp, Artificial sequence
  synthetic polynucleotide sequence
gctgaatccacaggccaa

SEQ ID NO: 14427 - DNA, 18 bp, Artificial sequence
  synthetic polynucleotide sequence
cggatgctcaggtgagca

SEQ ID NO: 14428 - DNA, 18 bp, Artificial sequence
  synthetic polynucleotide sequence
cgttgcaatgagaggcaa

SEQ ID NO: 14429 - DNA, 18 bp, Artificial sequence
  synthetic polynucleotide sequence
tgcgggttggacaggaga

SEQ ID NO: 14430 - DNA, 18 bp, Artificial sequence
  synthetic polynucleotide sequence
tgcgggttggacaggaga

SEQ ID NO: 14431 - DNA, 18 bp, Artificial sequence
  synthetic polynucleotide sequence
ggctgcttacaaagggca

SEQ ID NO: 14432 - DNA, 18 bp, Artificial sequence
  synthetic polynucleotide sequence
gacctcactgagccctga

SEQ ID NO: 14433 - DNA, 18 bp, Artificial sequence
  synthetic polynucleotide sequence
cggctgtcatacagagca

SEQ ID NO: 14434 - DNA, 18 bp, Artificial sequence
  synthetic polynucleotide sequence
gaggaaccaccggtgcca

SEQ ID NO: 14435 - DNA, 18 bp, Artificial sequence
  synthetic polynucleotide sequence
aatgcaagaggctccaga

SEQ ID NO: 14436 - DNA, 18 bp, Artificial sequence
  synthetic polynucleotide sequence
aactcccagacatccaca

SEQ ID NO: 14437 - DNA, 18 bp, Artificial sequence
  synthetic polynucleotide sequence
caactgcaaagtggccga

SEQ ID NO: 14438 - DNA, 18 bp, Artificial sequence
  synthetic polynucleotide sequence
cttcagaagcgtaagcca

SEQ ID NO: 14439 - DNA, 18 bp, Artificial sequence
  synthetic polynucleotide sequence
ccacccctgactcagcca

SEQ ID NO: 14440 - DNA, 18 bp, Artificial sequence
  synthetic polynucleotide sequence
taggatgtgcaacgccga

SEQ ID NO: 14441 - DNA, 18 bp, Artificial sequence
  synthetic polynucleotide sequence
cttctagcaccaccacca

SEQ ID NO: 14442 - DNA, 18 bp, Artificial sequence
  synthetic polynucleotide sequence
ggaactgaaggtggacca

SEQ ID NO: 14443 - DNA, 18 bp, Artificial sequence
  synthetic polynucleotide sequence
aaggcctgaaggctgcca

SEQ ID NO: 14444 - DNA, 18 bp, Artificial sequence
  synthetic polynucleotide sequence
gcctggagtcagtgacca

SEQ ID NO: 14445 - DNA, 18 bp, Artificial sequence
  synthetic polynucleotide sequence
cccggtatacctgggcca

SEQ ID NO: 14446 - DNA, 18 bp, Artificial sequence
  synthetic polynucleotide sequence
tgtgccatccccaccgca

SEQ ID NO: 14447 - DNA, 18 bp, Artificial sequence
  synthetic polynucleotide sequence
gccacaggcacatacaca

SEQ ID NO: 14448 - DNA, 18 bp, Artificial sequence
  synthetic polynucleotide sequence
gccacaggcacatacaca

SEQ ID NO: 14449 - DNA, 18 bp, Artificial sequence
  synthetic polynucleotide sequence
acctcagggctctcagga

SEQ ID NO: 14450 - DNA, 18 bp, Artificial sequence
  synthetic polynucleotide sequence
cactggtcacctgaggga

SEQ ID NO: 14451 - DNA, 18 bp, Artificial sequence
  synthetic polynucleotide sequence
gcaagcaggtggtggaga

SEQ ID NO: 14452 - DNA, 18 bp, Artificial sequence
  synthetic polynucleotide sequence
tggtgaccacctgcagga

SEQ ID NO: 14453 - DNA, 18 bp, Artificial sequence
  synthetic polynucleotide sequence
cagccgcttcagcagcaa

SEQ ID NO: 14454 - DNA, 18 bp, Artificial sequence
  synthetic polynucleotide sequence
ggtggcctcgagtaacca

SEQ ID NO: 14455 - DNA, 18 bp, Artificial sequence
  synthetic polynucleotide sequence
gctgggtgaagagggaca

SEQ ID NO: 14456 - DNA, 18 bp, Artificial sequence
  synthetic polynucleotide sequence
tggggatcaggctgcaca

SEQ ID NO: 14457 - DNA, 18 bp, Artificial sequence
  synthetic polynucleotide sequence
gggctccagtgtgagaga

SEQ ID NO: 14458 - DNA, 18 bp, Artificial sequence
  synthetic polynucleotide sequence
gtaggtagcggccagcca

SEQ ID NO: 14459 - DNA, 18 bp, Artificial sequence
  synthetic polynucleotide sequence
ggtgtccagcagcatgga

SEQ ID NO: 14460 - DNA, 18 bp, Artificial sequence
  synthetic polynucleotide sequence
caccgacgaggttcacca

SEQ ID NO: 14461 - DNA, 18 bp, Artificial sequence
  synthetic polynucleotide sequence
tccaaaggtgagcagcca

SEQ ID NO: 14462 - DNA, 18 bp, Artificial sequence
  synthetic polynucleotide sequence
gactagcccagaccacga

SEQ ID NO: 14463 - DNA, 18 bp, Artificial sequence
  synthetic polynucleotide sequence
accctttggccagccaga

SEQ ID NO: 14464 - DNA, 18 bp, Artificial sequence
  synthetic polynucleotide sequence
gatgatcacgagggcgga

SEQ ID NO: 14465 - DNA, 18 bp, Artificial sequence
  synthetic polynucleotide sequence
ctgcccacgccccacaca

SEQ ID NO: 14466 - DNA, 18 bp, Artificial sequence
  synthetic polynucleotide sequence
ctgcccacgccccacaca

SEQ ID NO: 14467 - DNA, 18 bp, Artificial sequence
  synthetic polynucleotide sequence
gagaaacgacgaggagca

SEQ ID NO: 14468 - DNA, 18 bp, Artificial sequence
  synthetic polynucleotide sequence
ggcagaggaaatcgagca

SEQ ID NO: 14469 - DNA, 18 bp, Artificial sequence
  synthetic polynucleotide sequence
ggatagcggggaaccaca

SEQ ID NO: 14470 - DNA, 18 bp, Artificial sequence
  synthetic polynucleotide sequence
gggctctcatccaccaca

SEQ ID NO: 14471 - DNA, 18 bp, Artificial sequence
  synthetic polynucleotide sequence
gctacggcgacatggaga

SEQ ID NO: 14472 - DNA, 18 bp, Artificial sequence
  synthetic polynucleotide sequence
cgcagccatactcaggga

SEQ ID NO: 14473 - DNA, 18 bp, Artificial sequence
  synthetic polynucleotide sequence
gacagcgagaaaccccga

SEQ ID NO: 14474 - DNA, 18 bp, Artificial sequence
  synthetic polynucleotide sequence
ggcatccttgacacacca

SEQ ID NO: 14475 - DNA, 18 bp, Artificial sequence
  synthetic polynucleotide sequence
cggcttggcagcaaggaa

SEQ ID NO: 14476 - DNA, 18 bp, Artificial sequence
  synthetic polynucleotide sequence
cctgtggggatgagcaca

SEQ ID NO: 14477 - DNA, 18 bp, Artificial sequence
  synthetic polynucleotide sequence
tgccacacagtgactgca

SEQ ID NO: 14478 - DNA, 18 bp, Artificial sequence
  synthetic polynucleotide sequence
ccaaggtacagtggacca

SEQ ID NO: 14479 - DNA, 18 bp, Artificial sequence
  synthetic polynucleotide sequence
agccacacaggttggaca

SEQ ID NO: 14480 - DNA, 18 bp, Artificial sequence
  synthetic polynucleotide sequence
catcccggaaggggagga

SEQ ID NO: 14481 - DNA, 18 bp, Artificial sequence
  synthetic polynucleotide sequence
ggacttgaccatcagcca

SEQ ID NO: 14482 - DNA, 18 bp, Artificial sequence
  synthetic polynucleotide sequence
aagatgctctgagccaca

SEQ ID NO: 14483 - DNA, 18 bp, Artificial sequence
  synthetic polynucleotide sequence
tagatctccagccgagga

SEQ ID NO: 14484 - DNA, 18 bp, Artificial sequence
  synthetic polynucleotide sequence
tagatctccagccgagga

SEQ ID NO: 14485 - DNA, 18 bp, Artificial sequence
  synthetic polynucleotide sequence
ccgaagactgcatcgcca

SEQ ID NO: 14486 - DNA, 18 bp, Artificial sequence
  synthetic polynucleotide sequence
ctgccaagacaggcacca

SEQ ID NO: 14487 - DNA, 18 bp, Artificial sequence
  synthetic polynucleotide sequence
gcccagcgttggagggaa

SEQ ID NO: 14488 - DNA, 18 bp, Artificial sequence
  synthetic polynucleotide sequence
acctgccactccgcccta

SEQ ID NO: 14489 - DNA, 18 bp, Artificial sequence
  synthetic polynucleotide sequence
cgtggtgaaccccaacga

SEQ ID NO: 14490 - DNA, 18 bp, Artificial sequence
  synthetic polynucleotide sequence
cagcgacgcgttgagaca

SEQ ID NO: 14491 - DNA, 18 bp, Artificial sequence
  synthetic polynucleotide sequence
gcaggcgcaaagcagcaa

SEQ ID NO: 14492 - DNA, 18 bp, Artificial sequence
  synthetic polynucleotide sequence
gagacggctttggcggga

SEQ ID NO: 14493 - DNA, 18 bp, Artificial sequence
  synthetic polynucleotide sequence
cctcccctgtcagaagga

SEQ ID NO: 14494 - DNA, 18 bp, Artificial sequence
  synthetic polynucleotide sequence
agcattcaggtggggaca

SEQ ID NO: 14495 - DNA, 18 bp, Artificial sequence
  synthetic polynucleotide sequence
ttgaccacacaggtgcca

SEQ ID NO: 14496 - DNA, 18 bp, Artificial sequence
  synthetic polynucleotide sequence
cctgcctggacgagcaga

SEQ ID NO: 14497 - DNA, 18 bp, Artificial sequence
  synthetic polynucleotide sequence
tggaaggcagtgagggca

SEQ ID NO: 14498 - DNA, 18 bp, Artificial sequence
  synthetic polynucleotide sequence
ctcatcctggagcccgga

SEQ ID NO: 14499 - DNA, 18 bp, Artificial sequence
  synthetic polynucleotide sequence
agcgcaaccactttggca

SEQ ID NO: 14500 - DNA, 18 bp, Artificial sequence
  synthetic polynucleotide sequence
accaagtagacctccaca

SEQ ID NO: 14501 - DNA, 18 bp, Artificial sequence
  synthetic polynucleotide sequence
gctgatctggcaagggga

SEQ ID NO: 14502 - DNA, 18 bp, Artificial sequence
  synthetic polynucleotide sequence
gctgatctggcaagggga

SEQ ID NO: 14503 - DNA, 18 bp, Artificial sequence
  synthetic polynucleotide sequence
gatccaggatgcccagca

SEQ ID NO: 14504 - DNA, 18 bp, Artificial sequence
  synthetic polynucleotide sequence
tggcgttgaagagccgga

SEQ ID NO: 14505 - DNA, 18 bp, Artificial sequence
  synthetic polynucleotide sequence
cctgaccaacggtgcaga

SEQ ID NO: 14506 - DNA, 18 bp, Artificial sequence
  synthetic polynucleotide sequence
ccgacgtaggacaccgga

SEQ ID NO: 14507 - DNA, 18 bp, Artificial sequence
  synthetic polynucleotide sequence
gccaccttaccccagtca

SEQ ID NO: 14508 - DNA, 18 bp, Artificial sequence
  synthetic polynucleotide sequence
gagcagtgagaggccgca

SEQ ID NO: 14509 - DNA, 18 bp, Artificial sequence
  synthetic polynucleotide sequence
gcagcctgcagctccgaa

SEQ ID NO: 14510 - DNA, 18 bp, Artificial sequence
  synthetic polynucleotide sequence
tgcaggtccagaagggca

SEQ ID NO: 14511 - DNA, 18 bp, Artificial sequence
  synthetic polynucleotide sequence
cagggagctggagaacca

SEQ ID NO: 14512 - DNA, 18 bp, Artificial sequence
  synthetic polynucleotide sequence
gttcatgccggacgggga

SEQ ID NO: 14513 - DNA, 21 bp, Artificial sequence
  synthetic polynucleotide sequence
gaagtggcagatagcagagga

SEQ ID NO: 14514 - DNA, 18 bp, Artificial sequence
  synthetic polynucleotide sequence
caccaaacagcagagcca

SEQ ID NO: 14515 - DNA, 18 bp, Artificial sequence
  synthetic polynucleotide sequence
cacactgggagggcgtga

SEQ ID NO: 14516 - DNA, 18 bp, Artificial sequence
  synthetic polynucleotide sequence
cctcggcaccctggccga

SEQ ID NO: 14517 - DNA, 18 bp, Artificial sequence
  synthetic polynucleotide sequence
ggaagaagcaccagggca

SEQ ID NO: 14518 - DNA, 18 bp, Artificial sequence
  synthetic polynucleotide sequence
ggcatcagccccgaggaa

SEQ ID NO: 14519 - DNA, 18 bp, Artificial sequence
  synthetic polynucleotide sequence
ggtttgcagacaggccca

SEQ ID NO: 14520 - DNA, 18 bp, Artificial sequence
  synthetic polynucleotide sequence
ggtttgcagacaggccca

SEQ ID NO: 14521 - DNA, 18 bp, Artificial sequence
  synthetic polynucleotide sequence
ggatatggccagcaacca

SEQ ID NO: 14522 - DNA, 18 bp, Artificial sequence
  synthetic polynucleotide sequence
ccaggttgagaggcagga

SEQ ID NO: 14523 - DNA, 18 bp, Artificial sequence
  synthetic polynucleotide sequence
gcctacatgcagccagga

SEQ ID NO: 14524 - DNA, 18 bp, Artificial sequence
  synthetic polynucleotide sequence
gcacagagctagcggcca

SEQ ID NO: 14525 - DNA, 18 bp, Artificial sequence
  synthetic polynucleotide sequence
cggtgggtgtcaccggaa

SEQ ID NO: 14526 - DNA, 18 bp, Artificial sequence
  synthetic polynucleotide sequence
ttggtgcgcagaagccca

SEQ ID NO: 14527 - DNA, 18 bp, Artificial sequence
  synthetic polynucleotide sequence
ggaggatgagggcagcca

SEQ ID NO: 14528 - DNA, 18 bp, Artificial sequence
  synthetic polynucleotide sequence
ggcgtccatcccgtggca

SEQ ID NO: 14529 - DNA, 18 bp, Artificial sequence
  synthetic polynucleotide sequence
ggcacgagcagctgcaga

SEQ ID NO: 14530 - DNA, 18 bp, Artificial sequence
  synthetic polynucleotide sequence
acgagcagaatacagcca

SEQ ID NO: 14531 - DNA, 18 bp, Artificial sequence
  synthetic polynucleotide sequence
aggtagactgagccgcca

SEQ ID NO: 14532 - DNA, 18 bp, Artificial sequence
  synthetic polynucleotide sequence
gggaatccggctgaggaa

SEQ ID NO: 14533 - DNA, 18 bp, Artificial sequence
  synthetic polynucleotide sequence
ggcagcagtgtatcagca

SEQ ID NO: 14534 - DNA, 18 bp, Artificial sequence
  synthetic polynucleotide sequence
gccagaagaagcaggcca

SEQ ID NO: 14535 - DNA, 18 bp, Artificial sequence
  synthetic polynucleotide sequence
ccgaggcagaagttggca

SEQ ID NO: 14536 - DNA, 18 bp, Artificial sequence
  synthetic polynucleotide sequence
gcttcagctccacggaga

SEQ ID NO: 14537 - DNA, 18 bp, Artificial sequence
  synthetic polynucleotide sequence
tacgggcatgctccagca

SEQ ID NO: 14538 - DNA, 18 bp, Artificial sequence
  synthetic polynucleotide sequence
tacgggcatgctccagca

SEQ ID NO: 14539 - DNA, 18 bp, Artificial sequence
  synthetic polynucleotide sequence
atctgcccacacggggca

SEQ ID NO: 14540 - DNA, 18 bp, Artificial sequence
  synthetic polynucleotide sequence
cccagatctccacggcca

SEQ ID NO: 14541 - DNA, 18 bp, Artificial sequence
  synthetic polynucleotide sequence
cagcctccagccaacaga

SEQ ID NO: 14542 - DNA, 18 bp, Artificial sequence
  synthetic polynucleotide sequence
acaggggctagtcgcaca

SEQ ID NO: 14543 - DNA, 18 bp, Artificial sequence
  synthetic polynucleotide sequence
aggactggcagtaagaca

SEQ ID NO: 14544 - DNA, 18 bp, Artificial sequence
  synthetic polynucleotide sequence
cgagaacttcaggggcca

SEQ ID NO: 14545 - DNA, 18 bp, Artificial sequence
  synthetic polynucleotide sequence
agcccagtgtgtggcaga

SEQ ID NO: 14546 - DNA, 18 bp, Artificial sequence
  synthetic polynucleotide sequence
agggagccgtcttcagga

SEQ ID NO: 14547 - DNA, 18 bp, Artificial sequence
  synthetic polynucleotide sequence
cctgctcaactccccaca

SEQ ID NO: 14548 - DNA, 18 bp, Artificial sequence
  synthetic polynucleotide sequence
ccacagaaccctcagaca

SEQ ID NO: 14549 - DNA, 18 bp, Artificial sequence
  synthetic polynucleotide sequence
cctgcagctcgtgcacca

SEQ ID NO: 14550 - DNA, 18 bp, Artificial sequence
  synthetic polynucleotide sequence
cagtggcaagggtgcaga

SEQ ID NO: 14551 - DNA, 18 bp, Artificial sequence
  synthetic polynucleotide sequence
ttgtcccacaccgaccga

SEQ ID NO: 14552 - DNA, 18 bp, Artificial sequence
  synthetic polynucleotide sequence
ccaaccctagggaggcca

SEQ ID NO: 14553 - DNA, 18 bp, Artificial sequence
  synthetic polynucleotide sequence
ggggcttgggagactcca

SEQ ID NO: 14554 - DNA, 18 bp, Artificial sequence
  synthetic polynucleotide sequence
gccgcttcactcaggcca

SEQ ID NO: 14555 - DNA, 18 bp, Artificial sequence
  synthetic polynucleotide sequence
cctggtcgcacaggcaca

SEQ ID NO: 14556 - DNA, 18 bp, Artificial sequence
  synthetic polynucleotide sequence
cctggtcgcacaggcaca

SEQ ID NO: 14557 - DNA, 18 bp, Artificial sequence
  synthetic polynucleotide sequence
gccgagaaggaggagaca

SEQ ID NO: 14558 - DNA, 18 bp, Artificial sequence
  synthetic polynucleotide sequence
acagagcaggaggcggca

SEQ ID NO: 14559 - DNA, 18 bp, Artificial sequence
  synthetic polynucleotide sequence
aggaacaggagcccagca

SEQ ID NO: 14560 - DNA, 18 bp, Artificial sequence
  synthetic polynucleotide sequence
cagggacattgtggcaga

SEQ ID NO: 14561 - DNA, 18 bp, Artificial sequence
  synthetic polynucleotide sequence
caaccttccaggcccaca

SEQ ID NO: 14562 - DNA, 18 bp, Artificial sequence
  synthetic polynucleotide sequence
tgcagcagagactgggca

SEQ ID NO: 14563 - DNA, 18 bp, Artificial sequence
  synthetic polynucleotide sequence
gcagccctaccaagacca

SEQ ID NO: 14564 - DNA, 18 bp, Artificial sequence
  synthetic polynucleotide sequence
cgctggatgcgtgaggca

SEQ ID NO: 14565 - DNA, 18 bp, Artificial sequence
  synthetic polynucleotide sequence
gctggacgtgatggagca

SEQ ID NO: 14566 - DNA, 18 bp, Artificial sequence
  synthetic polynucleotide sequence
gagcaatgacgtccagca

SEQ ID NO: 14567 - DNA, 16 bp, Artificial sequence
  synthetic polynucleotide sequence
ggcactggtactcgca

SEQ ID NO: 14568 - DNA, 18 bp, Artificial sequence
  synthetic polynucleotide sequence
cagcgctgtgtcaacaca

SEQ ID NO: 14569 - DNA, 18 bp, Artificial sequence
  synthetic polynucleotide sequence
cctacagcgagtccagga

SEQ ID NO: 14570 - DNA, 18 bp, Artificial sequence
  synthetic polynucleotide sequence
actcgtgcccaatcccga

SEQ ID NO: 14571 - DNA, 18 bp, Artificial sequence
  synthetic polynucleotide sequence
ggcaggcagtggaagcca

SEQ ID NO: 14572 - DNA, 18 bp, Artificial sequence
  synthetic polynucleotide sequence
ctgtgaggacctggacga

SEQ ID NO: 14573 - DNA, 18 bp, Artificial sequence
  synthetic polynucleotide sequence
attgggtaccaggcggca

SEQ ID NO: 14574 - DNA, 18 bp, Artificial sequence
  synthetic polynucleotide sequence
attgggtaccaggcggca

SEQ ID NO: 14575 - DNA, 18 bp, Artificial sequence
  synthetic polynucleotide sequence
ctgcccagagaacgcaga

SEQ ID NO: 14576 - DNA, 18 bp, Artificial sequence
  synthetic polynucleotide sequence
ctggttcaggaccaccca

SEQ ID NO: 14577 - DNA, 18 bp, Artificial sequence
  synthetic polynucleotide sequence
cccaaatggcagtcccca

SEQ ID NO: 14578 - DNA, 18 bp, Artificial sequence
  synthetic polynucleotide sequence
atctcggtcaggaacgca

SEQ ID NO: 14579 - DNA, 18 bp, Artificial sequence
  synthetic polynucleotide sequence
ccttacctggaaggacca

SEQ ID NO: 14580 - DNA, 18 bp, Artificial sequence
  synthetic polynucleotide sequence
cccccagccatcattgca

SEQ ID NO: 14581 - DNA, 18 bp, Artificial sequence
  synthetic polynucleotide sequence
cgtggcagtgaaccgcaa

SEQ ID NO: 14582 - DNA, 18 bp, Artificial sequence
  synthetic polynucleotide sequence
agagccagagagcagcca

SEQ ID NO: 14583 - DNA, 18 bp, Artificial sequence
  synthetic polynucleotide sequence
tgccacaggaagtgcaga

SEQ ID NO: 14584 - DNA, 18 bp, Artificial sequence
  synthetic polynucleotide sequence
ccgatgctgacgccagca

SEQ ID NO: 14585 - DNA, 18 bp, Artificial sequence
  synthetic polynucleotide sequence
tcctaagctgcgaccaga

SEQ ID NO: 14586 - DNA, 18 bp, Artificial sequence
  synthetic polynucleotide sequence
tggagtctcagacgccga

SEQ ID NO: 14587 - DNA, 18 bp, Artificial sequence
  synthetic polynucleotide sequence
catccagcagcacacaca

SEQ ID NO: 14588 - DNA, 18 bp, Artificial sequence
  synthetic polynucleotide sequence
cgaaaggggcacagccaa

SEQ ID NO: 14589 - DNA, 18 bp, Artificial sequence
  synthetic polynucleotide sequence
ggtgggcgttggagcaga

SEQ ID NO: 14590 - DNA, 18 bp, Artificial sequence
  synthetic polynucleotide sequence
aggctccctgccacccaa

SEQ ID NO: 14591 - DNA, 18 bp, Artificial sequence
  synthetic polynucleotide sequence
accgctcgggcatggaga

SEQ ID NO: 14592 - DNA, 18 bp, Artificial sequence
  synthetic polynucleotide sequence
accgctcgggcatggaga

SEQ ID NO: 14593 - DNA, 18 bp, Artificial sequence
  synthetic polynucleotide sequence
tgagcaggaggcagccaa

SEQ ID NO: 14594 - DNA, 18 bp, Artificial sequence
  synthetic polynucleotide sequence
aggcggagatcaacagga

SEQ ID NO: 14595 - DNA, 18 bp, Artificial sequence
  synthetic polynucleotide sequence
gggtggtgtcagacgcca

SEQ ID NO: 14596 - DNA, 18 bp, Artificial sequence
  synthetic polynucleotide sequence
caggcaagccccgggcga

SEQ ID NO: 14597 - DNA, 18 bp, Artificial sequence
  synthetic polynucleotide sequence
accgcagagacagaggaa

SEQ ID NO: 14598 - DNA, 18 bp, Artificial sequence
  synthetic polynucleotide sequence
ggaggctggagaagtgca

SEQ ID NO: 14599 - DNA, 18 bp, Artificial sequence
  synthetic polynucleotide sequence
ctcaccgagtggagcgaa

SEQ ID NO: 14600 - DNA, 18 bp, Artificial sequence
  synthetic polynucleotide sequence
ggtcatgcacaccaccga

SEQ ID NO: 14601 - DNA, 18 bp, Artificial sequence
  synthetic polynucleotide sequence
gcacctcaagcgtgccaa

SEQ ID NO: 14602 - DNA, 18 bp, Artificial sequence
  synthetic polynucleotide sequence
tgggtaagggctggcaca

SEQ ID NO: 14603 - DNA, 18 bp, Artificial sequence
  synthetic polynucleotide sequence
gagtcgctgacatcagca

SEQ ID NO: 14604 - DNA, 18 bp, Artificial sequence
  synthetic polynucleotide sequence
atagcgtgggcaatggca

SEQ ID NO: 14605 - DNA, 18 bp, Artificial sequence
  synthetic polynucleotide sequence
aggcggataagtagagga

SEQ ID NO: 14606 - DNA, 18 bp, Artificial sequence
  synthetic polynucleotide sequence
ccgtgagacaaagaagca

SEQ ID NO: 14607 - DNA, 18 bp, Artificial sequence
  synthetic polynucleotide sequence
ccttggggaggctgagca

SEQ ID NO: 14608 - DNA, 18 bp, Artificial sequence
  synthetic polynucleotide sequence
atggcaaatgggtggcaa

SEQ ID NO: 14609 - DNA, 18 bp, Artificial sequence
  synthetic polynucleotide sequence
cccccttcagtgcacaca

SEQ ID NO: 14610 - DNA, 18 bp, Artificial sequence
  synthetic polynucleotide sequence
cccccttcagtgcacaca

SEQ ID NO: 14611 - DNA, 18 bp, Artificial sequence
  synthetic polynucleotide sequence
gcaggacgccatagacca

SEQ ID NO: 14612 - DNA, 18 bp, Artificial sequence
  synthetic polynucleotide sequence
gtgcaggctcaggcgaca

SEQ ID NO: 14613 - DNA, 18 bp, Artificial sequence
  synthetic polynucleotide sequence
tgaagccctcagagtcca

SEQ ID NO: 14614 - DNA, 18 bp, Artificial sequence
  synthetic polynucleotide sequence
gcagacccatttacagca

SEQ ID NO: 14615 - DNA, 18 bp, Artificial sequence
  synthetic polynucleotide sequence
ccctctcagactccgaga

SEQ ID NO: 14616 - DNA, 18 bp, Artificial sequence
  synthetic polynucleotide sequence
gccacctgcacctccaca

SEQ ID NO: 14617 - DNA, 18 bp, Artificial sequence
  synthetic polynucleotide sequence
aggaggaatggagcccca

SEQ ID NO: 14618 - DNA, 18 bp, Artificial sequence
  synthetic polynucleotide sequence
gtcatgcagctcggcaca

SEQ ID NO: 14619 - DNA, 18 bp, Artificial sequence
  synthetic polynucleotide sequence
gcctgaggaagacagcga

SEQ ID NO: 14620 - DNA, 18 bp, Artificial sequence
  synthetic polynucleotide sequence
tggaacggcctgggagca

SEQ ID NO: 14621 - DNA, 18 bp, Artificial sequence
  synthetic polynucleotide sequence
tagagacacatcggtcca

SEQ ID NO: 14622 - DNA, 18 bp, Artificial sequence
  synthetic polynucleotide sequence
cagtgcctgccaccggaa

SEQ ID NO: 14623 - DNA, 18 bp, Artificial sequence
  synthetic polynucleotide sequence
ttgtccagggagccccca

SEQ ID NO: 14624 - DNA, 18 bp, Artificial sequence
  synthetic polynucleotide sequence
cgtggccaacgcgcagga

SEQ ID NO: 14625 - DNA, 18 bp, Artificial sequence
  synthetic polynucleotide sequence
gctcccgttaaggcacca

SEQ ID NO: 14626 - DNA, 18 bp, Artificial sequence
  synthetic polynucleotide sequence
agggctccacagttagga

SEQ ID NO: 14627 - DNA, 18 bp, Artificial sequence
  synthetic polynucleotide sequence
caagcggctggtgaggga

SEQ ID NO: 14628 - DNA, 18 bp, Artificial sequence
  synthetic polynucleotide sequence
caagcggctggtgaggga

SEQ ID NO: 14629 - DNA, 18 bp, Artificial sequence
  synthetic polynucleotide sequence
cgagcagcagaaggcgca

SEQ ID NO: 14630 - DNA, 18 bp, Artificial sequence
  synthetic polynucleotide sequence
gcggtctacacagctgga

SEQ ID NO: 14631 - DNA, 18 bp, Artificial sequence
  synthetic polynucleotide sequence
ctggcagccaaagcagga

SEQ ID NO: 14632 - DNA, 19 bp, Artificial sequence
  synthetic polynucleotide sequence
ggctactgctttcagggga

SEQ ID NO: 14633 - DNA, 18 bp, Artificial sequence
  synthetic polynucleotide sequence
gggcttcaccaagaccta

SEQ ID NO: 14634 - DNA, 18 bp, Artificial sequence
  synthetic polynucleotide sequence
tggctcccgaggcaggca

SEQ ID NO: 14635 - DNA, 18 bp, Artificial sequence
  synthetic polynucleotide sequence
gggacggcaagatgcaca

SEQ ID NO: 14636 - DNA, 18 bp, Artificial sequence
  synthetic polynucleotide sequence
gcacgggatcatggggca

SEQ ID NO: 14637 - DNA, 18 bp, Artificial sequence
  synthetic polynucleotide sequence
agaggtgggaccagctca

SEQ ID NO: 14638 - DNA, 18 bp, Artificial sequence
  synthetic polynucleotide sequence
ggagagcatgtcggtcca

SEQ ID NO: 14639 - DNA, 18 bp, Artificial sequence
  synthetic polynucleotide sequence
tggcagccacagttcaga

SEQ ID NO: 14640 - DNA, 18 bp, Artificial sequence
  synthetic polynucleotide sequence
catcgagccctgggagga

SEQ ID NO: 14641 - DNA, 18 bp, Artificial sequence
  synthetic polynucleotide sequence
agggcttggacagggcca

SEQ ID NO: 14642 - DNA, 18 bp, Artificial sequence
  synthetic polynucleotide sequence
tgatgcacagccgagcca

SEQ ID NO: 14643 - DNA, 18 bp, Artificial sequence
  synthetic polynucleotide sequence
agccaccccatgtccaca

SEQ ID NO: 14644 - DNA, 18 bp, Artificial sequence
  synthetic polynucleotide sequence
gcctcgaagctgcaggaa

SEQ ID NO: 14645 - DNA, 18 bp, Artificial sequence
  synthetic polynucleotide sequence
aacacgaggtcaagggaa

SEQ ID NO: 14646 - DNA, 18 bp, Artificial sequence
  synthetic polynucleotide sequence
aacacgaggtcaagggaa

SEQ ID NO: 14647 - DNA, 18 bp, Artificial sequence
  synthetic polynucleotide sequence
ctgcaactccgggatgca

SEQ ID NO: 14648 - DNA, 18 bp, Artificial sequence
  synthetic polynucleotide sequence
ggcccgacagcaggggga

SEQ ID NO: 14649 - DNA, 18 bp, Artificial sequence
  synthetic polynucleotide sequence
tctgccgggacaacagca

SEQ ID NO: 14650 - DNA, 18 bp, Artificial sequence
  synthetic polynucleotide sequence
cacagtgtggtaagcgca

SEQ ID NO: 14651 - DNA, 18 bp, Artificial sequence
  synthetic polynucleotide sequence
tgatgccgaggaggagga

SEQ ID NO: 14652 - DNA, 18 bp, Artificial sequence
  synthetic polynucleotide sequence
gtcccggtatcgggcaga

SEQ ID NO: 14653 - DNA, 18 bp, Artificial sequence
  synthetic polynucleotide sequence
ctgacctcagctgcgaca

SEQ ID NO: 14654 - DNA, 18 bp, Artificial sequence
  synthetic polynucleotide sequence
gccgagattctcccacga

SEQ ID NO: 14655 - DNA, 18 bp, Artificial sequence
  synthetic polynucleotide sequence
aggcatcgacgaggggca

SEQ ID NO: 14656 - DNA, 18 bp, Artificial sequence
  synthetic polynucleotide sequence
cttcccggaagcactcca

SEQ ID NO: 14657 - DNA, 18 bp, Artificial sequence
  synthetic polynucleotide sequence
ccagcatggtgagctgca

SEQ ID NO: 14658 - DNA, 18 bp, Artificial sequence
  synthetic polynucleotide sequence
gaaatgtccgtggccaca

SEQ ID NO: 14659 - DNA, 18 bp, Artificial sequence
  synthetic polynucleotide sequence
ccactactgcactggaca

SEQ ID NO: 14660 - DNA, 18 bp, Artificial sequence
  synthetic polynucleotide sequence
ccatcaagcccctggaca

SEQ ID NO: 14661 - DNA, 18 bp, Artificial sequence
  synthetic polynucleotide sequence
tcccgacactgccagcga

SEQ ID NO: 14662 - DNA, 18 bp, Artificial sequence
  synthetic polynucleotide sequence
caaggtggcatcggggaa

SEQ ID NO: 14663 - DNA, 18 bp, Artificial sequence
  synthetic polynucleotide sequence
cattgacaccgtggcgga

SEQ ID NO: 14664 - DNA, 18 bp, Artificial sequence
  synthetic polynucleotide sequence
cattgacaccgtggcgga

SEQ ID NO: 14665 - DNA, 18 bp, Artificial sequence
  synthetic polynucleotide sequence
gccacacagacggagcca

SEQ ID NO: 14666 - DNA, 18 bp, Artificial sequence
  synthetic polynucleotide sequence
acgtgcagcacctccaca

SEQ ID NO: 14667 - DNA, 18 bp, Artificial sequence
  synthetic polynucleotide sequence
ccgacagctacagcagca

SEQ ID NO: 14668 - DNA, 18 bp, Artificial sequence
  synthetic polynucleotide sequence
acttgccgcagtaggcga

SEQ ID NO: 14669 - DNA, 18 bp, Artificial sequence
  synthetic polynucleotide sequence
cccacgcatcaaggcaga

SEQ ID NO: 14670 - DNA, 18 bp, Artificial sequence
  synthetic polynucleotide sequence
gcagatcccacacagcga

SEQ ID NO: 14671 - DNA, 18 bp, Artificial sequence
  synthetic polynucleotide sequence
cagctggcaaatgaccca

SEQ ID NO: 14672 - DNA, 18 bp, Artificial sequence
  synthetic polynucleotide sequence
agaagggggtgtagggga

SEQ ID NO: 14673 - DNA, 18 bp, Artificial sequence
  synthetic polynucleotide sequence
ggcagtgcacagcacaga

SEQ ID NO: 14674 - DNA, 18 bp, Artificial sequence
  synthetic polynucleotide sequence
agccgtcctctgccacga

SEQ ID NO: 14675 - DNA, 18 bp, Artificial sequence
  synthetic polynucleotide sequence
ccttgcaagcccgaagca

SEQ ID NO: 14676 - DNA, 18 bp, Artificial sequence
  synthetic polynucleotide sequence
tcaccatggcaaccgcca

SEQ ID NO: 14677 - DNA, 18 bp, Artificial sequence
  synthetic polynucleotide sequence
aagctgccacatccagga

SEQ ID NO: 14678 - DNA, 18 bp, Artificial sequence
  synthetic polynucleotide sequence
cctcccaggatcaaggta

SEQ ID NO: 14679 - DNA, 18 bp, Artificial sequence
  synthetic polynucleotide sequence
aatacctgagacctgcca

SEQ ID NO: 14680 - DNA, 18 bp, Artificial sequence
  synthetic polynucleotide sequence
agccacaacgacactgga

SEQ ID NO: 14681 - DNA, 18 bp, Artificial sequence
  synthetic polynucleotide sequence
ccgtgagcaggatcagca

SEQ ID NO: 14682 - DNA, 18 bp, Artificial sequence
  synthetic polynucleotide sequence
ccgtgagcaggatcagca

SEQ ID NO: 14683 - DNA, 18 bp, Artificial sequence
  synthetic polynucleotide sequence
acaggccaggaatggaga

SEQ ID NO: 14684 - DNA, 18 bp, Artificial sequence
  synthetic polynucleotide sequence
aggcttgggaccaaggca

SEQ ID NO: 14685 - DNA, 18 bp, Artificial sequence
  synthetic polynucleotide sequence
gatcaaggaccagaggca

SEQ ID NO: 14686 - DNA, 18 bp, Artificial sequence
  synthetic polynucleotide sequence
tgcagccagcaagaagca

SEQ ID NO: 14687 - DNA, 18 bp, Artificial sequence
  synthetic polynucleotide sequence
tcccaggagaaaaccgca

SEQ ID NO: 14688 - DNA, 18 bp, Artificial sequence
  synthetic polynucleotide sequence
ctggtactgggacaagga

SEQ ID NO: 14689 - DNA, 18 bp, Artificial sequence
  synthetic polynucleotide sequence
tcggcgcagggccaggaa

SEQ ID NO: 14690 - DNA, 18 bp, Artificial sequence
  synthetic polynucleotide sequence
caccactcactctggaca

SEQ ID NO: 14691 - DNA, 18 bp, Artificial sequence
  synthetic polynucleotide sequence
ggagcacacaagggccaa

SEQ ID NO: 14692 - DNA, 18 bp, Artificial sequence
  synthetic polynucleotide sequence
tggccaccagctcagcca

SEQ ID NO: 14693 - DNA, 19 bp, Artificial sequence
  synthetic polynucleotide sequence
gtcaagcaactcgagacga

SEQ ID NO: 14694 - DNA, 19 bp, Artificial sequence
  synthetic polynucleotide sequence
gcacatcccaaatgaagca

SEQ ID NO: 14695 - DNA, 16 bp, Artificial sequence
  synthetic polynucleotide sequence
ggctgccatagaccga

SEQ ID NO: 14696 - DNA, 19 bp, Artificial sequence
  synthetic polynucleotide sequence
cagactgggtgtacaacga

SEQ ID NO: 14697 - DNA, 18 bp, Artificial sequence
  synthetic polynucleotide sequence
tgcacgcacagagggtca

SEQ ID NO: 14698 - DNA, 18 bp, Artificial sequence
  synthetic polynucleotide sequence
aggaacgggaggccgaga

SEQ ID NO: 14699 - DNA, 18 bp, Artificial sequence
  synthetic polynucleotide sequence
agggaggtgacagcggga

SEQ ID NO: 14700 - DNA, 18 bp, Artificial sequence
  synthetic polynucleotide sequence
agggaggtgacagcggga

SEQ ID NO: 14701 - DNA, 18 bp, Artificial sequence
  synthetic polynucleotide sequence
cggtcaggcctacagcga

SEQ ID NO: 14702 - DNA, 18 bp, Artificial sequence
  synthetic polynucleotide sequence
aaggtcctaggactggca

SEQ ID NO: 14703 - DNA, 18 bp, Artificial sequence
  synthetic polynucleotide sequence
ctgcacggtgcgggacca

SEQ ID NO: 14704 - DNA, 18 bp, Artificial sequence
  synthetic polynucleotide sequence
ccaggccaccgaagctga

SEQ ID NO: 14705 - DNA, 18 bp, Artificial sequence
  synthetic polynucleotide sequence
tgcacgatgcatcggaca

SEQ ID NO: 14706 - DNA, 18 bp, Artificial sequence
  synthetic polynucleotide sequence
tcatggccacagcagcca

SEQ ID NO: 14707 - DNA, 18 bp, Artificial sequence
  synthetic polynucleotide sequence
gagtccctgaagaagcaa

SEQ ID NO: 14708 - DNA, 18 bp, Artificial sequence
  synthetic polynucleotide sequence
taggccaagagctgagga

SEQ ID NO: 14709 - DNA, 18 bp, Artificial sequence
  synthetic polynucleotide sequence
accatctctacagccaca

SEQ ID NO: 14710 - DNA, 18 bp, Artificial sequence
  synthetic polynucleotide sequence
agggcaaggaccaagcca

SEQ ID NO: 14711 - DNA, 18 bp, Artificial sequence
  synthetic polynucleotide sequence
gccttcacctggggcaca

SEQ ID NO: 14712 - DNA, 18 bp, Artificial sequence
  synthetic polynucleotide sequence
ggacagaccaggactcca

SEQ ID NO: 14713 - DNA, 18 bp, Artificial sequence
  synthetic polynucleotide sequence
cgcttcatgaagaggcca

SEQ ID NO: 14714 - DNA, 18 bp, Artificial sequence
  synthetic polynucleotide sequence
tggaaccagaccctggca

SEQ ID NO: 14715 - DNA, 18 bp, Artificial sequence
  synthetic polynucleotide sequence
ccgtcagaagcagcagga

SEQ ID NO: 14716 - DNA, 18 bp, Artificial sequence
  synthetic polynucleotide sequence
ccggcagattggaggcga

SEQ ID NO: 14717 - DNA, 18 bp, Artificial sequence
  synthetic polynucleotide sequence
gcgacagcatcccaagca

SEQ ID NO: 14718 - DNA, 18 bp, Artificial sequence
  synthetic polynucleotide sequence
gcgacagcatcccaagca

SEQ ID NO: 14719 - DNA, 18 bp, Artificial sequence
  synthetic polynucleotide sequence
ggcggctgcaggggccta

SEQ ID NO: 14720 - DNA, 18 bp, Artificial sequence
  synthetic polynucleotide sequence
actccagggcagggccca

SEQ ID NO: 14721 - DNA, 18 bp, Artificial sequence
  synthetic polynucleotide sequence
acactcggagtcgccaga

SEQ ID NO: 14722 - DNA, 18 bp, Artificial sequence
  synthetic polynucleotide sequence
acagtctcccagcacgga

SEQ ID NO: 14723 - DNA, 18 bp, Artificial sequence
  synthetic polynucleotide sequence
ctaccctcccaacacgga

SEQ ID NO: 14724 - DNA, 18 bp, Artificial sequence
  synthetic polynucleotide sequence
cacggagttctcccagca

SEQ ID NO: 14725 - DNA, 18 bp, Artificial sequence
  synthetic polynucleotide sequence
ctatgagagggcacggga

SEQ ID NO: 14726 - DNA, 18 bp, Artificial sequence
  synthetic polynucleotide sequence
tggcgatggtggacacga

SEQ ID NO: 14727 - DNA, 18 bp, Artificial sequence
  synthetic polynucleotide sequence
tggagcgcagcatccaga

SEQ ID NO: 14728 - DNA, 18 bp, Artificial sequence
  synthetic polynucleotide sequence
cgccacgttgacagctga

SEQ ID NO: 14729 - DNA, 18 bp, Artificial sequence
  synthetic polynucleotide sequence
ccttgaagaagcgtcgca

SEQ ID NO: 14730 - DNA, 18 bp, Artificial sequence
  synthetic polynucleotide sequence
cgtgataccaacgagtca

SEQ ID NO: 14731 - DNA, 18 bp, Artificial sequence
  synthetic polynucleotide sequence
ccatccatgtgagcagca

SEQ ID NO: 14732 - DNA, 18 bp, Artificial sequence
  synthetic polynucleotide sequence
tggacatcgacgtggaga

SEQ ID NO: 14733 - DNA, 18 bp, Artificial sequence
  synthetic polynucleotide sequence
gcacctgactgaagctga

SEQ ID NO: 14734 - DNA, 18 bp, Artificial sequence
  synthetic polynucleotide sequence
gattgactcccagacgca

SEQ ID NO: 14735 - DNA, 18 bp, Artificial sequence
  synthetic polynucleotide sequence
catgctccccaacctgga

SEQ ID NO: 14736 - DNA, 18 bp, Artificial sequence
  synthetic polynucleotide sequence
catgctccccaacctgga

SEQ ID NO: 14737 - DNA, 18 bp, Artificial sequence
  synthetic polynucleotide sequence
ctggaagacatcctggaa

SEQ ID NO: 14738 - DNA, 18 bp, Artificial sequence
  synthetic polynucleotide sequence
gaatggctgacaccacca

SEQ ID NO: 14739 - DNA, 18 bp, Artificial sequence
  synthetic polynucleotide sequence
gggtgcaggctgctcgca

SEQ ID NO: 14740 - DNA, 18 bp, Artificial sequence
  synthetic polynucleotide sequence
caggaagctcgaaggtga

SEQ ID NO: 14741 - DNA, 18 bp, Artificial sequence
  synthetic polynucleotide sequence
gcatgggaagtgtgagca

SEQ ID NO: 14742 - DNA, 18 bp, Artificial sequence
  synthetic polynucleotide sequence
tgatgcagaggaccacca

SEQ ID NO: 14743 - DNA, 18 bp, Artificial sequence
  synthetic polynucleotide sequence
tgctacagggggtaccga

SEQ ID NO: 14744 - DNA, 18 bp, Artificial sequence
  synthetic polynucleotide sequence
actttccagcacaaggca

SEQ ID NO: 14745 - DNA, 18 bp, Artificial sequence
  synthetic polynucleotide sequence
tggaagcctgggacagca

SEQ ID NO: 14746 - DNA, 18 bp, Artificial sequence
  synthetic polynucleotide sequence
gatggccaggatcaccca

SEQ ID NO: 14747 - DNA, 18 bp, Artificial sequence
  synthetic polynucleotide sequence
gccgttagagcctggaga

SEQ ID NO: 14748 - DNA, 18 bp, Artificial sequence
  synthetic polynucleotide sequence
gtgaacagtgggcagtga

SEQ ID NO: 14749 - DNA, 18 bp, Artificial sequence
  synthetic polynucleotide sequence
tggacactgctgcaagca

SEQ ID NO: 14750 - DNA, 18 bp, Artificial sequence
  synthetic polynucleotide sequence
accagaggcgcaggagga

SEQ ID NO: 14751 - DNA, 18 bp, Artificial sequence
  synthetic polynucleotide sequence
ggagtctgaggcaactga

SEQ ID NO: 14752 - DNA, 18 bp, Artificial sequence
  synthetic polynucleotide sequence
cacacaactccagtgcta

SEQ ID NO: 14753 - DNA, 18 bp, Artificial sequence
  synthetic polynucleotide sequence
tgctgacgggactccaca

SEQ ID NO: 14754 - DNA, 18 bp, Artificial sequence
  synthetic polynucleotide sequence
tgctgacgggactccaca

SEQ ID NO: 14755 - DNA, 18 bp, Artificial sequence
  synthetic polynucleotide sequence
gaagtcaccggaccccaa

SEQ ID NO: 14756 - DNA, 18 bp, Artificial sequence
  synthetic polynucleotide sequence
ccctgctcactcacagca

SEQ ID NO: 14757 - DNA, 18 bp, Artificial sequence
  synthetic polynucleotide sequence
cgagtaccccaccaggaa

SEQ ID NO: 14758 - DNA, 18 bp, Artificial sequence
  synthetic polynucleotide sequence
cagtccccagggtccaga

SEQ ID NO: 14759 - DNA, 18 bp, Artificial sequence
  synthetic polynucleotide sequence
ggaatgaggacaccagca

SEQ ID NO: 14760 - DNA, 18 bp, Artificial sequence
  synthetic polynucleotide sequence
acacagccaggaagccca

SEQ ID NO: 14761 - DNA, 18 bp, Artificial sequence
  synthetic polynucleotide sequence
gatgcagaactgatgcca

SEQ ID NO: 14762 - DNA, 18 bp, Artificial sequence
  synthetic polynucleotide sequence
ttccacccctgcaagcga

SEQ ID NO: 14763 - DNA, 18 bp, Artificial sequence
  synthetic polynucleotide sequence
ccaggacttgccaagaca

SEQ ID NO: 14764 - DNA, 18 bp, Artificial sequence
  synthetic polynucleotide sequence
ccagaggagctacactga

SEQ ID NO: 14765 - DNA, 18 bp, Artificial sequence
  synthetic polynucleotide sequence
ccatgccgttgggcagga

SEQ ID NO: 14766 - DNA, 18 bp, Artificial sequence
  synthetic polynucleotide sequence
ggctgaaccgtaagccca

SEQ ID NO: 14767 - DNA, 18 bp, Artificial sequence
  synthetic polynucleotide sequence
cccagcgtcttgagcaga

SEQ ID NO: 14768 - DNA, 18 bp, Artificial sequence
  synthetic polynucleotide sequence
ggagcagctgcgaaggga

SEQ ID NO: 14769 - DNA, 18 bp, Artificial sequence
  synthetic polynucleotide sequence
cagcaatccaccaggtca

SEQ ID NO: 14770 - DNA, 18 bp, Artificial sequence
  synthetic polynucleotide sequence
taacagtggcactgagca

SEQ ID NO: 14771 - DNA, 18 bp, Artificial sequence
  synthetic polynucleotide sequence
gggtctgagatggccgga

SEQ ID NO: 14772 - DNA, 18 bp, Artificial sequence
  synthetic polynucleotide sequence
gggtctgagatggccgga

SEQ ID NO: 14773 - DNA, 18 bp, Artificial sequence
  synthetic polynucleotide sequence
ccaccacagtcatcccca

SEQ ID NO: 14774 - DNA, 18 bp, Artificial sequence
  synthetic polynucleotide sequence
gaccctcatcagggctca

SEQ ID NO: 14775 - DNA, 18 bp, Artificial sequence
  synthetic polynucleotide sequence
agtggatggacccagaca

SEQ ID NO: 14776 - DNA, 18 bp, Artificial sequence
  synthetic polynucleotide sequence
tccacctgctagagccca

SEQ ID NO: 14777 - DNA, 18 bp, Artificial sequence
  synthetic polynucleotide sequence
acgccacccccttgcaga

SEQ ID NO: 14778 - DNA, 18 bp, Artificial sequence
  synthetic polynucleotide sequence
caggggcatctgccagga

SEQ ID NO: 14779 - DNA, 18 bp, Artificial sequence
  synthetic polynucleotide sequence
acaacagtgcctgccgca

SEQ ID NO: 14780 - DNA, 18 bp, Artificial sequence
  synthetic polynucleotide sequence
tccagacacccaagagca

SEQ ID NO: 14781 - DNA, 18 bp, Artificial sequence
  synthetic polynucleotide sequence
acagatggatgcggcgaa

SEQ ID NO: 14782 - DNA, 18 bp, Artificial sequence
  synthetic polynucleotide sequence
acagccaggaacagggca

SEQ ID NO: 14783 - DNA, 18 bp, Artificial sequence
  synthetic polynucleotide sequence
tccaagaaggcaccccca

SEQ ID NO: 14784 - DNA, 18 bp, Artificial sequence
  synthetic polynucleotide sequence
ggaggaagccacttgtca

SEQ ID NO: 14785 - DNA, 18 bp, Artificial sequence
  synthetic polynucleotide sequence
cgatcccaatgcacgcga

SEQ ID NO: 14786 - DNA, 18 bp, Artificial sequence
  synthetic polynucleotide sequence
ccgagagcacaagccgca

SEQ ID NO: 14787 - DNA, 18 bp, Artificial sequence
  synthetic polynucleotide sequence
gacccaccacagaggcga

SEQ ID NO: 14788 - DNA, 18 bp, Artificial sequence
  synthetic polynucleotide sequence
taaacggatcacccgcaa

SEQ ID NO: 14789 - DNA, 18 bp, Artificial sequence
  synthetic polynucleotide sequence
agagcccattgctcagga

SEQ ID NO: 14790 - DNA, 18 bp, Artificial sequence
  synthetic polynucleotide sequence
agagcccattgctcagga

SEQ ID NO: 14791 - DNA, 18 bp, Artificial sequence
  synthetic polynucleotide sequence
ccctgggaccctggagca

SEQ ID NO: 14792 - DNA, 18 bp, Artificial sequence
  synthetic polynucleotide sequence
cactcctgtgcggcagca

SEQ ID NO: 14793 - DNA, 18 bp, Artificial sequence
  synthetic polynucleotide sequence
atcgaccaggatgggcca

SEQ ID NO: 14794 - DNA, 18 bp, Artificial sequence
  synthetic polynucleotide sequence
cttccacccgggtagcca

SEQ ID NO: 14795 - DNA, 18 bp, Artificial sequence
  synthetic polynucleotide sequence
gctcatccccaagtggca

SEQ ID NO: 14796 - DNA, 18 bp, Artificial sequence
  synthetic polynucleotide sequence
tccagagggaggggagga

SEQ ID NO: 14797 - DNA, 18 bp, Artificial sequence
  synthetic polynucleotide sequence
gacaacctggaagaacga

SEQ ID NO: 14798 - DNA, 18 bp, Artificial sequence
  synthetic polynucleotide sequence
gctgcagtacgcatccaa

SEQ ID NO: 14799 - DNA, 18 bp, Artificial sequence
  synthetic polynucleotide sequence
attccagcacacccagca

SEQ ID NO: 14800 - DNA, 18 bp, Artificial sequence
  synthetic polynucleotide sequence
gccaatgacccaacgcca

SEQ ID NO: 14801 - DNA, 18 bp, Artificial sequence
  synthetic polynucleotide sequence
tgtggtgagaggcaccca

SEQ ID NO: 14802 - DNA, 18 bp, Artificial sequence
  synthetic polynucleotide sequence
tgccaaggaagccagaga

SEQ ID NO: 14803 - DNA, 18 bp, Artificial sequence
  synthetic polynucleotide sequence
agatatctgccacaccca

SEQ ID NO: 14804 - DNA, 18 bp, Artificial sequence
  synthetic polynucleotide sequence
tggcatggctggggagca

SEQ ID NO: 14805 - DNA, 20 bp, Artificial sequence
  synthetic polynucleotide sequence
cgaaaagccaaatgcgagca

SEQ ID NO: 14806 - DNA, 22 bp, Artificial sequence
  synthetic polynucleotide sequence
gcagctgttatttatcccacca

SEQ ID NO: 14807 - DNA, 18 bp, Artificial sequence
  synthetic polynucleotide sequence
cccgaggccccaaggaga

SEQ ID NO: 14808 - DNA, 18 bp, Artificial sequence
  synthetic polynucleotide sequence
cccgaggccccaaggaga

SEQ ID NO: 14809 - DNA, 18 bp, Artificial sequence
  synthetic polynucleotide sequence
ccttcgaccccacacgca

SEQ ID NO: 14810 - DNA, 18 bp, Artificial sequence
  synthetic polynucleotide sequence
agggcctcagctccagca

SEQ ID NO: 14811 - DNA, 21 bp, Artificial sequence
  synthetic polynucleotide sequence
ggaactcaagggtagtatcca

SEQ ID NO: 14812 - DNA, 17 bp, Artificial sequence
  synthetic polynucleotide sequence
gcatacagggacgcaca

SEQ ID NO: 14813 - DNA, 18 bp, Artificial sequence
  synthetic polynucleotide sequence
gaagaggagttgtacgca

SEQ ID NO: 14814 - DNA, 18 bp, Artificial sequence
  synthetic polynucleotide sequence
tcagcgaatggcagctga

SEQ ID NO: 14815 - DNA, 18 bp, Artificial sequence
  synthetic polynucleotide sequence
gcaacatacggcacccta

SEQ ID NO: 14816 - DNA, 18 bp, Artificial sequence
  synthetic polynucleotide sequence
tgagaacaggtgtcagca

SEQ ID NO: 14817 - DNA, 18 bp, Artificial sequence
  synthetic polynucleotide sequence
ggaccagggttctggaca

SEQ ID NO: 14818 - DNA, 18 bp, Artificial sequence
  synthetic polynucleotide sequence
gcctccatgaaggggtga

SEQ ID NO: 14819 - DNA, 18 bp, Artificial sequence
  synthetic polynucleotide sequence
aacagctagcccacccaa

SEQ ID NO: 14820 - DNA, 18 bp, Artificial sequence
  synthetic polynucleotide sequence
caaagatgccaacagcca

SEQ ID NO: 14821 - DNA, 18 bp, Artificial sequence
  synthetic polynucleotide sequence
ccgtactccagccggcta

SEQ ID NO: 14822 - DNA, 18 bp, Artificial sequence
  synthetic polynucleotide sequence
agcccgtgggcggtcgaa

SEQ ID NO: 14823 - DNA, 18 bp, Artificial sequence
  synthetic polynucleotide sequence
tctccagtagcaggcaga

SEQ ID NO: 14824 - DNA, 18 bp, Artificial sequence
  synthetic polynucleotide sequence
acttggcaagatgcacca

SEQ ID NO: 14825 - DNA, 18 bp, Artificial sequence
  synthetic polynucleotide sequence
ggcagcaggaagcccaca

SEQ ID NO: 14826 - DNA, 18 bp, Artificial sequence
  synthetic polynucleotide sequence
ggcagcaggaagcccaca

SEQ ID NO: 14827 - DNA, 18 bp, Artificial sequence
  synthetic polynucleotide sequence
cgagtgcaggtacgagga

SEQ ID NO: 14828 - DNA, 18 bp, Artificial sequence
  synthetic polynucleotide sequence
ggatcagagggtccacca

SEQ ID NO: 14829 - DNA, 18 bp, Artificial sequence
  synthetic polynucleotide sequence
agcgctgcttcccaggaa

SEQ ID NO: 14830 - DNA, 18 bp, Artificial sequence
  synthetic polynucleotide sequence
actccaccaggaggctca

SEQ ID NO: 14831 - DNA, 18 bp, Artificial sequence
  synthetic polynucleotide sequence
ctgctacaggagccccca

SEQ ID NO: 14832 - DNA, 18 bp, Artificial sequence
  synthetic polynucleotide sequence
aggaaggcatacgttgca

SEQ ID NO: 14833 - DNA, 18 bp, Artificial sequence
  synthetic polynucleotide sequence
agaggaggggagagtgga

SEQ ID NO: 14834 - DNA, 18 bp, Artificial sequence
  synthetic polynucleotide sequence
aacattcagcaccaccga

SEQ ID NO: 14835 - DNA, 18 bp, Artificial sequence
  synthetic polynucleotide sequence
cagctgccagcaaaggga

SEQ ID NO: 14836 - DNA, 18 bp, Artificial sequence
  synthetic polynucleotide sequence
ggccggttgcgggaagga

SEQ ID NO: 14837 - DNA, 18 bp, Artificial sequence
  synthetic polynucleotide sequence
gccggttgcgagccgtga

SEQ ID NO: 14838 - DNA, 18 bp, Artificial sequence
  synthetic polynucleotide sequence
cggtcctgacaaaagaca

SEQ ID NO: 14839 - DNA, 18 bp, Artificial sequence
  synthetic polynucleotide sequence
caccctgacatgcgtcca

SEQ ID NO: 14840 - DNA, 18 bp, Artificial sequence
  synthetic polynucleotide sequence
tggccacacagttccaga

SEQ ID NO: 14841 - DNA, 18 bp, Artificial sequence
  synthetic polynucleotide sequence
caatcacagctgtccaca

SEQ ID NO: 14842 - DNA, 18 bp, Artificial sequence
  synthetic polynucleotide sequence
gagaggtgggtcctcaca

SEQ ID NO: 14843 - DNA, 18 bp, Artificial sequence
  synthetic polynucleotide sequence
ctgcaggaagccggcaca

SEQ ID NO: 14844 - DNA, 18 bp, Artificial sequence
  synthetic polynucleotide sequence
ctgcaggaagccggcaca

SEQ ID NO: 14845 - DNA, 18 bp, Artificial sequence
  synthetic polynucleotide sequence
gatctgcaaccacaggga

SEQ ID NO: 14846 - DNA, 18 bp, Artificial sequence
  synthetic polynucleotide sequence
tggcagctgtccacgcca

SEQ ID NO: 14847 - DNA, 18 bp, Artificial sequence
  synthetic polynucleotide sequence
gaggccagcgctgaggaa

SEQ ID NO: 14848 - DNA, 18 bp, Artificial sequence
  synthetic polynucleotide sequence
atgcccaaggctccagca

SEQ ID NO: 14849 - DNA, 18 bp, Artificial sequence
  synthetic polynucleotide sequence
ccacgaagaggacagcca

SEQ ID NO: 14850 - DNA, 18 bp, Artificial sequence
  synthetic polynucleotide sequence
ccagcccgtaatccagca

SEQ ID NO: 14851 - DNA, 18 bp, Artificial sequence
  synthetic polynucleotide sequence
acagcctcctcacccgca

SEQ ID NO: 14852 - DNA, 18 bp, Artificial sequence
  synthetic polynucleotide sequence
ttgagcagaggcacagca

SEQ ID NO: 14853 - DNA, 18 bp, Artificial sequence
  synthetic polynucleotide sequence
acacccagaccctgggca

SEQ ID NO: 14854 - DNA, 18 bp, Artificial sequence
  synthetic polynucleotide sequence
ggatctggcagtaccaga

SEQ ID NO: 14855 - DNA, 18 bp, Artificial sequence
  synthetic polynucleotide sequence
ttcagggcacccacggta

SEQ ID NO: 14856 - DNA, 18 bp, Artificial sequence
  synthetic polynucleotide sequence
ccccctgagatctgagga

SEQ ID NO: 14857 - DNA, 18 bp, Artificial sequence
  synthetic polynucleotide sequence
atgatccccacactggca

SEQ ID NO: 14858 - DNA, 18 bp, Artificial sequence
  synthetic polynucleotide sequence
gctatcagggtccaagga

SEQ ID NO: 14859 - DNA, 18 bp, Artificial sequence
  synthetic polynucleotide sequence
tggccacaccatggcgca

SEQ ID NO: 14860 - DNA, 18 bp, Artificial sequence
  synthetic polynucleotide sequence
ctgcggctctgcgccaca

SEQ ID NO: 14861 - DNA, 18 bp, Artificial sequence
  synthetic polynucleotide sequence
taacggcggaatatccca

SEQ ID NO: 14862 - DNA, 18 bp, Artificial sequence
  synthetic polynucleotide sequence
taacggcggaatatccca

SEQ ID NO: 14863 - DNA, 18 bp, Artificial sequence
  synthetic polynucleotide sequence
gggtacagtgggacagca

SEQ ID NO: 14864 - DNA, 18 bp, Artificial sequence
  synthetic polynucleotide sequence
gcccttccagtggaacca

SEQ ID NO: 14865 - DNA, 18 bp, Artificial sequence
  synthetic polynucleotide sequence
aatggcgtggagctgaga

SEQ ID NO: 14866 - DNA, 18 bp, Artificial sequence
  synthetic polynucleotide sequence
gaggagcacatgggtgga

SEQ ID NO: 14867 - DNA, 18 bp, Artificial sequence
  synthetic polynucleotide sequence
caagacggccgagcagca

SEQ ID NO: 14868 - DNA, 16 bp, Artificial sequence
  synthetic polynucleotide sequence
ggccagcgtagggaga

SEQ ID NO: 14869 - DNA, 18 bp, Artificial sequence
  synthetic polynucleotide sequence
atcgagccagcgcagaga

SEQ ID NO: 14870 - DNA, 18 bp, Artificial sequence
  synthetic polynucleotide sequence
gctgacactccatgcaga

SEQ ID NO: 14871 - DNA, 18 bp, Artificial sequence
  synthetic polynucleotide sequence
tgtgaagccagggcccaa

SEQ ID NO: 14872 - DNA, 18 bp, Artificial sequence
  synthetic polynucleotide sequence
gtagcaataggcatccca

SEQ ID NO: 14873 - DNA, 18 bp, Artificial sequence
  synthetic polynucleotide sequence
tctccaaggcatccagca

SEQ ID NO: 14874 - DNA, 18 bp, Artificial sequence
  synthetic polynucleotide sequence
tacagcaggcccagggga

SEQ ID NO: 14875 - DNA, 18 bp, Artificial sequence
  synthetic polynucleotide sequence
catgagcggctcccagga

SEQ ID NO: 14876 - DNA, 18 bp, Artificial sequence
  synthetic polynucleotide sequence
aggagccagcagagccaa

SEQ ID NO: 14877 - DNA, 18 bp, Artificial sequence
  synthetic polynucleotide sequence
acagtggcattggcacca

SEQ ID NO: 14878 - DNA, 18 bp, Artificial sequence
  synthetic polynucleotide sequence
cggaatgaaaactcccca

SEQ ID NO: 14879 - DNA, 18 bp, Artificial sequence
  synthetic polynucleotide sequence
agacctgggtgggctgca

SEQ ID NO: 14880 - DNA, 18 bp, Artificial sequence
  synthetic polynucleotide sequence
agacctgggtgggctgca

SEQ ID NO: 14881 - DNA, 18 bp, Artificial sequence
  synthetic polynucleotide sequence
ctgcacaggctgccggaa

SEQ ID NO: 14882 - DNA, 18 bp, Artificial sequence
  synthetic polynucleotide sequence
agcctcccatcagcccca

SEQ ID NO: 14883 - DNA, 18 bp, Artificial sequence
  synthetic polynucleotide sequence
ctggaaccccagagcgaa

SEQ ID NO: 14884 - DNA, 18 bp, Artificial sequence
  synthetic polynucleotide sequence
tgagttagcaggagacca

SEQ ID NO: 14885 - DNA, 18 bp, Artificial sequence
  synthetic polynucleotide sequence
ggcgcgaccgcacagcga

SEQ ID NO: 14886 - DNA, 18 bp, Artificial sequence
  synthetic polynucleotide sequence
aagcagccccagcacgaa

SEQ ID NO: 14887 - DNA, 18 bp, Artificial sequence
  synthetic polynucleotide sequence
acgcgatggaagccggca

SEQ ID NO: 14888 - DNA, 18 bp, Artificial sequence
  synthetic polynucleotide sequence
gtgggcaaggctgcagga

SEQ ID NO: 14889 - DNA, 18 bp, Artificial sequence
  synthetic polynucleotide sequence
agcccctggacaaggtca

SEQ ID NO: 14890 - DNA, 18 bp, Artificial sequence
  synthetic polynucleotide sequence
ccaggaggaggccaggca

SEQ ID NO: 14891 - DNA, 18 bp, Artificial sequence
  synthetic polynucleotide sequence
aggccattgaggtgggca

SEQ ID NO: 14892 - DNA, 18 bp, Artificial sequence
  synthetic polynucleotide sequence
aaggaggacgagtaccca

SEQ ID NO: 14893 - DNA, 18 bp, Artificial sequence
  synthetic polynucleotide sequence
cactcaaagcagctggca

SEQ ID NO: 14894 - DNA, 18 bp, Artificial sequence
  synthetic polynucleotide sequence
gcatcaagagcaaaccga

SEQ ID NO: 14895 - DNA, 18 bp, Artificial sequence
  synthetic polynucleotide sequence
gcggcacctccagcagca

SEQ ID NO: 14896 - DNA, 18 bp, Artificial sequence
  synthetic polynucleotide sequence
cccagcttggactgcaca

SEQ ID NO: 14897 - DNA, 18 bp, Artificial sequence
  synthetic polynucleotide sequence
tgaaggtggaactgggca

SEQ ID NO: 14898 - DNA, 18 bp, Artificial sequence
  synthetic polynucleotide sequence
tgaaggtggaactgggca

SEQ ID NO: 14899 - DNA, 17 bp, Artificial sequence
  synthetic polynucleotide sequence
catgggacccaggtcaa

SEQ ID NO: 14900 - DNA, 18 bp, Artificial sequence
  synthetic polynucleotide sequence
cctccttggagaagggga

SEQ ID NO: 14901 - DNA, 18 bp, Artificial sequence
  synthetic polynucleotide sequence
agaagtccagcacgccca

SEQ ID NO: 14902 - DNA, 18 bp, Artificial sequence
  synthetic polynucleotide sequence
cggatactgcacaccaca

SEQ ID NO: 14903 - DNA, 18 bp, Artificial sequence
  synthetic polynucleotide sequence
ccttggacagcgcccaca

SEQ ID NO: 14904 - DNA, 18 bp, Artificial sequence
  synthetic polynucleotide sequence
atgtcacctgcgggcaga

SEQ ID NO: 14905 - DNA, 19 bp, Artificial sequence
  synthetic polynucleotide sequence
gaagtgggagtgagcggaa

SEQ ID NO: 14906 - DNA, 17 bp, Artificial sequence
  synthetic polynucleotide sequence
gggcacagtcaactcca

SEQ ID NO: 14907 - DNA, 18 bp, Artificial sequence
  synthetic polynucleotide sequence
agagcagtgccagcccca

SEQ ID NO: 14908 - DNA, 18 bp, Artificial sequence
  synthetic polynucleotide sequence
gtgctgagggggaagcca

SEQ ID NO: 14909 - DNA, 18 bp, Artificial sequence
  synthetic polynucleotide sequence
taggggacacagcgggca

SEQ ID NO: 14910 - DNA, 18 bp, Artificial sequence
  synthetic polynucleotide sequence
actgacgagggctcccga

SEQ ID NO: 14911 - DNA, 19 bp, Artificial sequence
  synthetic polynucleotide sequence
cagcaggaagagcaacgca

SEQ ID NO: 14912 - DNA, 18 bp, Artificial sequence
  synthetic polynucleotide sequence
tgggacgaaggagaggga

SEQ ID NO: 14913 - DNA, 18 bp, Artificial sequence
  synthetic polynucleotide sequence
gttacagccacacagaga

SEQ ID NO: 14914 - DNA, 18 bp, Artificial sequence
  synthetic polynucleotide sequence
gacccagcctgggacaga

SEQ ID NO: 14915 - DNA, 18 bp, Artificial sequence
  synthetic polynucleotide sequence
tggtaccaagaggacaga

SEQ ID NO: 14916 - DNA, 18 bp, Artificial sequence
  synthetic polynucleotide sequence
tggtaccaagaggacaga

SEQ ID NO: 14917 - DNA, 18 bp, Artificial sequence
  synthetic polynucleotide sequence
tctcagccactgcggcga

SEQ ID NO: 14918 - DNA, 18 bp, Artificial sequence
  synthetic polynucleotide sequence
gtccgaagtaggtgagga

SEQ ID NO: 14919 - DNA, 18 bp, Artificial sequence
  synthetic polynucleotide sequence
ggtgtctcgagaaggcca

SEQ ID NO: 14920 - DNA, 18 bp, Artificial sequence
  synthetic polynucleotide sequence
gacacctgcgctatagca

SEQ ID NO: 14921 - DNA, 18 bp, Artificial sequence
  synthetic polynucleotide sequence
gaggtgatgtggcaacca

SEQ ID NO: 14922 - DNA, 18 bp, Artificial sequence
  synthetic polynucleotide sequence
tctcgagacaccacctga

SEQ ID NO: 14923 - DNA, 18 bp, Artificial sequence
  synthetic polynucleotide sequence
caggagaaggcaactcca

SEQ ID NO: 14924 - DNA, 18 bp, Artificial sequence
  synthetic polynucleotide sequence
aagctgagaagccatgga

SEQ ID NO: 14925 - DNA, 18 bp, Artificial sequence
  synthetic polynucleotide sequence
accccgctaccccgagga

SEQ ID NO: 14926 - DNA, 18 bp, Artificial sequence
  synthetic polynucleotide sequence
accgggtaccatcacgca

SEQ ID NO: 14927 - DNA, 19 bp, Artificial sequence
  synthetic polynucleotide sequence
cacggaatgtgacctggga

SEQ ID NO: 14928 - DNA, 19 bp, Artificial sequence
  synthetic polynucleotide sequence
gacaaactcccacacagca

SEQ ID NO: 14929 - DNA, 18 bp, Artificial sequence
  synthetic polynucleotide sequence
ggtgtccccaacatgcaa

SEQ ID NO: 14930 - DNA, 18 bp, Artificial sequence
  synthetic polynucleotide sequence
caagtggctcccaatgca

SEQ ID NO: 14931 - DNA, 18 bp, Artificial sequence
  synthetic polynucleotide sequence
gaagagcagagaagtgca

SEQ ID NO: 14932 - DNA, 18 bp, Artificial sequence
  synthetic polynucleotide sequence
atgtgggaaatgcagcca

SEQ ID NO: 14933 - DNA, 18 bp, Artificial sequence
  synthetic polynucleotide sequence
cacttggaggtaggccca

SEQ ID NO: 14934 - DNA, 18 bp, Artificial sequence
  synthetic polynucleotide sequence
cacttggaggtaggccca

SEQ ID NO: 14935 - DNA, 18 bp, Artificial sequence
  synthetic polynucleotide sequence
gcgctgcacctgcagcca

SEQ ID NO: 14936 - DNA, 18 bp, Artificial sequence
  synthetic polynucleotide sequence
tgtgaagatggacgccca

SEQ ID NO: 14937 - DNA, 18 bp, Artificial sequence
  synthetic polynucleotide sequence
ccggtccatgaagcagca

SEQ ID NO: 14938 - DNA, 18 bp, Artificial sequence
  synthetic polynucleotide sequence
tggacttggccaggagga

SEQ ID NO: 14939 - DNA, 18 bp, Artificial sequence
  synthetic polynucleotide sequence
gcccgagctgatgaggaa

SEQ ID NO: 14940 - DNA, 18 bp, Artificial sequence
  synthetic polynucleotide sequence
gcatctgcacccgctcca

SEQ ID NO: 14941 - DNA, 18 bp, Artificial sequence
  synthetic polynucleotide sequence
ctgaagcagcaggtgcaa

SEQ ID NO: 14942 - DNA, 18 bp, Artificial sequence
  synthetic polynucleotide sequence
gcagttacagggtgggca

SEQ ID NO: 14943 - DNA, 18 bp, Artificial sequence
  synthetic polynucleotide sequence
tgcagccgaaagagccca

SEQ ID NO: 14944 - DNA, 18 bp, Artificial sequence
  synthetic polynucleotide sequence
actcagcaggaggcggca

SEQ ID NO: 14945 - DNA, 17 bp, Artificial sequence
  synthetic polynucleotide sequence
ggagatgcagcagcaca

SEQ ID NO: 14946 - DNA, 18 bp, Artificial sequence
  synthetic polynucleotide sequence
gctgcaagctgcacgaga

SEQ ID NO: 14947 - DNA, 18 bp, Artificial sequence
  synthetic polynucleotide sequence
tacagaccactggcggca

SEQ ID NO: 14948 - DNA, 18 bp, Artificial sequence
  synthetic polynucleotide sequence
tccaccaccctctccaca

SEQ ID NO: 14949 - DNA, 18 bp, Artificial sequence
  synthetic polynucleotide sequence
catgcggaagaggtcaga

SEQ ID NO: 14950 - DNA, 18 bp, Artificial sequence
  synthetic polynucleotide sequence
aggtggacgaggacggca

SEQ ID NO: 14951 - DNA, 18 bp, Artificial sequence
  synthetic polynucleotide sequence
cctgtcgaagatgcggaa

SEQ ID NO: 14952 - DNA, 18 bp, Artificial sequence
  synthetic polynucleotide sequence
cctgtcgaagatgcggaa

SEQ ID NO: 14953 - DNA, 18 bp, Artificial sequence
  synthetic polynucleotide sequence
gatggacctccgtgggaa

SEQ ID NO: 14954 - DNA, 18 bp, Artificial sequence
  synthetic polynucleotide sequence
tgccagacatggcctcca

SEQ ID NO: 14955 - DNA, 18 bp, Artificial sequence
  synthetic polynucleotide sequence
ggtgcagaagaccagcaa

SEQ ID NO: 14956 - DNA, 18 bp, Artificial sequence
  synthetic polynucleotide sequence
agggccttgagcatggca

SEQ ID NO: 14957 - DNA, 18 bp, Artificial sequence
  synthetic polynucleotide sequence
ccgtgtggacaaggtgga

SEQ ID NO: 14958 - DNA, 18 bp, Artificial sequence
  synthetic polynucleotide sequence
cccccagcagcgcctgca

SEQ ID NO: 14959 - DNA, 18 bp, Artificial sequence
  synthetic polynucleotide sequence
agcgtggtaagcggcaga

SEQ ID NO: 14960 - DNA, 18 bp, Artificial sequence
  synthetic polynucleotide sequence
ggtggatccagtccgaca

SEQ ID NO: 14961 - DNA, 18 bp, Artificial sequence
  synthetic polynucleotide sequence
ctgagaccgaggagacca

SEQ ID NO: 14962 - DNA, 18 bp, Artificial sequence
  synthetic polynucleotide sequence
gaggcaccaagttgggca

SEQ ID NO: 14963 - DNA, 18 bp, Artificial sequence
  synthetic polynucleotide sequence
tgagggcctggagctcca

SEQ ID NO: 14964 - DNA, 18 bp, Artificial sequence
  synthetic polynucleotide sequence
ccaggaggaagctgcaga

SEQ ID NO: 14965 - DNA, 17 bp, Artificial sequence
  synthetic polynucleotide sequence
gggagcggtaattgcga

SEQ ID NO: 14966 - DNA, 18 bp, Artificial sequence
  synthetic polynucleotide sequence
aggaggagcaagagccga

SEQ ID NO: 14967 - DNA, 18 bp, Artificial sequence
  synthetic polynucleotide sequence
aggtcacctaacagggca

SEQ ID NO: 14968 - DNA, 18 bp, Artificial sequence
  synthetic polynucleotide sequence
aacagctggtagcccgaa

SEQ ID NO: 14969 - DNA, 18 bp, Artificial sequence
  synthetic polynucleotide sequence
ctgcaccagggtgacaca

SEQ ID NO: 14970 - DNA, 18 bp, Artificial sequence
  synthetic polynucleotide sequence
ctgcaccagggtgacaca

SEQ ID NO: 14971 - DNA, 18 bp, Artificial sequence
  synthetic polynucleotide sequence
ggatgccaccaagaggca

SEQ ID NO: 14972 - DNA, 18 bp, Artificial sequence
  synthetic polynucleotide sequence
gtggtgatggagcccaca

SEQ ID NO: 14973 - DNA, 18 bp, Artificial sequence
  synthetic polynucleotide sequence
tctccctggagcagcaca

SEQ ID NO: 14974 - DNA, 18 bp, Artificial sequence
  synthetic polynucleotide sequence
ggccatgctgcatgcaga

SEQ ID NO: 14975 - DNA, 18 bp, Artificial sequence
  synthetic polynucleotide sequence
gccttgccagagaagcga

SEQ ID NO: 14976 - DNA, 18 bp, Artificial sequence
  synthetic polynucleotide sequence
tggcgacaggcgaagaca

SEQ ID NO: 14977 - DNA, 18 bp, Artificial sequence
  synthetic polynucleotide sequence
gcaatgaggccctgcaca

SEQ ID NO: 14978 - DNA, 18 bp, Artificial sequence
  synthetic polynucleotide sequence
gtcccgatcacgggcaga

SEQ ID NO: 14979 - DNA, 18 bp, Artificial sequence
  synthetic polynucleotide sequence
atgcccataagtgaccca

SEQ ID NO: 14980 - DNA, 18 bp, Artificial sequence
  synthetic polynucleotide sequence
aagccgaggttgatggga

SEQ ID NO: 14981 - DNA, 18 bp, Artificial sequence
  synthetic polynucleotide sequence
agggagttgatggcggca

SEQ ID NO: 14982 - DNA, 18 bp, Artificial sequence
  synthetic polynucleotide sequence
ccccaacatggaccagga

SEQ ID NO: 14983 - DNA, 18 bp, Artificial sequence
  synthetic polynucleotide sequence
ggctggagaggttgggca

SEQ ID NO: 14984 - DNA, 18 bp, Artificial sequence
  synthetic polynucleotide sequence
cactggctgaccaacgga

SEQ ID NO: 14985 - DNA, 18 bp, Artificial sequence
  synthetic polynucleotide sequence
ccagagtggccctaggca

SEQ ID NO: 14986 - DNA, 18 bp, Artificial sequence
  synthetic polynucleotide sequence
ccagaaggaagccaccaa

SEQ ID NO: 14987 - DNA, 18 bp, Artificial sequence
  synthetic polynucleotide sequence
agggtagagcccctggca

SEQ ID NO: 14988 - DNA, 18 bp, Artificial sequence
  synthetic polynucleotide sequence
agggtagagcccctggca

SEQ ID NO: 14989 - DNA, 18 bp, Artificial sequence
  synthetic polynucleotide sequence
caaggatgcaggacacca

SEQ ID NO: 14990 - DNA, 18 bp, Artificial sequence
  synthetic polynucleotide sequence
gggccagtgtcaggggca

SEQ ID NO: 14991 - DNA, 18 bp, Artificial sequence
  synthetic polynucleotide sequence
gctgagcaaagaggccaa

SEQ ID NO: 14992 - DNA, 18 bp, Artificial sequence
  synthetic polynucleotide sequence
aagccccagcgaatggca

SEQ ID NO: 14993 - DNA, 18 bp, Artificial sequence
  synthetic polynucleotide sequence
gccaatgcagccaaacca

SEQ ID NO: 14994 - DNA, 18 bp, Artificial sequence
  synthetic polynucleotide sequence
gatcgatgtcagcagcca

SEQ ID NO: 14995 - DNA, 18 bp, Artificial sequence
  synthetic polynucleotide sequence
ggaaggagaaacagcgga

SEQ ID NO: 14996 - DNA, 18 bp, Artificial sequence
  synthetic polynucleotide sequence
ggagtccttcccgaggaa

SEQ ID NO: 14997 - DNA, 18 bp, Artificial sequence
  synthetic polynucleotide sequence
tggaccccaggatcagca

SEQ ID NO: 14998 - DNA, 18 bp, Artificial sequence
  synthetic polynucleotide sequence
tggcgagagcccaggcga

SEQ ID NO: 14999 - DNA, 18 bp, Artificial sequence
  synthetic polynucleotide sequence
accggtagtggaggtgga

SEQ ID NO: 15000 - DNA, 18 bp, Artificial sequence
  synthetic polynucleotide sequence
aagccctcctgctacaca

SEQ ID NO: 15001 - DNA, 18 bp, Artificial sequence
  synthetic polynucleotide sequence
cgaccggttcgtggcaga

SEQ ID NO: 15002 - DNA, 18 bp, Artificial sequence
  synthetic polynucleotide sequence
gtaaaggccgaggggcaa

SEQ ID NO: 15003 - DNA, 18 bp, Artificial sequence
  synthetic polynucleotide sequence
tcgtccactgcgagcaga

SEQ ID NO: 15004 - DNA, 18 bp, Artificial sequence
  synthetic polynucleotide sequence
aaccccaagggcagagga

SEQ ID NO: 15005 - DNA, 18 bp, Artificial sequence
  synthetic polynucleotide sequence
accccatccaccaggtca

SEQ ID NO: 15006 - DNA, 18 bp, Artificial sequence
  synthetic polynucleotide sequence
accccatccaccaggtca

SEQ ID NO: 15007 - DNA, 18 bp, Artificial sequence
  synthetic polynucleotide sequence
gaaggacctggcaggaca

SEQ ID NO: 15008 - DNA, 18 bp, Artificial sequence
  synthetic polynucleotide sequence
gcagaacagtcaggacca

SEQ ID NO: 15009 - DNA, 18 bp, Artificial sequence
  synthetic polynucleotide sequence
gccggaagaaagagggaa

SEQ ID NO: 15010 - DNA, 18 bp, Artificial sequence
  synthetic polynucleotide sequence
ccactgtgccacaggcca

SEQ ID NO: 15011 - DNA, 18 bp, Artificial sequence
  synthetic polynucleotide sequence
ctgtgctggacagcacca

SEQ ID NO: 15012 - DNA, 18 bp, Artificial sequence
  synthetic polynucleotide sequence
gaagaaggcgattcggga

SEQ ID NO: 15013 - DNA, 18 bp, Artificial sequence
  synthetic polynucleotide sequence
gcggagaagctgcaccca

SEQ ID NO: 15014 - DNA, 18 bp, Artificial sequence
  synthetic polynucleotide sequence
accatccagccttgagca

SEQ ID NO: 15015 - DNA, 19 bp, Artificial sequence
  synthetic polynucleotide sequence
tacactcacccaccatgca

SEQ ID NO: 15016 - DNA, 19 bp, Artificial sequence
  synthetic polynucleotide sequence
cccgaacgcacatactcca

SEQ ID NO: 15017 - DNA, 18 bp, Artificial sequence
  synthetic polynucleotide sequence
tagaggctacccaggcca

SEQ ID NO: 15018 - DNA, 18 bp, Artificial sequence
  synthetic polynucleotide sequence
gcccatacagtggaggca

SEQ ID NO: 15019 - DNA, 18 bp, Artificial sequence
  synthetic polynucleotide sequence
tcgaagcgctcacgccca

SEQ ID NO: 15020 - DNA, 18 bp, Artificial sequence
  synthetic polynucleotide sequence
cactgcccaacaacacca

SEQ ID NO: 15021 - DNA, 18 bp, Artificial sequence
  synthetic polynucleotide sequence
actcccatggaggcacga

SEQ ID NO: 15022 - DNA, 18 bp, Artificial sequence
  synthetic polynucleotide sequence
ggtggaagggaagcggaa

SEQ ID NO: 15023 - DNA, 18 bp, Artificial sequence
  synthetic polynucleotide sequence
ctcactgagaccagggca

SEQ ID NO: 15024 - DNA, 18 bp, Artificial sequence
  synthetic polynucleotide sequence
ctcactgagaccagggca

SEQ ID NO: 15025 - DNA, 18 bp, Artificial sequence
  synthetic polynucleotide sequence
tcatcgagcaccccagca

SEQ ID NO: 15026 - DNA, 18 bp, Artificial sequence
  synthetic polynucleotide sequence
cgcgtccgggagcgggga

SEQ ID NO: 15027 - DNA, 18 bp, Artificial sequence
  synthetic polynucleotide sequence
tcctgcggaccccaagca

SEQ ID NO: 15028 - DNA, 18 bp, Artificial sequence
  synthetic polynucleotide sequence
aagagatggtctggcgga

SEQ ID NO: 15029 - DNA, 18 bp, Artificial sequence
  synthetic polynucleotide sequence
agaggtagtgcagggcaa

SEQ ID NO: 15030 - DNA, 18 bp, Artificial sequence
  synthetic polynucleotide sequence
tcacagtccaggtcagca

SEQ ID NO: 15031 - DNA, 18 bp, Artificial sequence
  synthetic polynucleotide sequence
ctccacccggatcaccta

SEQ ID NO: 15032 - DNA, 18 bp, Artificial sequence
  synthetic polynucleotide sequence
gcactgatcgtggcagca

SEQ ID NO: 15033 - DNA, 18 bp, Artificial sequence
  synthetic polynucleotide sequence
gcaacgttggaacggcca

SEQ ID NO: 15034 - DNA, 18 bp, Artificial sequence
  synthetic polynucleotide sequence
gggccgtggagctgagga

SEQ ID NO: 15035 - DNA, 18 bp, Artificial sequence
  synthetic polynucleotide sequence
gcctcctctgaagcgcca

SEQ ID NO: 15036 - DNA, 18 bp, Artificial sequence
  synthetic polynucleotide sequence
agagccagatacctgcca

SEQ ID NO: 15037 - DNA, 18 bp, Artificial sequence
  synthetic polynucleotide sequence
gtgctctgagccaccgca

SEQ ID NO: 15038 - DNA, 18 bp, Artificial sequence
  synthetic polynucleotide sequence
ggcccaggaagtacacga

SEQ ID NO: 15039 - DNA, 18 bp, Artificial sequence
  synthetic polynucleotide sequence
agcctgagcctccagtga

SEQ ID NO: 15040 - DNA, 18 bp, Artificial sequence
  synthetic polynucleotide sequence
cctggaacgtgcagagga

SEQ ID NO: 15041 - DNA, 18 bp, Artificial sequence
  synthetic polynucleotide sequence
ctctgaggccatcaggga

SEQ ID NO: 15042 - DNA, 18 bp, Artificial sequence
  synthetic polynucleotide sequence
ctctgaggccatcaggga

SEQ ID NO: 15043 - DNA, 18 bp, Artificial sequence
  synthetic polynucleotide sequence
gcgagaagttgagggaga

SEQ ID NO: 15044 - DNA, 18 bp, Artificial sequence
  synthetic polynucleotide sequence
gctcctgagcacggtcca

SEQ ID NO: 15045 - DNA, 18 bp, Artificial sequence
  synthetic polynucleotide sequence
gctcaaagaggccaagca

SEQ ID NO: 15046 - DNA, 18 bp, Artificial sequence
  synthetic polynucleotide sequence
aggatgaccagcttacga

SEQ ID NO: 15047 - DNA, 18 bp, Artificial sequence
  synthetic polynucleotide sequence
tcccagagagcgtggaga

SEQ ID NO: 15048 - DNA, 18 bp, Artificial sequence
  synthetic polynucleotide sequence
taggggtccgcgcagaga

SEQ ID NO: 15049 - DNA, 18 bp, Artificial sequence
  synthetic polynucleotide sequence
cccaaggctctaccagca

SEQ ID NO: 15050 - DNA, 18 bp, Artificial sequence
  synthetic polynucleotide sequence
atcccagccaggaccaga

SEQ ID NO: 15051 - DNA, 18 bp, Artificial sequence
  synthetic polynucleotide sequence
ccacatccacttccccca

SEQ ID NO: 15052 - DNA, 18 bp, Artificial sequence
  synthetic polynucleotide sequence
ggagtcaactgaaggcca

SEQ ID NO: 15053 - DNA, 19 bp, Artificial sequence
  synthetic polynucleotide sequence
ggttaccctgcattcggga

SEQ ID NO: 15054 - DNA, 18 bp, Artificial sequence
  synthetic polynucleotide sequence
ctttgtttcggagcggga

SEQ ID NO: 15055 - DNA, 18 bp, Artificial sequence
  synthetic polynucleotide sequence
atcggggctctgaggcca

SEQ ID NO: 15056 - DNA, 18 bp, Artificial sequence
  synthetic polynucleotide sequence
ggcagactccaaggccca

SEQ ID NO: 15057 - DNA, 18 bp, Artificial sequence
  synthetic polynucleotide sequence
cgtcacggacgatgcgga

SEQ ID NO: 15058 - DNA, 18 bp, Artificial sequence
  synthetic polynucleotide sequence
tacaccgcccagatcgga

SEQ ID NO: 15059 - DNA, 18 bp, Artificial sequence
  synthetic polynucleotide sequence
acagcatgtcatcgcgga

SEQ ID NO: 15060 - DNA, 18 bp, Artificial sequence
  synthetic polynucleotide sequence
acagcatgtcatcgcgga

SEQ ID NO: 15061 - DNA, 18 bp, Artificial sequence
  synthetic polynucleotide sequence
gctgtggagaggaaacca

SEQ ID NO: 15062 - DNA, 18 bp, Artificial sequence
  synthetic polynucleotide sequence
gcatggcagaatccagca

SEQ ID NO: 15063 - DNA, 18 bp, Artificial sequence
  synthetic polynucleotide sequence
gatcgagcggtccacgga

SEQ ID NO: 15064 - DNA, 18 bp, Artificial sequence
  synthetic polynucleotide sequence
gccatgtcccgcaccaca

SEQ ID NO: 15065 - DNA, 18 bp, Artificial sequence
  synthetic polynucleotide sequence
ggagcaaccgaggaggca

SEQ ID NO: 15066 - DNA, 18 bp, Artificial sequence
  synthetic polynucleotide sequence
cggcaaggatgagagtga

SEQ ID NO: 15067 - DNA, 18 bp, Artificial sequence
  synthetic polynucleotide sequence
aggctgaggagctcgaga

SEQ ID NO: 15068 - DNA, 18 bp, Artificial sequence
  synthetic polynucleotide sequence
ttgggcaagatgggccca

SEQ ID NO: 15069 - DNA, 18 bp, Artificial sequence
  synthetic polynucleotide sequence
acggcacagccacagcca

SEQ ID NO: 15070 - DNA, 18 bp, Artificial sequence
  synthetic polynucleotide sequence
gtgtacaagctcagccca

SEQ ID NO: 15071 - DNA, 18 bp, Artificial sequence
  synthetic polynucleotide sequence
tgtagcccagcaggccga

SEQ ID NO: 15072 - DNA, 18 bp, Artificial sequence
  synthetic polynucleotide sequence
tgacgccgagcccaggaa

SEQ ID NO: 15073 - DNA, 18 bp, Artificial sequence
  synthetic polynucleotide sequence
cattcaggtacagccgca

SEQ ID NO: 15074 - DNA, 18 bp, Artificial sequence
  synthetic polynucleotide sequence
tgggcaagctggagcaga

SEQ ID NO: 15075 - DNA, 17 bp, Artificial sequence
  synthetic polynucleotide sequence
caggtccttgaggccaa

SEQ ID NO: 15076 - DNA, 19 bp, Artificial sequence
  synthetic polynucleotide sequence
gcgagagcctggagaagaa

SEQ ID NO: 15077 - DNA, 18 bp, Artificial sequence
  synthetic polynucleotide sequence
caccaccacgcagggaca

SEQ ID NO: 15078 - DNA, 18 bp, Artificial sequence
  synthetic polynucleotide sequence
caccaccacgcagggaca

SEQ ID NO: 15079 - DNA, 18 bp, Artificial sequence
  synthetic polynucleotide sequence
gtcgcagctggacgagga

SEQ ID NO: 15080 - DNA, 18 bp, Artificial sequence
  synthetic polynucleotide sequence
tctgaagccaggtgggca

SEQ ID NO: 15081 - DNA, 18 bp, Artificial sequence
  synthetic polynucleotide sequence
gctgaaccagagccagca

SEQ ID NO: 15082 - DNA, 18 bp, Artificial sequence
  synthetic polynucleotide sequence
tggccaggaacactgcca

SEQ ID NO: 15083 - DNA, 18 bp, Artificial sequence
  synthetic polynucleotide sequence
acaggaggccaaggccaa

SEQ ID NO: 15084 - DNA, 18 bp, Artificial sequence
  synthetic polynucleotide sequence
aagggccactcaaggaga

SEQ ID NO: 15085 - DNA, 18 bp, Artificial sequence
  synthetic polynucleotide sequence
gcggtggatgggcacaca

SEQ ID NO: 15086 - DNA, 18 bp, Artificial sequence
  synthetic polynucleotide sequence
gcctgaatggccactgca

SEQ ID NO: 15087 - DNA, 18 bp, Artificial sequence
  synthetic polynucleotide sequence
caatcccacggaacccaa

SEQ ID NO: 15088 - DNA, 17 bp, Artificial sequence
  synthetic polynucleotide sequence
cgggtggagacctcaca

SEQ ID NO: 15089 - DNA, 18 bp, Artificial sequence
  synthetic polynucleotide sequence
ccctgaaggcccagggga

SEQ ID NO: 15090 - DNA, 18 bp, Artificial sequence
  synthetic polynucleotide sequence
gcggaatcgagacagcca

SEQ ID NO: 15091 - DNA, 18 bp, Artificial sequence
  synthetic polynucleotide sequence
tagggaaggcaccaacca

SEQ ID NO: 15092 - DNA, 18 bp, Artificial sequence
  synthetic polynucleotide sequence
caaaggccccaggaagga

SEQ ID NO: 15093 - DNA, 18 bp, Artificial sequence
  synthetic polynucleotide sequence
cctcgaaggcaactggca

SEQ ID NO: 15094 - DNA, 18 bp, Artificial sequence
  synthetic polynucleotide sequence
gtgtcaccccgacagaga

SEQ ID NO: 15095 - DNA, 18 bp, Artificial sequence
  synthetic polynucleotide sequence
gtgagggaggacgaacca

SEQ ID NO: 15096 - DNA, 18 bp, Artificial sequence
  synthetic polynucleotide sequence
gtgagggaggacgaacca

SEQ ID NO: 15097 - DNA, 18 bp, Artificial sequence
  synthetic polynucleotide sequence
tgacagacgaccagcgga

SEQ ID NO: 15098 - DNA, 18 bp, Artificial sequence
  synthetic polynucleotide sequence
tcgccactgctgagagga

SEQ ID NO: 15099 - DNA, 18 bp, Artificial sequence
  synthetic polynucleotide sequence
agcgtagaaagcccagga

SEQ ID NO: 15100 - DNA, 19 bp, Artificial sequence
  synthetic polynucleotide sequence
cttagcacggatcaatcca

SEQ ID NO: 15101 - DNA, 18 bp, Artificial sequence
  synthetic polynucleotide sequence
ccaagacgattgaaggca

SEQ ID NO: 15102 - DNA, 18 bp, Artificial sequence
  synthetic polynucleotide sequence
gtgaatggctggcaggga

SEQ ID NO: 15103 - DNA, 19 bp, Artificial sequence
  synthetic polynucleotide sequence
caagctccacccaagtcaa

SEQ ID NO: 15104 - DNA, 18 bp, Artificial sequence
  synthetic polynucleotide sequence
acctcagcgtgacagcaa

SEQ ID NO: 15105 - DNA, 18 bp, Artificial sequence
  synthetic polynucleotide sequence
gcggaatctacaacccca

SEQ ID NO: 15106 - DNA, 18 bp, Artificial sequence
  synthetic polynucleotide sequence
agatgcaggccaggagga

SEQ ID NO: 15107 - DNA, 18 bp, Artificial sequence
  synthetic polynucleotide sequence
tcacccagactcgggcaa

SEQ ID NO: 15108 - DNA, 18 bp, Artificial sequence
  synthetic polynucleotide sequence
aaaccgcgtggagggcaa

SEQ ID NO: 15109 - DNA, 18 bp, Artificial sequence
  synthetic polynucleotide sequence
cagggacagacacgggca

SEQ ID NO: 15110 - DNA, 18 bp, Artificial sequence
  synthetic polynucleotide sequence
aatgagggcctcccccaa

SEQ ID NO: 15111 - DNA, 18 bp, Artificial sequence
  synthetic polynucleotide sequence
tcgggacagcatatgcaa

SEQ ID NO: 15112 - DNA, 18 bp, Artificial sequence
  synthetic polynucleotide sequence
accccacaaacggcagca

SEQ ID NO: 15113 - DNA, 18 bp, Artificial sequence
  synthetic polynucleotide sequence
catggcccatgaactcca

SEQ ID NO: 15114 - DNA, 18 bp, Artificial sequence
  synthetic polynucleotide sequence
catggcccatgaactcca

SEQ ID NO: 15115 - DNA, 18 bp, Artificial sequence
  synthetic polynucleotide sequence
cctacgtgagccctgaga

SEQ ID NO: 15116 - DNA, 18 bp, Artificial sequence
  synthetic polynucleotide sequence
aggggtatcgtccaacca

SEQ ID NO: 15117 - DNA, 18 bp, Artificial sequence
  synthetic polynucleotide sequence
gaggaggaggcagccaga

SEQ ID NO: 15118 - DNA, 18 bp, Artificial sequence
  synthetic polynucleotide sequence
tgtacagcatcaccccca

SEQ ID NO: 15119 - DNA, 18 bp, Artificial sequence
  synthetic polynucleotide sequence
ggcctcatactcgggcaa

SEQ ID NO: 15120 - DNA, 18 bp, Artificial sequence
  synthetic polynucleotide sequence
ctcccgacgaaggaggca

SEQ ID NO: 15121 - DNA, 18 bp, Artificial sequence
  synthetic polynucleotide sequence
ctcaccagacaaccccca

SEQ ID NO: 15122 - DNA, 18 bp, Artificial sequence
  synthetic polynucleotide sequence
gaaggagcccagagccga

SEQ ID NO: 15123 - DNA, 18 bp, Artificial sequence
  synthetic polynucleotide sequence
ggactacgaggctggaca

SEQ ID NO: 15124 - DNA, 18 bp, Artificial sequence
  synthetic polynucleotide sequence
tgctggacaggggtgaga

SEQ ID NO: 15125 - DNA, 18 bp, Artificial sequence
  synthetic polynucleotide sequence
aaggagaggggcacggga

SEQ ID NO: 15126 - DNA, 18 bp, Artificial sequence
  synthetic polynucleotide sequence
cacggccaccgagcagga

SEQ ID NO: 15127 - DNA, 18 bp, Artificial sequence
  synthetic polynucleotide sequence
gggagacacatcagcgga

SEQ ID NO: 15128 - DNA, 18 bp, Artificial sequence
  synthetic polynucleotide sequence
acggggagatcctggaca

SEQ ID NO: 15129 - DNA, 18 bp, Artificial sequence
  synthetic polynucleotide sequence
gccctggcacatggcaca

SEQ ID NO: 15130 - DNA, 18 bp, Artificial sequence
  synthetic polynucleotide sequence
aggtgccacagctcagca

SEQ ID NO: 15131 - DNA, 18 bp, Artificial sequence
  synthetic polynucleotide sequence
gctggaggcactaggtga

SEQ ID NO: 15132 - DNA, 18 bp, Artificial sequence
  synthetic polynucleotide sequence
gctggaggcactaggtga

SEQ ID NO: 15133 - DNA, 18 bp, Artificial sequence
  synthetic polynucleotide sequence
ctgcagccaaagccacca

SEQ ID NO: 15134 - DNA, 18 bp, Artificial sequence
  synthetic polynucleotide sequence
tgaggcatctcagccaca

SEQ ID NO: 15135 - DNA, 18 bp, Artificial sequence
  synthetic polynucleotide sequence
gcatctgggccaacacca

SEQ ID NO: 15136 - DNA, 18 bp, Artificial sequence
  synthetic polynucleotide sequence
ctggccacttgagccaca

SEQ ID NO: 15137 - DNA, 18 bp, Artificial sequence
  synthetic polynucleotide sequence
cgtgactctggacccaga

SEQ ID NO: 15138 - DNA, 18 bp, Artificial sequence
  synthetic polynucleotide sequence
ccggcgatgaagcatgga

SEQ ID NO: 15139 - DNA, 18 bp, Artificial sequence
  synthetic polynucleotide sequence
cgagacgcgcatgaacga

SEQ ID NO: 15140 - DNA, 18 bp, Artificial sequence
  synthetic polynucleotide sequence
tcctgggaactcaggcca

SEQ ID NO: 15141 - DNA, 18 bp, Artificial sequence
  synthetic polynucleotide sequence
gccgcttcaccaaggaga

SEQ ID NO: 15142 - DNA, 18 bp, Artificial sequence
  synthetic polynucleotide sequence
aggagctgccttggacga

SEQ ID NO: 15143 - DNA, 18 bp, Artificial sequence
  synthetic polynucleotide sequence
ggcagagggacctggaga

SEQ ID NO: 15144 - DNA, 18 bp, Artificial sequence
  synthetic polynucleotide sequence
caaaccgaggtcccacca

SEQ ID NO: 15145 - DNA, 18 bp, Artificial sequence
  synthetic polynucleotide sequence
tcaaccgcaggcaagcca

SEQ ID NO: 15146 - DNA, 18 bp, Artificial sequence
  synthetic polynucleotide sequence
agtctgggagcaggcaca

SEQ ID NO: 15147 - DNA, 18 bp, Artificial sequence
  synthetic polynucleotide sequence
ggaggctgaggcaggaga

SEQ ID NO: 15148 - DNA, 18 bp, Artificial sequence
  synthetic polynucleotide sequence
tggagtgcaatggcacga

SEQ ID NO: 15149 - DNA, 18 bp, Artificial sequence
  synthetic polynucleotide sequence
tggaggggaggagcctca

SEQ ID NO: 15150 - DNA, 18 bp, Artificial sequence
  synthetic polynucleotide sequence
tggaggggaggagcctca

SEQ ID NO: 15151 - DNA, 18 bp, Artificial sequence
  synthetic polynucleotide sequence
catccctgggaggaggga

SEQ ID NO: 15152 - DNA, 18 bp, Artificial sequence
  synthetic polynucleotide sequence
tcccaccagaacctccca

SEQ ID NO: 15153 - DNA, 18 bp, Artificial sequence
  synthetic polynucleotide sequence
ccccagccccaatagaga

SEQ ID NO: 15154 - DNA, 18 bp, Artificial sequence
  synthetic polynucleotide sequence
ctgagcaaggctggcaca

SEQ ID NO: 15155 - DNA, 18 bp, Artificial sequence
  synthetic polynucleotide sequence
ggagcttcagacgcagca

SEQ ID NO: 15156 - DNA, 18 bp, Artificial sequence
  synthetic polynucleotide sequence
cgaggcatagtggccaga

SEQ ID NO: 15157 - DNA, 18 bp, Artificial sequence
  synthetic polynucleotide sequence
cccaggaggatggccaca

SEQ ID NO: 15158 - DNA, 18 bp, Artificial sequence
  synthetic polynucleotide sequence
gcggggtgaccttgggca

SEQ ID NO: 15159 - DNA, 18 bp, Artificial sequence
  synthetic polynucleotide sequence
aggaacccacatccccca

SEQ ID NO: 15160 - DNA, 18 bp, Artificial sequence
  synthetic polynucleotide sequence
gagcgtgactcggaggta

SEQ ID NO: 15161 - DNA, 18 bp, Artificial sequence
  synthetic polynucleotide sequence
ccaccaggtccaagtcca

SEQ ID NO: 15162 - DNA, 18 bp, Artificial sequence
  synthetic polynucleotide sequence
ccatccattccaccacca

SEQ ID NO: 15163 - DNA, 18 bp, Artificial sequence
  synthetic polynucleotide sequence
gtcagcagctgctggcga

SEQ ID NO: 15164 - DNA, 18 bp, Artificial sequence
  synthetic polynucleotide sequence
cagggctgacatcaagca

SEQ ID NO: 15165 - DNA, 18 bp, Artificial sequence
  synthetic polynucleotide sequence
agccccgcgatcccgcta

SEQ ID NO: 15166 - DNA, 18 bp, Artificial sequence
  synthetic polynucleotide sequence
aggggacggcagagcaga

SEQ ID NO: 15167 - DNA, 18 bp, Artificial sequence
  synthetic polynucleotide sequence
ctcgtggtaggagcgcaa

SEQ ID NO: 15168 - DNA, 18 bp, Artificial sequence
  synthetic polynucleotide sequence
ctcgtggtaggagcgcaa

SEQ ID NO: 15169 - DNA, 18 bp, Artificial sequence
  synthetic polynucleotide sequence
caggccgaaagccaggca

SEQ ID NO: 15170 - DNA, 18 bp, Artificial sequence
  synthetic polynucleotide sequence
aaggggttccgaggctga

SEQ ID NO: 15171 - DNA, 18 bp, Artificial sequence
  synthetic polynucleotide sequence
gcctggatgaagacggga

SEQ ID NO: 15172 - DNA, 18 bp, Artificial sequence
  synthetic polynucleotide sequence
ggctcagaagaagcgcaa

SEQ ID NO: 15173 - DNA, 18 bp, Artificial sequence
  synthetic polynucleotide sequence
ccaggctggcatgaggaa

SEQ ID NO: 15174 - DNA, 18 bp, Artificial sequence
  synthetic polynucleotide sequence
catagcgcaggctggaga

SEQ ID NO: 15175 - DNA, 18 bp, Artificial sequence
  synthetic polynucleotide sequence
cggtggggttaaccagga

SEQ ID NO: 15176 - DNA, 18 bp, Artificial sequence
  synthetic polynucleotide sequence
gcactgcagcttccgaca

SEQ ID NO: 15177 - DNA, 18 bp, Artificial sequence
  synthetic polynucleotide sequence
accgtccctacctgcaga

SEQ ID NO: 15178 - DNA, 18 bp, Artificial sequence
  synthetic polynucleotide sequence
ggcatactgggagacgca

SEQ ID NO: 15179 - DNA, 18 bp, Artificial sequence
  synthetic polynucleotide sequence
gagcttccggcagcagga

SEQ ID NO: 15180 - DNA, 18 bp, Artificial sequence
  synthetic polynucleotide sequence
caccaacaccctggagga

SEQ ID NO: 15181 - DNA, 18 bp, Artificial sequence
  synthetic polynucleotide sequence
cgaccagcaggttgacca

SEQ ID NO: 15182 - DNA, 18 bp, Artificial sequence
  synthetic polynucleotide sequence
tccccgagtggatcacca

SEQ ID NO: 15183 - DNA, 18 bp, Artificial sequence
  synthetic polynucleotide sequence
ctctctgcaggcgccaga

SEQ ID NO: 15184 - DNA, 18 bp, Artificial sequence
  synthetic polynucleotide sequence
actgcagctcctacggca

SEQ ID NO: 15185 - DNA, 18 bp, Artificial sequence
  synthetic polynucleotide sequence
acgaggggtaagtgggca

SEQ ID NO: 15186 - DNA, 18 bp, Artificial sequence
  synthetic polynucleotide sequence
acgaggggtaagtgggca

SEQ ID NO: 15187 - DNA, 18 bp, Artificial sequence
  synthetic polynucleotide sequence
gcggctcaccaacaccaa

SEQ ID NO: 15188 - DNA, 18 bp, Artificial sequence
  synthetic polynucleotide sequence
gaccacagccatcagcca

SEQ ID NO: 15189 - DNA, 18 bp, Artificial sequence
  synthetic polynucleotide sequence
tggcagatgccgtcgaca

SEQ ID NO: 15190 - DNA, 18 bp, Artificial sequence
  synthetic polynucleotide sequence
ttccctccgagccaacca

SEQ ID NO: 15191 - DNA, 18 bp, Artificial sequence
  synthetic polynucleotide sequence
caccacagcagaggcaga

SEQ ID NO: 15192 - DNA, 18 bp, Artificial sequence
  synthetic polynucleotide sequence
agaactggaggctgccga

SEQ ID NO: 15193 - DNA, 18 bp, Artificial sequence
  synthetic polynucleotide sequence
tctcagccacagccagca

SEQ ID NO: 15194 - DNA, 18 bp, Artificial sequence
  synthetic polynucleotide sequence
gacgtgatgggccagaca

SEQ ID NO: 15195 - DNA, 18 bp, Artificial sequence
  synthetic polynucleotide sequence
gcaggagtaggagcagga

SEQ ID NO: 15196 - DNA, 18 bp, Artificial sequence
  synthetic polynucleotide sequence
ctgccagtaggtacagca

SEQ ID NO: 15197 - DNA, 18 bp, Artificial sequence
  synthetic polynucleotide sequence
acctcctcccggaccgca

SEQ ID NO: 15198 - DNA, 18 bp, Artificial sequence
  synthetic polynucleotide sequence
ccagaccccttcggagca

SEQ ID NO: 15199 - DNA, 18 bp, Artificial sequence
  synthetic polynucleotide sequence
aggtcactgagaccggca

SEQ ID NO: 15200 - DNA, 18 bp, Artificial sequence
  synthetic polynucleotide sequence
gggcgtgatagacctgga

SEQ ID NO: 15201 - DNA, 21 bp, Artificial sequence
  synthetic polynucleotide sequence
ccttggactgaagtaaagcca

SEQ ID NO: 15202 - DNA, 18 bp, Artificial sequence
  synthetic polynucleotide sequence
gttccctgacctgaccaa

SEQ ID NO: 15203 - DNA, 18 bp, Artificial sequence
  synthetic polynucleotide sequence
acaggtagcgcctggaca

SEQ ID NO: 15204 - DNA, 18 bp, Artificial sequence
  synthetic polynucleotide sequence
acaggtagcgcctggaca

SEQ ID NO: 15205 - DNA, 18 bp, Artificial sequence
  synthetic polynucleotide sequence
acctcccggcactgcaga

SEQ ID NO: 15206 - DNA, 18 bp, Artificial sequence
  synthetic polynucleotide sequence
ctacgcagtgcagggcca

SEQ ID NO: 15207 - DNA, 18 bp, Artificial sequence
  synthetic polynucleotide sequence
tggctgccgagcaggaca

SEQ ID NO: 15208 - DNA, 18 bp, Artificial sequence
  synthetic polynucleotide sequence
agaagaccaagcgctgca

SEQ ID NO: 15209 - DNA, 18 bp, Artificial sequence
  synthetic polynucleotide sequence
acgtcaccaacacagcca

SEQ ID NO: 15210 - DNA, 18 bp, Artificial sequence
  synthetic polynucleotide sequence
ccaattccagctgccaca

SEQ ID NO: 15211 - DNA, 18 bp, Artificial sequence
  synthetic polynucleotide sequence
ccaggagcaacagggtca

SEQ ID NO: 15212 - DNA, 18 bp, Artificial sequence
  synthetic polynucleotide sequence
aacacagctagccagaca

SEQ ID NO: 15213 - DNA, 18 bp, Artificial sequence
  synthetic polynucleotide sequence
tgccggagggaaccccaa

SEQ ID NO: 15214 - DNA, 18 bp, Artificial sequence
  synthetic polynucleotide sequence
cggaagaggcacatggca

SEQ ID NO: 15215 - DNA, 18 bp, Artificial sequence
  synthetic polynucleotide sequence
agagcctcacacccctca

SEQ ID NO: 15216 - DNA, 18 bp, Artificial sequence
  synthetic polynucleotide sequence
caatggaaccaaccctga

SEQ ID NO: 15217 - DNA, 18 bp, Artificial sequence
  synthetic polynucleotide sequence
cagccaggtggcaggaga

SEQ ID NO: 15218 - DNA, 18 bp, Artificial sequence
  synthetic polynucleotide sequence
accctgaccccacgagca

SEQ ID NO: 15219 - DNA, 18 bp, Artificial sequence
  synthetic polynucleotide sequence
ctcactgaactccaagca

SEQ ID NO: 15220 - DNA, 18 bp, Artificial sequence
  synthetic polynucleotide sequence
gcacctgtacggcacgca

SEQ ID NO: 15221 - DNA, 18 bp, Artificial sequence
  synthetic polynucleotide sequence
cctggcatcatagccaca

SEQ ID NO: 15222 - DNA, 18 bp, Artificial sequence
  synthetic polynucleotide sequence
cctggcatcatagccaca

SEQ ID NO: 15223 - DNA, 18 bp, Artificial sequence
  synthetic polynucleotide sequence
gggcaaggtgagcctgga

SEQ ID NO: 15224 - DNA, 18 bp, Artificial sequence
  synthetic polynucleotide sequence
ctacgatggcagcgacca

SEQ ID NO: 15225 - DNA, 18 bp, Artificial sequence
  synthetic polynucleotide sequence
ggacttacacggacgcta

SEQ ID NO: 15226 - DNA, 18 bp, Artificial sequence
  synthetic polynucleotide sequence
gcacaccacagcagctca

SEQ ID NO: 15227 - DNA, 18 bp, Artificial sequence
  synthetic polynucleotide sequence
gcgacaggtatcctagga

SEQ ID NO: 15228 - DNA, 18 bp, Artificial sequence
  synthetic polynucleotide sequence
cagcagctccattgacca

SEQ ID NO: 15229 - DNA, 18 bp, Artificial sequence
  synthetic polynucleotide sequence
gcacgctctactcagcca

SEQ ID NO: 15230 - DNA, 18 bp, Artificial sequence
  synthetic polynucleotide sequence
ccaccaaggcccagccca

SEQ ID NO: 15231 - DNA, 18 bp, Artificial sequence
  synthetic polynucleotide sequence
agctcaccatcagctgga

SEQ ID NO: 15232 - DNA, 18 bp, Artificial sequence
  synthetic polynucleotide sequence
ggcagcagtaacagggca

SEQ ID NO: 15233 - DNA, 18 bp, Artificial sequence
  synthetic polynucleotide sequence
tgcgcttgagacgcagga

SEQ ID NO: 15234 - DNA, 18 bp, Artificial sequence
  synthetic polynucleotide sequence
cctgcaggcactggagga

SEQ ID NO: 15235 - DNA, 18 bp, Artificial sequence
  synthetic polynucleotide sequence
cctcttgaaggaggcaga

SEQ ID NO: 15236 - DNA, 18 bp, Artificial sequence
  synthetic polynucleotide sequence
tcagccagcggctccaca

SEQ ID NO: 15237 - DNA, 18 bp, Artificial sequence
  synthetic polynucleotide sequence
ttgccgcagaggtaggca

SEQ ID NO: 15238 - DNA, 18 bp, Artificial sequence
  synthetic polynucleotide sequence
aagggcggttcctgggca

SEQ ID NO: 15239 - DNA, 18 bp, Artificial sequence
  synthetic polynucleotide sequence
tgaagggtgtgaaccgga

SEQ ID NO: 15240 - DNA, 18 bp, Artificial sequence
  synthetic polynucleotide sequence
tgaagggtgtgaaccgga

SEQ ID NO: 15241 - DNA, 18 bp, Artificial sequence
  synthetic polynucleotide sequence
ccaccaccaggaaagcca

SEQ ID NO: 15242 - DNA, 18 bp, Artificial sequence
  synthetic polynucleotide sequence
aatttgggccaggcggga

SEQ ID NO: 15243 - DNA, 18 bp, Artificial sequence
  synthetic polynucleotide sequence
cagggttgcaaccccaca

SEQ ID NO: 15244 - DNA, 18 bp, Artificial sequence
  synthetic polynucleotide sequence
tgacctccaatgcggcca

SEQ ID NO: 15245 - DNA, 18 bp, Artificial sequence
  synthetic polynucleotide sequence
gctcacagaggctgagga

SEQ ID NO: 15246 - DNA, 18 bp, Artificial sequence
  synthetic polynucleotide sequence
tcaggcagaccagagcca

SEQ ID NO: 15247 - DNA, 18 bp, Artificial sequence
  synthetic polynucleotide sequence
cgtcacaggcacaaagga

SEQ ID NO: 15248 - DNA, 18 bp, Artificial sequence
  synthetic polynucleotide sequence
catccagggtagtagcca

SEQ ID NO: 15249 - DNA, 18 bp, Artificial sequence
  synthetic polynucleotide sequence
atgcactccaaggccgca

SEQ ID NO: 15250 - DNA, 18 bp, Artificial sequence
  synthetic polynucleotide sequence
gtgcaacaactcgagaca

SEQ ID NO: 15251 - DNA, 18 bp, Artificial sequence
  synthetic polynucleotide sequence
ccagggatgccatcagga

SEQ ID NO: 15252 - DNA, 18 bp, Artificial sequence
  synthetic polynucleotide sequence
cgcctgcagatggaagga

SEQ ID NO: 15253 - DNA, 18 bp, Artificial sequence
  synthetic polynucleotide sequence
agcttcaggcctggcaca

SEQ ID NO: 15254 - DNA, 18 bp, Artificial sequence
  synthetic polynucleotide sequence
ccagcagcactggaagca

SEQ ID NO: 15255 - DNA, 18 bp, Artificial sequence
  synthetic polynucleotide sequence
cacaggtgcaggtaagga

SEQ ID NO: 15256 - DNA, 18 bp, Artificial sequence
  synthetic polynucleotide sequence
gacagcttgaagcagaga

SEQ ID NO: 15257 - DNA, 18 bp, Artificial sequence
  synthetic polynucleotide sequence
cctcctgcaggtagcgca

SEQ ID NO: 15258 - DNA, 18 bp, Artificial sequence
  synthetic polynucleotide sequence
cctcctgcaggtagcgca

SEQ ID NO: 15259 - DNA, 18 bp, Artificial sequence
  synthetic polynucleotide sequence
acactcggaggcagcaga

SEQ ID NO: 15260 - DNA, 18 bp, Artificial sequence
  synthetic polynucleotide sequence
actggcggagtctcagca

SEQ ID NO: 15261 - DNA, 18 bp, Artificial sequence
  synthetic polynucleotide sequence
ggccagagcaaactgcaa

SEQ ID NO: 15262 - DNA, 18 bp, Artificial sequence
  synthetic polynucleotide sequence
atgcccaagtgaaccgga

SEQ ID NO: 15263 - DNA, 18 bp, Artificial sequence
  synthetic polynucleotide sequence
catagacaaccagggcca

SEQ ID NO: 15264 - DNA, 18 bp, Artificial sequence
  synthetic polynucleotide sequence
atgatccaccaagaccca

SEQ ID NO: 15265 - DNA, 18 bp, Artificial sequence
  synthetic polynucleotide sequence
ctccatgaccctggacca

SEQ ID NO: 15266 - DNA, 18 bp, Artificial sequence
  synthetic polynucleotide sequence
ggacaggtggtactcgca

SEQ ID NO: 15267 - DNA, 18 bp, Artificial sequence
  synthetic polynucleotide sequence
ctctggcgagaagaggca

SEQ ID NO: 15268 - DNA, 18 bp, Artificial sequence
  synthetic polynucleotide sequence
ctggagtggcaatcacca

SEQ ID NO: 15269 - DNA, 18 bp, Artificial sequence
  synthetic polynucleotide sequence
aggactccatggtagcca

SEQ ID NO: 15270 - DNA, 18 bp, Artificial sequence
  synthetic polynucleotide sequence
gccgctgccgctcaccga

SEQ ID NO: 15271 - DNA, 18 bp, Artificial sequence
  synthetic polynucleotide sequence
acggccacattgatggca

SEQ ID NO: 15272 - DNA, 18 bp, Artificial sequence
  synthetic polynucleotide sequence
aggctggccctacgggca

SEQ ID NO: 15273 - DNA, 18 bp, Artificial sequence
  synthetic polynucleotide sequence
gagggtcacacttgacca

SEQ ID NO: 15274 - DNA, 18 bp, Artificial sequence
  synthetic polynucleotide sequence
gaaggcctaccacgagca

SEQ ID NO: 15275 - DNA, 18 bp, Artificial sequence
  synthetic polynucleotide sequence
ttggccaggtcaccccca

SEQ ID NO: 15276 - DNA, 18 bp, Artificial sequence
  synthetic polynucleotide sequence
ttggccaggtcaccccca

SEQ ID NO: 15277 - DNA, 18 bp, Artificial sequence
  synthetic polynucleotide sequence
cgacgtggtgcccaagga

SEQ ID NO: 15278 - DNA, 18 bp, Artificial sequence
  synthetic polynucleotide sequence
gaagcctgtgggacacca

SEQ ID NO: 15279 - DNA, 18 bp, Artificial sequence
  synthetic polynucleotide sequence
ccactccaccacagagca

SEQ ID NO: 15280 - DNA, 18 bp, Artificial sequence
  synthetic polynucleotide sequence
gagggaggcagtgatgga

SEQ ID NO: 15281 - DNA, 18 bp, Artificial sequence
  synthetic polynucleotide sequence
ctccgtgcagaccaggaa

SEQ ID NO: 15282 - DNA, 18 bp, Artificial sequence
  synthetic polynucleotide sequence
caatgaaggtggcggcca

SEQ ID NO: 15283 - DNA, 18 bp, Artificial sequence
  synthetic polynucleotide sequence
cgtggagtggatccccaa

SEQ ID NO: 15284 - DNA, 18 bp, Artificial sequence
  synthetic polynucleotide sequence
ccgtgaactgctcggaga

SEQ ID NO: 15285 - DNA, 18 bp, Artificial sequence
  synthetic polynucleotide sequence
ctacggggacctcaacca

SEQ ID NO: 15286 - DNA, 18 bp, Artificial sequence
  synthetic polynucleotide sequence
agaagtgcaggcgaggga

SEQ ID NO: 15287 - DNA, 18 bp, Artificial sequence
  synthetic polynucleotide sequence
cttgaggaggccagccca

SEQ ID NO: 15288 - DNA, 18 bp, Artificial sequence
  synthetic polynucleotide sequence
tcgcacatcagctgggaa

SEQ ID NO: 15289 - DNA, 18 bp, Artificial sequence
  synthetic polynucleotide sequence
aggcctcccgcttacgca

SEQ ID NO: 15290 - DNA, 18 bp, Artificial sequence
  synthetic polynucleotide sequence
cgggctcatgatggccaa

SEQ ID NO: 15291 - DNA, 18 bp, Artificial sequence
  synthetic polynucleotide sequence
tcaggcaggtgtccagga

SEQ ID NO: 15292 - DNA, 18 bp, Artificial sequence
  synthetic polynucleotide sequence
cctggcacatcctggaga

SEQ ID NO: 15293 - DNA, 18 bp, Artificial sequence
  synthetic polynucleotide sequence
ccccctggtacccagaga

SEQ ID NO: 15294 - DNA, 18 bp, Artificial sequence
  synthetic polynucleotide sequence
ccccctggtacccagaga

SEQ ID NO: 15295 - DNA, 18 bp, Artificial sequence
  synthetic polynucleotide sequence
ccagcaggcagcacacca

SEQ ID NO: 15296 - DNA, 18 bp, Artificial sequence
  synthetic polynucleotide sequence
gcatcgacttgccagcca

SEQ ID NO: 15297 - DNA, 18 bp, Artificial sequence
  synthetic polynucleotide sequence
gaggcgcactatgaggca

SEQ ID NO: 15298 - DNA, 18 bp, Artificial sequence
  synthetic polynucleotide sequence
agggccttgctcagcaca

SEQ ID NO: 15299 - DNA, 18 bp, Artificial sequence
  synthetic polynucleotide sequence
ccagaaggtggaggccca

SEQ ID NO: 15300 - DNA, 18 bp, Artificial sequence
  synthetic polynucleotide sequence
gggcaggataatccgaca

SEQ ID NO: 15301 - DNA, 18 bp, Artificial sequence
  synthetic polynucleotide sequence
cgtcgtgggacaaggaga

SEQ ID NO: 15302 - DNA, 18 bp, Artificial sequence
  synthetic polynucleotide sequence
ctcggccgaactggagca

SEQ ID NO: 15303 - DNA, 18 bp, Artificial sequence
  synthetic polynucleotide sequence
ggtcctccagagcgacga

SEQ ID NO: 15304 - DNA, 18 bp, Artificial sequence
  synthetic polynucleotide sequence
ccgagaaggcgtagctga

SEQ ID NO: 15305 - DNA, 18 bp, Artificial sequence
  synthetic polynucleotide sequence
ccatgcgccacacggaga

SEQ ID NO: 15306 - DNA, 18 bp, Artificial sequence
  synthetic polynucleotide sequence
agctgagcaagatccaga

SEQ ID NO: 15307 - DNA, 18 bp, Artificial sequence
  synthetic polynucleotide sequence
ctggaataaggcgcgtga

SEQ ID NO: 15308 - DNA, 18 bp, Artificial sequence
  synthetic polynucleotide sequence
aggagctgcatgaaccga

SEQ ID NO: 15309 - DNA, 18 bp, Artificial sequence
  synthetic polynucleotide sequence
cccatcagcccaactgga

SEQ ID NO: 15310 - DNA, 18 bp, Artificial sequence
  synthetic polynucleotide sequence
gaagtacggaggctgcca

SEQ ID NO: 15311 - DNA, 18 bp, Artificial sequence
  synthetic polynucleotide sequence
tgagtggagctcggagca

SEQ ID NO: 15312 - DNA, 18 bp, Artificial sequence
  synthetic polynucleotide sequence
tgagtggagctcggagca

SEQ ID NO: 15313 - DNA, 18 bp, Artificial sequence
  synthetic polynucleotide sequence
ccagtggactgcccctga

SEQ ID NO: 15314 - DNA, 18 bp, Artificial sequence
  synthetic polynucleotide sequence
aacccccgtcagggctga

SEQ ID NO: 15315 - DNA, 18 bp, Artificial sequence
  synthetic polynucleotide sequence
ggcagcagaagaggccaa

SEQ ID NO: 15316 - DNA, 18 bp, Artificial sequence
  synthetic polynucleotide sequence
cctcagcttccccaggaa

SEQ ID NO: 15317 - DNA, 18 bp, Artificial sequence
  synthetic polynucleotide sequence
ccgaggctgacaagggca

SEQ ID NO: 15318 - DNA, 18 bp, Artificial sequence
  synthetic polynucleotide sequence
cctcccaagtaggagcca

SEQ ID NO: 15319 - DNA, 18 bp, Artificial sequence
  synthetic polynucleotide sequence
gccgaaccagctctgaga

SEQ ID NO: 15320 - DNA, 18 bp, Artificial sequence
  synthetic polynucleotide sequence
tccatatagcagggagga

SEQ ID NO: 15321 - DNA, 18 bp, Artificial sequence
  synthetic polynucleotide sequence
agcaggagatggtggaca

SEQ ID NO: 15322 - DNA, 18 bp, Artificial sequence
  synthetic polynucleotide sequence
agtccttgggggacacca

SEQ ID NO: 15323 - DNA, 18 bp, Artificial sequence
  synthetic polynucleotide sequence
gccagacctcctgagcca

SEQ ID NO: 15324 - DNA, 18 bp, Artificial sequence
  synthetic polynucleotide sequence
aggcttatcaggagggca

SEQ ID NO: 15325 - DNA, 18 bp, Artificial sequence
  synthetic polynucleotide sequence
cgaagagccgctgcacca

SEQ ID NO: 15326 - DNA, 18 bp, Artificial sequence
  synthetic polynucleotide sequence
ccacctctgtgccccaca

SEQ ID NO: 15327 - DNA, 18 bp, Artificial sequence
  synthetic polynucleotide sequence
aagtgaccctcgcccaga

SEQ ID NO: 15328 - DNA, 18 bp, Artificial sequence
  synthetic polynucleotide sequence
agctggccacactcacca

SEQ ID NO: 15329 - DNA, 18 bp, Artificial sequence
  synthetic polynucleotide sequence
aaggcacaccgaggccca

SEQ ID NO: 15330 - DNA, 18 bp, Artificial sequence
  synthetic polynucleotide sequence
aaggcacaccgaggccca

SEQ ID NO: 15331 - DNA, 18 bp, Artificial sequence
  synthetic polynucleotide sequence
aatggaacgcccgaggga

SEQ ID NO: 15332 - DNA, 18 bp, Artificial sequence
  synthetic polynucleotide sequence
catcagctgaagagggga

SEQ ID NO: 15333 - DNA, 18 bp, Artificial sequence
  synthetic polynucleotide sequence
gcatgctggcagaggaca

SEQ ID NO: 15334 - DNA, 18 bp, Artificial sequence
  synthetic polynucleotide sequence
ccagccacttgacaggca

SEQ ID NO: 15335 - DNA, 18 bp, Artificial sequence
  synthetic polynucleotide sequence
ggcccaggcccagagcga

SEQ ID NO: 15336 - DNA, 18 bp, Artificial sequence
  synthetic polynucleotide sequence
aagtacacggccagggca

SEQ ID NO: 15337 - DNA, 18 bp, Artificial sequence
  synthetic polynucleotide sequence
gcaccgaggatgggccaa

SEQ ID NO: 15338 - DNA, 18 bp, Artificial sequence
  synthetic polynucleotide sequence
cttccaagcactgagcga

SEQ ID NO: 15339 - DNA, 18 bp, Artificial sequence
  synthetic polynucleotide sequence
cccacctgaacttcagca

SEQ ID NO: 15340 - DNA, 18 bp, Artificial sequence
  synthetic polynucleotide sequence
accctgactggctcagca

SEQ ID NO: 15341 - DNA, 18 bp, Artificial sequence
  synthetic polynucleotide sequence
ctcatactgacggcagca

SEQ ID NO: 15342 - DNA, 18 bp, Artificial sequence
  synthetic polynucleotide sequence
taatggacagccgatcca

SEQ ID NO: 15343 - DNA, 18 bp, Artificial sequence
  synthetic polynucleotide sequence
ggcacttgcagggtcaca

SEQ ID NO: 15344 - DNA, 18 bp, Artificial sequence
  synthetic polynucleotide sequence
acgtcacggatcaggcca

SEQ ID NO: 15345 - DNA, 18 bp, Artificial sequence
  synthetic polynucleotide sequence
tccccgcattgaacagca

SEQ ID NO: 15346 - DNA, 18 bp, Artificial sequence
  synthetic polynucleotide sequence
gagcagactgtggagcaa

SEQ ID NO: 15347 - DNA, 18 bp, Artificial sequence
  synthetic polynucleotide sequence
gtggaggtggagggctga

SEQ ID NO: 15348 - DNA, 18 bp, Artificial sequence
  synthetic polynucleotide sequence
gtggaggtggagggctga

SEQ ID NO: 15349 - DNA, 18 bp, Artificial sequence
  synthetic polynucleotide sequence
ccctgagcagcagaagga

SEQ ID NO: 15350 - DNA, 18 bp, Artificial sequence
  synthetic polynucleotide sequence
ctagctgccgctaccaca

SEQ ID NO: 15351 - DNA, 18 bp, Artificial sequence
  synthetic polynucleotide sequence
cagcgccaccgatgagga

SEQ ID NO: 15352 - DNA, 18 bp, Artificial sequence
  synthetic polynucleotide sequence
agccactcgcacgcggca

SEQ ID NO: 15353 - DNA, 18 bp, Artificial sequence
  synthetic polynucleotide sequence
cggctcatggagatggga

SEQ ID NO: 15354 - DNA, 18 bp, Artificial sequence
  synthetic polynucleotide sequence
gcaggaagttggtggcga

SEQ ID NO: 15355 - DNA, 18 bp, Artificial sequence
  synthetic polynucleotide sequence
cacacctcccttccagca

SEQ ID NO: 15356 - DNA, 18 bp, Artificial sequence
  synthetic polynucleotide sequence
aggcccagaacctgcaga

SEQ ID NO: 15357 - DNA, 18 bp, Artificial sequence
  synthetic polynucleotide sequence
agcagatgcagcggggaa

SEQ ID NO: 15358 - DNA, 18 bp, Artificial sequence
  synthetic polynucleotide sequence
ttggcagactgcagggga

SEQ ID NO: 15359 - DNA, 15 bp, Artificial sequence
  synthetic polynucleotide sequence
agggacggggagcaa

SEQ ID NO: 15360 - DNA, 17 bp, Artificial sequence
  synthetic polynucleotide sequence
ccgctacatacgcacca

SEQ ID NO: 15361 - DNA, 18 bp, Artificial sequence
  synthetic polynucleotide sequence
gaccaggtgcagggtcga

SEQ ID NO: 15362 - DNA, 18 bp, Artificial sequence
  synthetic polynucleotide sequence
tccaggataaggaaggca

SEQ ID NO: 15363 - DNA, 18 bp, Artificial sequence
  synthetic polynucleotide sequence
agatcttggagcccagca

SEQ ID NO: 15364 - DNA, 18 bp, Artificial sequence
  synthetic polynucleotide sequence
ccgttccgaggaatggga

SEQ ID NO: 15365 - DNA, 18 bp, Artificial sequence
  synthetic polynucleotide sequence
tgaccgcgttccacacca

SEQ ID NO: 15366 - DNA, 18 bp, Artificial sequence
  synthetic polynucleotide sequence
tgaccgcgttccacacca

SEQ ID NO: 15367 - DNA, 18 bp, Artificial sequence
  synthetic polynucleotide sequence
gccctgctatcaccccaa

SEQ ID NO: 15368 - DNA, 18 bp, Artificial sequence
  synthetic polynucleotide sequence
ctgacatcatacagggca

SEQ ID NO: 15369 - DNA, 18 bp, Artificial sequence
  synthetic polynucleotide sequence
agcgcatatcaaggtgga

SEQ ID NO: 15370 - DNA, 18 bp, Artificial sequence
  synthetic polynucleotide sequence
agtcagagctggtgacca

SEQ ID NO: 15371 - DNA, 18 bp, Artificial sequence
  synthetic polynucleotide sequence
ggagtccagcactaacca

SEQ ID NO: 15372 - DNA, 18 bp, Artificial sequence
  synthetic polynucleotide sequence
ggcaatacttcccaccaa

SEQ ID NO: 15373 - DNA, 18 bp, Artificial sequence
  synthetic polynucleotide sequence
ctacgagagcagcgcgga

SEQ ID NO: 15374 - DNA, 18 bp, Artificial sequence
  synthetic polynucleotide sequence
ctgccagcatgctcacca

SEQ ID NO: 15375 - DNA, 18 bp, Artificial sequence
  synthetic polynucleotide sequence
gggactccgtgggaagga

SEQ ID NO: 15376 - DNA, 18 bp, Artificial sequence
  synthetic polynucleotide sequence
ctaagatggacaggcaca

SEQ ID NO: 15377 - DNA, 18 bp, Artificial sequence
  synthetic polynucleotide sequence
atcagtacagctgaccca

SEQ ID NO: 15378 - DNA, 18 bp, Artificial sequence
  synthetic polynucleotide sequence
cagcagcagagtcagaga

SEQ ID NO: 15379 - DNA, 18 bp, Artificial sequence
  synthetic polynucleotide sequence
tcagctaggtcagcccga

SEQ ID NO: 15380 - DNA, 18 bp, Artificial sequence
  synthetic polynucleotide sequence
gcaaccaaaaccgaccaa

SEQ ID NO: 15381 - DNA, 18 bp, Artificial sequence
  synthetic polynucleotide sequence
gcacattgagggcctcca

SEQ ID NO: 15382 - DNA, 18 bp, Artificial sequence
  synthetic polynucleotide sequence
tggacgagaacggacaga

SEQ ID NO: 15383 - DNA, 18 bp, Artificial sequence
  synthetic polynucleotide sequence
atagcagaactgtgcgga

SEQ ID NO: 15384 - DNA, 18 bp, Artificial sequence
  synthetic polynucleotide sequence
atagcagaactgtgcgga

SEQ ID NO: 15385 - DNA, 18 bp, Artificial sequence
  synthetic polynucleotide sequence
tcaccttcaccagcgcca

SEQ ID NO: 15386 - DNA, 18 bp, Artificial sequence
  synthetic polynucleotide sequence
ccatgatgccctcaggca

SEQ ID NO: 15387 - DNA, 18 bp, Artificial sequence
  synthetic polynucleotide sequence
cctccaggtcaccatcga

SEQ ID NO: 15388 - DNA, 18 bp, Artificial sequence
  synthetic polynucleotide sequence
cgcccacgttcgggtgga

SEQ ID NO: 15389 - DNA, 18 bp, Artificial sequence
  synthetic polynucleotide sequence
atgttagccacagagcca

SEQ ID NO: 15390 - DNA, 18 bp, Artificial sequence
  synthetic polynucleotide sequence
gagctcgcaggtcatcca

SEQ ID NO: 15391 - DNA, 18 bp, Artificial sequence
  synthetic polynucleotide sequence
atccatgggctccacaga

SEQ ID NO: 15392 - DNA, 18 bp, Artificial sequence
  synthetic polynucleotide sequence
ctctgcccagaagtgcca

SEQ ID NO: 15393 - DNA, 18 bp, Artificial sequence
  synthetic polynucleotide sequence
cccagatcacaggaggca

SEQ ID NO: 15394 - DNA, 18 bp, Artificial sequence
  synthetic polynucleotide sequence
gctgcaggaatgtgggca

SEQ ID NO: 15395 - DNA, 18 bp, Artificial sequence
  synthetic polynucleotide sequence
tccaggaaccaagacgca

SEQ ID NO: 15396 - DNA, 18 bp, Artificial sequence
  synthetic polynucleotide sequence
gctgcttgccaggaagca

SEQ ID NO: 15397 - DNA, 18 bp, Artificial sequence
  synthetic polynucleotide sequence
tcttcagaggaggggcca

SEQ ID NO: 15398 - DNA, 18 bp, Artificial sequence
  synthetic polynucleotide sequence
ggagatcaccacggcaga

SEQ ID NO: 15399 - DNA, 18 bp, Artificial sequence
  synthetic polynucleotide sequence
aagcagctgagctgggga

SEQ ID NO: 15400 - DNA, 18 bp, Artificial sequence
  synthetic polynucleotide sequence
ggcaggcacttggagaga

SEQ ID NO: 15401 - DNA, 18 bp, Artificial sequence
  synthetic polynucleotide sequence
acgccagttcaggggcca

SEQ ID NO: 15402 - DNA, 18 bp, Artificial sequence
  synthetic polynucleotide sequence
acgccagttcaggggcca

SEQ ID NO: 15403 - DNA, 18 bp, Artificial sequence
  synthetic polynucleotide sequence
ccaggagaagaaccagca

SEQ ID NO: 15404 - DNA, 18 bp, Artificial sequence
  synthetic polynucleotide sequence
gcttgagtagcacaagca

SEQ ID NO: 15405 - DNA, 18 bp, Artificial sequence
  synthetic polynucleotide sequence
ggagggcaaaacggtgga

SEQ ID NO: 15406 - DNA, 18 bp, Artificial sequence
  synthetic polynucleotide sequence
agacagcctgacgtcgga

SEQ ID NO: 15407 - DNA, 18 bp, Artificial sequence
  synthetic polynucleotide sequence
cagcgagagaggcaggga

SEQ ID NO: 15408 - DNA, 18 bp, Artificial sequence
  synthetic polynucleotide sequence
agggccctccattcagga

SEQ ID NO: 15409 - DNA, 18 bp, Artificial sequence
  synthetic polynucleotide sequence
cggcaagcggtcccccaa

SEQ ID NO: 15410 - DNA, 18 bp, Artificial sequence
  synthetic polynucleotide sequence
cgcagctcatcaacccga

SEQ ID NO: 15411 - DNA, 18 bp, Artificial sequence
  synthetic polynucleotide sequence
ttgggactcgggacggca

SEQ ID NO: 15412 - DNA, 18 bp, Artificial sequence
  synthetic polynucleotide sequence
agggtccgcagcaggtga

SEQ ID NO: 15413 - DNA, 18 bp, Artificial sequence
  synthetic polynucleotide sequence
ccatgtgggagcagctga

SEQ ID NO: 15414 - DNA, 18 bp, Artificial sequence
  synthetic polynucleotide sequence
cagtgacccctatcccaa

SEQ ID NO: 15415 - DNA, 18 bp, Artificial sequence
  synthetic polynucleotide sequence
gctccacccctggcccca

SEQ ID NO: 15416 - DNA, 18 bp, Artificial sequence
  synthetic polynucleotide sequence
cgcctcttcgggagagga

SEQ ID NO: 15417 - DNA, 18 bp, Artificial sequence
  synthetic polynucleotide sequence
tccagcgataagagccga

SEQ ID NO: 15418 - DNA, 18 bp, Artificial sequence
  synthetic polynucleotide sequence
agagccatctccacggaa

SEQ ID NO: 15419 - DNA, 18 bp, Artificial sequence
  synthetic polynucleotide sequence
ctgtactggcccagggca

SEQ ID NO: 15420 - DNA, 18 bp, Artificial sequence
  synthetic polynucleotide sequence
ctgtactggcccagggca

SEQ ID NO: 15421 - DNA, 18 bp, Artificial sequence
  synthetic polynucleotide sequence
tggatgggcagcccacca

SEQ ID NO: 15422 - DNA, 18 bp, Artificial sequence
  synthetic polynucleotide sequence
cgcggatgaaccaggcga

SEQ ID NO: 15423 - DNA, 18 bp, Artificial sequence
  synthetic polynucleotide sequence
aagaggtagcaacagcga

SEQ ID NO: 15424 - DNA, 18 bp, Artificial sequence
  synthetic polynucleotide sequence
acctgctgccaataacga

SEQ ID NO: 15425 - DNA, 18 bp, Artificial sequence
  synthetic polynucleotide sequence
ctgaaagccaacccagga

SEQ ID NO: 15426 - DNA, 18 bp, Artificial sequence
  synthetic polynucleotide sequence
atcagcatcagggggaga

SEQ ID NO: 15427 - DNA, 18 bp, Artificial sequence
  synthetic polynucleotide sequence
tgatgagccaccaccaga

SEQ ID NO: 15428 - DNA, 18 bp, Artificial sequence
  synthetic polynucleotide sequence
cggcatagagaatcacca

SEQ ID NO: 15429 - DNA, 18 bp, Artificial sequence
  synthetic polynucleotide sequence
ctgcctgtcaaaaccaca

SEQ ID NO: 15430 - DNA, 18 bp, Artificial sequence
  synthetic polynucleotide sequence
accaagggcactgtagga

SEQ ID NO: 15431 - DNA, 18 bp, Artificial sequence
  synthetic polynucleotide sequence
gagacaggtactgggcca

SEQ ID NO: 15432 - DNA, 18 bp, Artificial sequence
  synthetic polynucleotide sequence
gccattccaaagggagga

SEQ ID NO: 15433 - DNA, 18 bp, Artificial sequence
  synthetic polynucleotide sequence
gtccgttcgcaacaacca

SEQ ID NO: 15434 - DNA, 18 bp, Artificial sequence
  synthetic polynucleotide sequence
cgtgcacttggaggacca

SEQ ID NO: 15435 - DNA, 18 bp, Artificial sequence
  synthetic polynucleotide sequence
tgcccccaatgaagacca

SEQ ID NO: 15436 - DNA, 18 bp, Artificial sequence
  synthetic polynucleotide sequence
cgaccaattcagaccaca

SEQ ID NO: 15437 - DNA, 18 bp, Artificial sequence
  synthetic polynucleotide sequence
ctgtcagcacgacggcca

SEQ ID NO: 15438 - DNA, 18 bp, Artificial sequence
  synthetic polynucleotide sequence
ctgtcagcacgacggcca

SEQ ID NO: 15439 - DNA, 18 bp, Artificial sequence
  synthetic polynucleotide sequence
ccacaaaggagccaagca

SEQ ID NO: 15440 - DNA, 18 bp, Artificial sequence
  synthetic polynucleotide sequence
ccgttgtcacacagacca

SEQ ID NO: 15441 - DNA, 18 bp, Artificial sequence
  synthetic polynucleotide sequence
aagcccctggatcgagca

SEQ ID NO: 15442 - DNA, 18 bp, Artificial sequence
  synthetic polynucleotide sequence
agagtggtactggaacca

SEQ ID NO: 15443 - DNA, 18 bp, Artificial sequence
  synthetic polynucleotide sequence
ccttgcccagatcccaca

SEQ ID NO: 15444 - DNA, 18 bp, Artificial sequence
  synthetic polynucleotide sequence
acaagggaatgcccacca

SEQ ID NO: 15445 - DNA, 18 bp, Artificial sequence
  synthetic polynucleotide sequence
aagcccctgcatcgagca

SEQ ID NO: 15446 - DNA, 18 bp, Artificial sequence
  synthetic polynucleotide sequence
gtgaggtcacgggctgca

SEQ ID NO: 15447 - DNA, 18 bp, Artificial sequence
  synthetic polynucleotide sequence
aagccccttgatcgagca

SEQ ID NO: 15448 - DNA, 18 bp, Artificial sequence
  synthetic polynucleotide sequence
cgtgggctgcaacccgaa

SEQ ID NO: 15449 - DNA, 18 bp, Artificial sequence
  synthetic polynucleotide sequence
ctgaccattgaccccaga

SEQ ID NO: 15450 - DNA, 18 bp, Artificial sequence
  synthetic polynucleotide sequence
atggggaaagctgacgta

SEQ ID NO: 15451 - DNA, 18 bp, Artificial sequence
  synthetic polynucleotide sequence
acccagcagcttcccaca

SEQ ID NO: 15452 - DNA, 18 bp, Artificial sequence
  synthetic polynucleotide sequence
gactgggggagcgacgca

SEQ ID NO: 15453 - DNA, 18 bp, Artificial sequence
  synthetic polynucleotide sequence
ccccacgcagccaccaga

SEQ ID NO: 15454 - DNA, 18 bp, Artificial sequence
  synthetic polynucleotide sequence
gacgcacctcaagcccta

SEQ ID NO: 15455 - DNA, 18 bp, Artificial sequence
  synthetic polynucleotide sequence
cgattgacagggtgacca

SEQ ID NO: 15456 - DNA, 18 bp, Artificial sequence
  synthetic polynucleotide sequence
cgattgacagggtgacca

SEQ ID NO: 15457 - DNA, 18 bp, Artificial sequence
  synthetic polynucleotide sequence
gcggatgaagtcgaccga

SEQ ID NO: 15458 - DNA, 18 bp, Artificial sequence
  synthetic polynucleotide sequence
tcagctgaaggtgcacca

SEQ ID NO: 15459 - DNA, 19 bp, Artificial sequence
  synthetic polynucleotide sequence
agtgggagaagaacaggga

SEQ ID NO: 15460 - DNA, 17 bp, Artificial sequence
  synthetic polynucleotide sequence
gtgcctggggccagaga

SEQ ID NO: 15461 - DNA, 18 bp, Artificial sequence
  synthetic polynucleotide sequence
ccctcaccctgcaggcaa

SEQ ID NO: 15462 - DNA, 18 bp, Artificial sequence
  synthetic polynucleotide sequence
tggaaggacatggccaca

SEQ ID NO: 15463 - DNA, 18 bp, Artificial sequence
  synthetic polynucleotide sequence
caggcttagctcaaccca

SEQ ID NO: 15464 - DNA, 18 bp, Artificial sequence
  synthetic polynucleotide sequence
gccagggaggatgaagca

SEQ ID NO: 15465 - DNA, 18 bp, Artificial sequence
  synthetic polynucleotide sequence
ccaggacagatgcccaca

SEQ ID NO: 15466 - DNA, 18 bp, Artificial sequence
  synthetic polynucleotide sequence
ccggaacatctggacgga

SEQ ID NO: 15467 - DNA, 18 bp, Artificial sequence
  synthetic polynucleotide sequence
gcttactcgggagccaga

SEQ ID NO: 15468 - DNA, 18 bp, Artificial sequence
  synthetic polynucleotide sequence
ggggactacactagagca

SEQ ID NO: 15469 - DNA, 18 bp, Artificial sequence
  synthetic polynucleotide sequence
atcagctcctcggagaga

SEQ ID NO: 15470 - DNA, 18 bp, Artificial sequence
  synthetic polynucleotide sequence
gcactacttccgcaacca

SEQ ID NO: 15471 - DNA, 18 bp, Artificial sequence
  synthetic polynucleotide sequence
actccaccgtagccccga

SEQ ID NO: 15472 - DNA, 18 bp, Artificial sequence
  synthetic polynucleotide sequence
gtggacatcagcgcagga

SEQ ID NO: 15473 - DNA, 18 bp, Artificial sequence
  synthetic polynucleotide sequence
actgctggcacaccagga

SEQ ID NO: 15474 - DNA, 18 bp, Artificial sequence
  synthetic polynucleotide sequence
actgctggcacaccagga

SEQ ID NO: 15475 - DNA, 18 bp, Artificial sequence
  synthetic polynucleotide sequence
cccagctaacagacccga

SEQ ID NO: 15476 - DNA, 18 bp, Artificial sequence
  synthetic polynucleotide sequence
aggacaggtgtgtaggca

SEQ ID NO: 15477 - DNA, 18 bp, Artificial sequence
  synthetic polynucleotide sequence
ctgcaccgtgtcagagga

SEQ ID NO: 15478 - DNA, 18 bp, Artificial sequence
  synthetic polynucleotide sequence
gccggatagggagaggga

SEQ ID NO: 15479 - DNA, 18 bp, Artificial sequence
  synthetic polynucleotide sequence
acacggtgccatcccaga

SEQ ID NO: 15480 - DNA, 18 bp, Artificial sequence
  synthetic polynucleotide sequence
aggagcacctcagagcca

SEQ ID NO: 15481 - DNA, 18 bp, Artificial sequence
  synthetic polynucleotide sequence
ccagggttctccagggca

SEQ ID NO: 15482 - DNA, 18 bp, Artificial sequence
  synthetic polynucleotide sequence
tggccagacggaaggtga

SEQ ID NO: 15483 - DNA, 18 bp, Artificial sequence
  synthetic polynucleotide sequence
tatccacccccacaccaa

SEQ ID NO: 15484 - DNA, 18 bp, Artificial sequence
  synthetic polynucleotide sequence
ggacagcgttgagaagga

SEQ ID NO: 15485 - DNA, 18 bp, Artificial sequence
  synthetic polynucleotide sequence
agcagtccatcccggcta

SEQ ID NO: 15486 - DNA, 18 bp, Artificial sequence
  synthetic polynucleotide sequence
cgagcacttcccgaacga

SEQ ID NO: 15487 - DNA, 18 bp, Artificial sequence
  synthetic polynucleotide sequence
gcatgggtggcatgacca

SEQ ID NO: 15488 - DNA, 18 bp, Artificial sequence
  synthetic polynucleotide sequence
gcccgcttcatgaccaca

SEQ ID NO: 15489 - DNA, 18 bp, Artificial sequence
  synthetic polynucleotide sequence
agctgcatcgctggacga

SEQ ID NO: 15490 - DNA, 18 bp, Artificial sequence
  synthetic polynucleotide sequence
gagaggctgaagcggcaa

SEQ ID NO: 15491 - DNA, 18 bp, Artificial sequence
  synthetic polynucleotide sequence
ctgagggcaatggcgcca

SEQ ID NO: 15492 - DNA, 18 bp, Artificial sequence
  synthetic polynucleotide sequence
ctgagggcaatggcgcca

SEQ ID NO: 15493 - DNA, 18 bp, Artificial sequence
  synthetic polynucleotide sequence
cccacagctgctgaccga

SEQ ID NO: 15494 - DNA, 18 bp, Artificial sequence
  synthetic polynucleotide sequence
cgatagggtccagggcca

SEQ ID NO: 15495 - DNA, 18 bp, Artificial sequence
  synthetic polynucleotide sequence
caagaagctggtgcagga

SEQ ID NO: 15496 - DNA, 18 bp, Artificial sequence
  synthetic polynucleotide sequence
taggagcagagagcccca

SEQ ID NO: 15497 - DNA, 18 bp, Artificial sequence
  synthetic polynucleotide sequence
cccgcctgaggggtgaca

SEQ ID NO: 15498 - DNA, 22 bp, Artificial sequence
  synthetic polynucleotide sequence
caaagcaaccaatgtagaagca

SEQ ID NO: 15499 - DNA, 18 bp, Artificial sequence
  synthetic polynucleotide sequence
gtcccgacggcctacaca

SEQ ID NO: 15500 - DNA, 18 bp, Artificial sequence
  synthetic polynucleotide sequence
aaggtacccagtccagga

SEQ ID NO: 15501 - DNA, 20 bp, Artificial sequence
  synthetic polynucleotide sequence
gcctaaagagcagtggacca

SEQ ID NO: 15502 - DNA, 18 bp, Artificial sequence
  synthetic polynucleotide sequence
aacagctgcatccacaga

SEQ ID NO: 15503 - DNA, 18 bp, Artificial sequence
  synthetic polynucleotide sequence
agctgctcaatggggcca

SEQ ID NO: 15504 - DNA, 18 bp, Artificial sequence
  synthetic polynucleotide sequence
cccctggctgaatgggaa

SEQ ID NO: 15505 - DNA, 18 bp, Artificial sequence
  synthetic polynucleotide sequence
agcaactagagcctggga

SEQ ID NO: 15506 - DNA, 18 bp, Artificial sequence
  synthetic polynucleotide sequence
actatctcccaggccaca

SEQ ID NO: 15507 - DNA, 18 bp, Artificial sequence
  synthetic polynucleotide sequence
gcaatgggtacacagcca

SEQ ID NO: 15508 - DNA, 18 bp, Artificial sequence
  synthetic polynucleotide sequence
attgagcaggaagctgca

SEQ ID NO: 15509 - DNA, 18 bp, Artificial sequence
  synthetic polynucleotide sequence
cgagaggatacacgctca

SEQ ID NO: 15510 - DNA, 18 bp, Artificial sequence
  synthetic polynucleotide sequence
cgagaggatacacgctca

SEQ ID NO: 15511 - DNA, 18 bp, Artificial sequence
  synthetic polynucleotide sequence
cgcggatgcggcatgtga

SEQ ID NO: 15512 - DNA, 18 bp, Artificial sequence
  synthetic polynucleotide sequence
aactgcggcaccacgcga

SEQ ID NO: 15513 - DNA, 18 bp, Artificial sequence
  synthetic polynucleotide sequence
cacgctcttggaagccga

SEQ ID NO: 15514 - DNA, 18 bp, Artificial sequence
  synthetic polynucleotide sequence
acaccctggtagagggca

SEQ ID NO: 15515 - DNA, 18 bp, Artificial sequence
  synthetic polynucleotide sequence
ccgtgatgtggccaagca

SEQ ID NO: 15516 - DNA, 18 bp, Artificial sequence
  synthetic polynucleotide sequence
ccaaccacctcatagcca

SEQ ID NO: 15517 - DNA, 18 bp, Artificial sequence
  synthetic polynucleotide sequence
ggagcagggagagcagga

SEQ ID NO: 15518 - DNA, 18 bp, Artificial sequence
  synthetic polynucleotide sequence
ccaccatgccgctcagca

SEQ ID NO: 15519 - DNA, 18 bp, Artificial sequence
  synthetic polynucleotide sequence
gtgtgacacctgcagaga

SEQ ID NO: 15520 - DNA, 18 bp, Artificial sequence
  synthetic polynucleotide sequence
tgcaaggcagacagagga

SEQ ID NO: 15521 - DNA, 18 bp, Artificial sequence
  synthetic polynucleotide sequence
agcaaccacttcccctca

SEQ ID NO: 15522 - DNA, 18 bp, Artificial sequence
  synthetic polynucleotide sequence
caaggaatccagtgacca

SEQ ID NO: 15523 - DNA, 18 bp, Artificial sequence
  synthetic polynucleotide sequence
ctcagagctgggtgggga

SEQ ID NO: 15524 - DNA, 18 bp, Artificial sequence
  synthetic polynucleotide sequence
caacaaggacagcggcca

SEQ ID NO: 15525 - DNA, 18 bp, Artificial sequence
  synthetic polynucleotide sequence
ggaccacttccacagtga

SEQ ID NO: 15526 - DNA, 18 bp, Artificial sequence
  synthetic polynucleotide sequence
aggaagcacacaaacgga

SEQ ID NO: 15527 - DNA, 18 bp, Artificial sequence
  synthetic polynucleotide sequence
gctctcaaggcacctgca

SEQ ID NO: 15528 - DNA, 18 bp, Artificial sequence
  synthetic polynucleotide sequence
gctctcaaggcacctgca

SEQ ID NO: 15529 - DNA, 18 bp, Artificial sequence
  synthetic polynucleotide sequence
ggggacacctggtaccta

SEQ ID NO: 15530 - DNA, 18 bp, Artificial sequence
  synthetic polynucleotide sequence
agtgactgggcatcacca

SEQ ID NO: 15531 - DNA, 18 bp, Artificial sequence
  synthetic polynucleotide sequence
ccaaggcaagaaccgcaa

SEQ ID NO: 15532 - DNA, 18 bp, Artificial sequence
  synthetic polynucleotide sequence
gtaggcacagcttgcaca

SEQ ID NO: 15533 - DNA, 18 bp, Artificial sequence
  synthetic polynucleotide sequence
gcacgtgggaatggcaga

SEQ ID NO: 15534 - DNA, 18 bp, Artificial sequence
  synthetic polynucleotide sequence
gtcttcccaggacaccaa

SEQ ID NO: 15535 - DNA, 18 bp, Artificial sequence
  synthetic polynucleotide sequence
gccagtgacaaagccgga

SEQ ID NO: 15536 - DNA, 18 bp, Artificial sequence
  synthetic polynucleotide sequence
accagtctggcaccggca

SEQ ID NO: 15537 - DNA, 18 bp, Artificial sequence
  synthetic polynucleotide sequence
ggcattgggaagaccaga

SEQ ID NO: 15538 - DNA, 18 bp, Artificial sequence
  synthetic polynucleotide sequence
cgtttgggaccggaacca

SEQ ID NO: 15539 - DNA, 18 bp, Artificial sequence
  synthetic polynucleotide sequence
aacccactggtgtcagga

SEQ ID NO: 15540 - DNA, 18 bp, Artificial sequence
  synthetic polynucleotide sequence
tggcaatgcacagaacga

SEQ ID NO: 15541 - DNA, 18 bp, Artificial sequence
  synthetic polynucleotide sequence
cccttcatcagcagggca

SEQ ID NO: 15542 - DNA, 18 bp, Artificial sequence
  synthetic polynucleotide sequence
gaaggtggctcaagcgaa

SEQ ID NO: 15543 - DNA, 18 bp, Artificial sequence
  synthetic polynucleotide sequence
ccatcagtgagtcagcca

SEQ ID NO: 15544 - DNA, 18 bp, Artificial sequence
  synthetic polynucleotide sequence
tgcaagccaagagcagca

SEQ ID NO: 15545 - DNA, 18 bp, Artificial sequence
  synthetic polynucleotide sequence
ggaccggcacacgctgca

SEQ ID NO: 15546 - DNA, 18 bp, Artificial sequence
  synthetic polynucleotide sequence
ggaccggcacacgctgca

SEQ ID NO: 15547 - DNA, 18 bp, Artificial sequence
  synthetic polynucleotide sequence
ccctccatgagcagagca

SEQ ID NO: 15548 - DNA, 18 bp, Artificial sequence
  synthetic polynucleotide sequence
tccccacgtggatggaga

SEQ ID NO: 15549 - DNA, 18 bp, Artificial sequence
  synthetic polynucleotide sequence
gcactgtgcatacccgga

SEQ ID NO: 15550 - DNA, 18 bp, Artificial sequence
  synthetic polynucleotide sequence
ctgtgggcaccaagcaca

SEQ ID NO: 15551 - DNA, 18 bp, Artificial sequence
  synthetic polynucleotide sequence
ccagaggaacaagggcaa

SEQ ID NO: 15552 - DNA, 19 bp, Artificial sequence
  synthetic polynucleotide sequence
gcaaaacaggaaccaccca

SEQ ID NO: 15553 - DNA, 18 bp, Artificial sequence
  synthetic polynucleotide sequence
agtagccccagcaccaga

SEQ ID NO: 15554 - DNA, 18 bp, Artificial sequence
  synthetic polynucleotide sequence
ctcagatgcagcagccga

SEQ ID NO: 15555 - DNA, 18 bp, Artificial sequence
  synthetic polynucleotide sequence
cccagtatcaccaggcaa

SEQ ID NO: 15556 - DNA, 18 bp, Artificial sequence
  synthetic polynucleotide sequence
gagaggtgactgtcagca

SEQ ID NO: 15557 - DNA, 18 bp, Artificial sequence
  synthetic polynucleotide sequence
actcgcctggaagctgga

SEQ ID NO: 15558 - DNA, 18 bp, Artificial sequence
  synthetic polynucleotide sequence
aaacggaggccacgcgaa

SEQ ID NO: 15559 - DNA, 18 bp, Artificial sequence
  synthetic polynucleotide sequence
cctggagcgcctgcagga

SEQ ID NO: 15560 - DNA, 18 bp, Artificial sequence
  synthetic polynucleotide sequence
gaagtgcgagtggccaga

SEQ ID NO: 15561 - DNA, 18 bp, Artificial sequence
  synthetic polynucleotide sequence
aggagagagctcttacga

SEQ ID NO: 15562 - DNA, 18 bp, Artificial sequence
  synthetic polynucleotide sequence
ggaagctaagcactcgga

SEQ ID NO: 15563 - DNA, 18 bp, Artificial sequence
  synthetic polynucleotide sequence
actaccacgatgatggca

SEQ ID NO: 15564 - DNA, 18 bp, Artificial sequence
  synthetic polynucleotide sequence
actaccacgatgatggca

SEQ ID NO: 15565 - DNA, 18 bp, Artificial sequence
  synthetic polynucleotide sequence
agccaagctcaagcgcaa

SEQ ID NO: 15566 - DNA, 18 bp, Artificial sequence
  synthetic polynucleotide sequence
gatgaggatgatggcgca

SEQ ID NO: 15567 - DNA, 18 bp, Artificial sequence
  synthetic polynucleotide sequence
ggttctggaaagagacca

SEQ ID NO: 15568 - DNA, 18 bp, Artificial sequence
  synthetic polynucleotide sequence
gagaagcgcctgcctgca

SEQ ID NO: 15569 - DNA, 18 bp, Artificial sequence
  synthetic polynucleotide sequence
attgagagaggggagaga

SEQ ID NO: 15570 - DNA, 18 bp, Artificial sequence
  synthetic polynucleotide sequence
tgcatccacgccaccaca

SEQ ID NO: 15571 - DNA, 18 bp, Artificial sequence
  synthetic polynucleotide sequence
cagcagcgttcagaccaa

SEQ ID NO: 15572 - DNA, 18 bp, Artificial sequence
  synthetic polynucleotide sequence
tcaggatgatgagcagga

SEQ ID NO: 15573 - DNA, 18 bp, Artificial sequence
  synthetic polynucleotide sequence
ggttcaagagcacagaca

SEQ ID NO: 15574 - DNA, 18 bp, Artificial sequence
  synthetic polynucleotide sequence
agctgtgcagctaagaca

SEQ ID NO: 15575 - DNA, 18 bp, Artificial sequence
  synthetic polynucleotide sequence
gggccaggatccgctcca

SEQ ID NO: 15576 - DNA, 18 bp, Artificial sequence
  synthetic polynucleotide sequence
gcggaacctgcaaagtga

SEQ ID NO: 15577 - DNA, 18 bp, Artificial sequence
  synthetic polynucleotide sequence
gaggctgaagtccaagca

SEQ ID NO: 15578 - DNA, 18 bp, Artificial sequence
  synthetic polynucleotide sequence
caacggcatgacccccaa

SEQ ID NO: 15579 - DNA, 18 bp, Artificial sequence
  synthetic polynucleotide sequence
gaagtgacagtcggagca

SEQ ID NO: 15580 - DNA, 18 bp, Artificial sequence
  synthetic polynucleotide sequence
ctgtgtggaaagaggcaa

SEQ ID NO: 15581 - DNA, 18 bp, Artificial sequence
  synthetic polynucleotide sequence
acagcttccaggcgctca

SEQ ID NO: 15582 - DNA, 18 bp, Artificial sequence
  synthetic polynucleotide sequence
acagcttccaggcgctca

SEQ ID NO: 15583 - DNA, 18 bp, Artificial sequence
  synthetic polynucleotide sequence
gaccacttccgagaccca

SEQ ID NO: 15584 - DNA, 18 bp, Artificial sequence
  synthetic polynucleotide sequence
cctcagctcctggacgaa

SEQ ID NO: 15585 - DNA, 18 bp, Artificial sequence
  synthetic polynucleotide sequence
atcgcagggctcaggaca

SEQ ID NO: 15586 - DNA, 18 bp, Artificial sequence
  synthetic polynucleotide sequence
tgaggagggccatggaca

SEQ ID NO: 15587 - DNA, 18 bp, Artificial sequence
  synthetic polynucleotide sequence
ggcaccttctaccaggga

SEQ ID NO: 15588 - DNA, 18 bp, Artificial sequence
  synthetic polynucleotide sequence
accctcccaccacggaga

SEQ ID NO: 15589 - DNA, 18 bp, Artificial sequence
  synthetic polynucleotide sequence
gtccaaaagtgctgggca

SEQ ID NO: 15590 - DNA, 18 bp, Artificial sequence
  synthetic polynucleotide sequence
aaccagcccaccctgcca

SEQ ID NO: 15591 - DNA, 18 bp, Artificial sequence
  synthetic polynucleotide sequence
gctggatgaacagtacca

SEQ ID NO: 15592 - DNA, 18 bp, Artificial sequence
  synthetic polynucleotide sequence
tacattagcccccaacca

SEQ ID NO: 15593 - DNA, 18 bp, Artificial sequence
  synthetic polynucleotide sequence
cggatggtataggcgcca

SEQ ID NO: 15594 - DNA, 18 bp, Artificial sequence
  synthetic polynucleotide sequence
caggctggaagaagcaga

SEQ ID NO: 15595 - DNA, 18 bp, Artificial sequence
  synthetic polynucleotide sequence
ggcagcagcttctccaga

SEQ ID NO: 15596 - DNA, 18 bp, Artificial sequence
  synthetic polynucleotide sequence
ggcacagaccactgagca

SEQ ID NO: 15597 - DNA, 18 bp, Artificial sequence
  synthetic polynucleotide sequence
gggcattgtgaaccagca

SEQ ID NO: 15598 - DNA, 18 bp, Artificial sequence
  synthetic polynucleotide sequence
ccacagtgaaggccacca

SEQ ID NO: 15599 - DNA, 18 bp, Artificial sequence
  synthetic polynucleotide sequence
gctgcagcagactgacca

SEQ ID NO: 15600 - DNA, 18 bp, Artificial sequence
  synthetic polynucleotide sequence
gctgcagcagactgacca

SEQ ID NO: 15601 - DNA, 18 bp, Artificial sequence
  synthetic polynucleotide sequence
ggtacaagcgggagcaca

SEQ ID NO: 15602 - DNA, 18 bp, Artificial sequence
  synthetic polynucleotide sequence
ggccagccagccctcgta

SEQ ID NO: 15603 - DNA, 18 bp, Artificial sequence
  synthetic polynucleotide sequence
catcaggtaccaactgca

SEQ ID NO: 15604 - DNA, 18 bp, Artificial sequence
  synthetic polynucleotide sequence
aactccagggcgagccca

SEQ ID NO: 15605 - DNA, 18 bp, Artificial sequence
  synthetic polynucleotide sequence
ccttcacccagaaatgga

SEQ ID NO: 15606 - DNA, 18 bp, Artificial sequence
  synthetic polynucleotide sequence
ctgatagccagcaagcca

SEQ ID NO: 15607 - DNA, 18 bp, Artificial sequence
  synthetic polynucleotide sequence
cgtgaccaaagccggaca

SEQ ID NO: 15608 - DNA, 18 bp, Artificial sequence
  synthetic polynucleotide sequence
tcctgcaccccaggacga

SEQ ID NO: 15609 - DNA, 18 bp, Artificial sequence
  synthetic polynucleotide sequence
tcagcgcagctactgcca

SEQ ID NO: 15610 - DNA, 18 bp, Artificial sequence
  synthetic polynucleotide sequence
cagtgggcacacactcca

SEQ ID NO: 15611 - DNA, 18 bp, Artificial sequence
  synthetic polynucleotide sequence
acagaacggggctgggga

SEQ ID NO: 15612 - DNA, 18 bp, Artificial sequence
  synthetic polynucleotide sequence
cctggaagaacacagcca

SEQ ID NO: 15613 - DNA, 18 bp, Artificial sequence
  synthetic polynucleotide sequence
ccacagctggcaggccga

SEQ ID NO: 15614 - DNA, 18 bp, Artificial sequence
  synthetic polynucleotide sequence
acaagacctgccccacca

SEQ ID NO: 15615 - DNA, 18 bp, Artificial sequence
  synthetic polynucleotide sequence
agggcccaagattgagga

SEQ ID NO: 15616 - DNA, 18 bp, Artificial sequence
  synthetic polynucleotide sequence
gacatacctggtgagcca

SEQ ID NO: 15617 - DNA, 18 bp, Artificial sequence
  synthetic polynucleotide sequence
cagactgggtcactggca

SEQ ID NO: 15618 - DNA, 18 bp, Artificial sequence
  synthetic polynucleotide sequence
cagactgggtcactggca

SEQ ID NO: 15619 - DNA, 18 bp, Artificial sequence
  synthetic polynucleotide sequence
cccttcccgaaacccaca

SEQ ID NO: 15620 - DNA, 18 bp, Artificial sequence
  synthetic polynucleotide sequence
ccttggacaggggtgcca

SEQ ID NO: 15621 - DNA, 18 bp, Artificial sequence
  synthetic polynucleotide sequence
ccacagctaccgaggtca

SEQ ID NO: 15622 - DNA, 18 bp, Artificial sequence
  synthetic polynucleotide sequence
ggctccggacaacctgga

SEQ ID NO: 15623 - DNA, 18 bp, Artificial sequence
  synthetic polynucleotide sequence
tggacacctggcaggaga

SEQ ID NO: 15624 - DNA, 18 bp, Artificial sequence
  synthetic polynucleotide sequence
cctgcttgaccagcacga

SEQ ID NO: 15625 - DNA, 18 bp, Artificial sequence
  synthetic polynucleotide sequence
caatgacgccctgcgcca

SEQ ID NO: 15626 - DNA, 18 bp, Artificial sequence
  synthetic polynucleotide sequence
cacgaaggtgacgagcca

SEQ ID NO: 15627 - DNA, 18 bp, Artificial sequence
  synthetic polynucleotide sequence
gggagcaaatgaacctga

SEQ ID NO: 15628 - DNA, 18 bp, Artificial sequence
  synthetic polynucleotide sequence
ccatcagcatgcctggca

SEQ ID NO: 15629 - DNA, 18 bp, Artificial sequence
  synthetic polynucleotide sequence
ggcttggaagctggagga

SEQ ID NO: 15630 - DNA, 18 bp, Artificial sequence
  synthetic polynucleotide sequence
gaaccccaaataccggca

SEQ ID NO: 15631 - DNA, 18 bp, Artificial sequence
  synthetic polynucleotide sequence
agtagaggacggccacca

SEQ ID NO: 15632 - DNA, 18 bp, Artificial sequence
  synthetic polynucleotide sequence
gtacaagaggctggccaa

SEQ ID NO: 15633 - DNA, 18 bp, Artificial sequence
  synthetic polynucleotide sequence
ccttcagatgggcagcca

SEQ ID NO: 15634 - DNA, 18 bp, Artificial sequence
  synthetic polynucleotide sequence
caacttcgccctggagca

SEQ ID NO: 15635 - DNA, 18 bp, Artificial sequence
  synthetic polynucleotide sequence
agcgagagacaccaggga

SEQ ID NO: 15636 - DNA, 18 bp, Artificial sequence
  synthetic polynucleotide sequence
agcgagagacaccaggga

SEQ ID NO: 15637 - DNA, 18 bp, Artificial sequence
  synthetic polynucleotide sequence
gcgggagaaggagcggga

SEQ ID NO: 15638 - DNA, 18 bp, Artificial sequence
  synthetic polynucleotide sequence
gtaggccaggtacaggga

SEQ ID NO: 15639 - DNA, 18 bp, Artificial sequence
  synthetic polynucleotide sequence
gcctgccagcaccacaga

SEQ ID NO: 15640 - DNA, 18 bp, Artificial sequence
  synthetic polynucleotide sequence
agaatggcccatgcggca

SEQ ID NO: 15641 - DNA, 18 bp, Artificial sequence
  synthetic polynucleotide sequence
cgtcctaggcaatacgca

SEQ ID NO: 15642 - DNA, 18 bp, Artificial sequence
  synthetic polynucleotide sequence
gtgggtgcctccacgcga

SEQ ID NO: 15643 - DNA, 18 bp, Artificial sequence
  synthetic polynucleotide sequence
gcacagacactgcgtgca

SEQ ID NO: 15644 - DNA, 18 bp, Artificial sequence
  synthetic polynucleotide sequence
gggaggctctgggggaga

SEQ ID NO: 15645 - DNA, 19 bp, Artificial sequence
  synthetic polynucleotide sequence
gtacccaaggagcctgaga

SEQ ID NO: 15646 - DNA, 18 bp, Artificial sequence
  synthetic polynucleotide sequence
cctcatgcccatagccca

SEQ ID NO: 15647 - DNA, 18 bp, Artificial sequence
  synthetic polynucleotide sequence
ataggcccagatgatcca

SEQ ID NO: 15648 - DNA, 18 bp, Artificial sequence
  synthetic polynucleotide sequence
acaacttgtggacggcca

SEQ ID NO: 15649 - DNA, 18 bp, Artificial sequence
  synthetic polynucleotide sequence
ggggcaagctgactccca

SEQ ID NO: 15650 - DNA, 18 bp, Artificial sequence
  synthetic polynucleotide sequence
gcacacagtagaaggcca

SEQ ID NO: 15651 - DNA, 18 bp, Artificial sequence
  synthetic polynucleotide sequence
gccatggaattcccgaca

SEQ ID NO: 15652 - DNA, 18 bp, Artificial sequence
  synthetic polynucleotide sequence
cggcccaggagcccagca

SEQ ID NO: 15653 - DNA, 18 bp, Artificial sequence
  synthetic polynucleotide sequence
ctcaggctgcagctcaga

SEQ ID NO: 15654 - DNA, 18 bp, Artificial sequence
  synthetic polynucleotide sequence
ctcaggctgcagctcaga

SEQ ID NO: 15655 - DNA, 18 bp, Artificial sequence
  synthetic polynucleotide sequence
accagcagcgggcaggca

SEQ ID NO: 15656 - DNA, 18 bp, Artificial sequence
  synthetic polynucleotide sequence
ccgagaatcgatcgggga

SEQ ID NO: 15657 - DNA, 18 bp, Artificial sequence
  synthetic polynucleotide sequence
catgcaccgcatgagcca

SEQ ID NO: 15658 - DNA, 18 bp, Artificial sequence
  synthetic polynucleotide sequence
acgccgacatgccgctca

SEQ ID NO: 15659 - DNA, 18 bp, Artificial sequence
  synthetic polynucleotide sequence
ctccccactcagcaagga

SEQ ID NO: 15660 - DNA, 18 bp, Artificial sequence
  synthetic polynucleotide sequence
ccggctggtgtggaggga

SEQ ID NO: 15661 - DNA, 18 bp, Artificial sequence
  synthetic polynucleotide sequence
gcatcgctggagtcccca

SEQ ID NO: 15662 - DNA, 18 bp, Artificial sequence
  synthetic polynucleotide sequence
aacgctcccgacgccgca

SEQ ID NO: 15663 - DNA, 18 bp, Artificial sequence
  synthetic polynucleotide sequence
ctctcatcagaggcagca

SEQ ID NO: 15664 - DNA, 18 bp, Artificial sequence
  synthetic polynucleotide sequence
agcaatggggtgatggca

SEQ ID NO: 15665 - DNA, 18 bp, Artificial sequence
  synthetic polynucleotide sequence
tcaatggcaccagggtca

SEQ ID NO: 15666 - DNA, 18 bp, Artificial sequence
  synthetic polynucleotide sequence
cagtctcacggaagcaga

SEQ ID NO: 15667 - DNA, 18 bp, Artificial sequence
  synthetic polynucleotide sequence
atgtagaccagaccccca

SEQ ID NO: 15668 - DNA, 18 bp, Artificial sequence
  synthetic polynucleotide sequence
gctgcaaaaccagagcaa

SEQ ID NO: 15669 - DNA, 18 bp, Artificial sequence
  synthetic polynucleotide sequence
tggctcagcaagggccca

SEQ ID NO: 15670 - DNA, 18 bp, Artificial sequence
  synthetic polynucleotide sequence
ggctgaggagaagcagga

SEQ ID NO: 15671 - DNA, 18 bp, Artificial sequence
  synthetic polynucleotide sequence
gctccagctccagctcga

SEQ ID NO: 15672 - DNA, 18 bp, Artificial sequence
  synthetic polynucleotide sequence
gctccagctccagctcga

SEQ ID NO: 15673 - DNA, 18 bp, Artificial sequence
  synthetic polynucleotide sequence
ccagctgtcggatggcaa

SEQ ID NO: 15674 - DNA, 18 bp, Artificial sequence
  synthetic polynucleotide sequence
agcgtcacattgccccca

SEQ ID NO: 15675 - DNA, 18 bp, Artificial sequence
  synthetic polynucleotide sequence
tgccccagggaatgagga

SEQ ID NO: 15676 - DNA, 18 bp, Artificial sequence
  synthetic polynucleotide sequence
ggcccttggcagtgcaga

SEQ ID NO: 15677 - DNA, 18 bp, Artificial sequence
  synthetic polynucleotide sequence
gagctcggcagaaaacga

SEQ ID NO: 15678 - DNA, 18 bp, Artificial sequence
  synthetic polynucleotide sequence
tgcagctgaagatggcga

SEQ ID NO: 15679 - DNA, 18 bp, Artificial sequence
  synthetic polynucleotide sequence
aggggcagaatgtggaga

SEQ ID NO: 15680 - DNA, 18 bp, Artificial sequence
  synthetic polynucleotide sequence
tgtcgggcaagagctcca

SEQ ID NO: 15681 - DNA, 18 bp, Artificial sequence
  synthetic polynucleotide sequence
ccgtagctacaccacaga

SEQ ID NO: 15682 - DNA, 18 bp, Artificial sequence
  synthetic polynucleotide sequence
ccaagagcaggcgcagga

SEQ ID NO: 15683 - DNA, 18 bp, Artificial sequence
  synthetic polynucleotide sequence
cgggaggggcttcgggca

SEQ ID NO: 15684 - DNA, 18 bp, Artificial sequence
  synthetic polynucleotide sequence
cgacttcagcgacggcaa

SEQ ID NO: 15685 - DNA, 18 bp, Artificial sequence
  synthetic polynucleotide sequence
gcatcaggtaagggctga

SEQ ID NO: 15686 - DNA, 18 bp, Artificial sequence
  synthetic polynucleotide sequence
tgccaaagcaacagggga

SEQ ID NO: 15687 - DNA, 18 bp, Artificial sequence
  synthetic polynucleotide sequence
tccctaggatgacgagca

SEQ ID NO: 15688 - DNA, 18 bp, Artificial sequence
  synthetic polynucleotide sequence
cgtgaaagacttcgggaa

SEQ ID NO: 15689 - DNA, 18 bp, Artificial sequence
  synthetic polynucleotide sequence
ccagccagtactgagcga

SEQ ID NO: 15690 - DNA, 18 bp, Artificial sequence
  synthetic polynucleotide sequence
ccagccagtactgagcga

SEQ ID NO: 15691 - DNA, 18 bp, Artificial sequence
  synthetic polynucleotide sequence
ccagcagctgccagggaa

SEQ ID NO: 15692 - DNA, 18 bp, Artificial sequence
  synthetic polynucleotide sequence
gcacgttggactcaggca

SEQ ID NO: 15693 - DNA, 18 bp, Artificial sequence
  synthetic polynucleotide sequence
ctgcccagaagctgagga

SEQ ID NO: 15694 - DNA, 18 bp, Artificial sequence
  synthetic polynucleotide sequence
cccactcacctccacaca

SEQ ID NO: 15695 - DNA, 18 bp, Artificial sequence
  synthetic polynucleotide sequence
gagagaagcccaggagga

SEQ ID NO: 15696 - DNA, 18 bp, Artificial sequence
  synthetic polynucleotide sequence
gctgatgccgtgggagga

SEQ ID NO: 15697 - DNA, 18 bp, Artificial sequence
  synthetic polynucleotide sequence
atgcccagctgaccggga

SEQ ID NO: 15698 - DNA, 18 bp, Artificial sequence
  synthetic polynucleotide sequence
agcaaggacttggcagca

SEQ ID NO: 15699 - DNA, 18 bp, Artificial sequence
  synthetic polynucleotide sequence
tccaggctactgacgcga

SEQ ID NO: 15700 - DNA, 18 bp, Artificial sequence
  synthetic polynucleotide sequence
ccggaggtcgactccaca

SEQ ID NO: 15701 - DNA, 18 bp, Artificial sequence
  synthetic polynucleotide sequence
acacactccgtctgggga

SEQ ID NO: 15702 - DNA, 18 bp, Artificial sequence
  synthetic polynucleotide sequence
ccacgtcgacacgagcca

SEQ ID NO: 15703 - DNA, 18 bp, Artificial sequence
  synthetic polynucleotide sequence
agcagtccccaggaagca

SEQ ID NO: 15704 - DNA, 18 bp, Artificial sequence
  synthetic polynucleotide sequence
gggaaggaaggtggcgaa

SEQ ID NO: 15705 - DNA, 18 bp, Artificial sequence
  synthetic polynucleotide sequence
tgccccttcaggaccaga

SEQ ID NO: 15706 - DNA, 18 bp, Artificial sequence
  synthetic polynucleotide sequence
gaaaacaaccagccccca

SEQ ID NO: 15707 - DNA, 18 bp, Artificial sequence
  synthetic polynucleotide sequence
gacactgctcctccagga

SEQ ID NO: 15708 - DNA, 18 bp, Artificial sequence
  synthetic polynucleotide sequence
gacactgctcctccagga

SEQ ID NO: 15709 - DNA, 18 bp, Artificial sequence
  synthetic polynucleotide sequence
cgacgacaagctcgagca

SEQ ID NO: 15710 - DNA, 18 bp, Artificial sequence
  synthetic polynucleotide sequence
ctgcgatcaagggctgca

SEQ ID NO: 15711 - DNA, 18 bp, Artificial sequence
  synthetic polynucleotide sequence
cagggcaggaatcagcga

SEQ ID NO: 15712 - DNA, 18 bp, Artificial sequence
  synthetic polynucleotide sequence
acagggggcagtggacca

SEQ ID NO: 15713 - DNA, 18 bp, Artificial sequence
  synthetic polynucleotide sequence
gagcagcgtgaacaggaa

SEQ ID NO: 15714 - DNA, 18 bp, Artificial sequence
  synthetic polynucleotide sequence
aacagcaatacggcgaga

SEQ ID NO: 15715 - DNA, 18 bp, Artificial sequence
  synthetic polynucleotide sequence
cagccaacaggaggagca

SEQ ID NO: 15716 - DNA, 18 bp, Artificial sequence
  synthetic polynucleotide sequence
agcaggtcgctacgggca

SEQ ID NO: 15717 - DNA, 18 bp, Artificial sequence
  synthetic polynucleotide sequence
agcctgcacagccaccaa

SEQ ID NO: 15718 - DNA, 18 bp, Artificial sequence
  synthetic polynucleotide sequence
cgctgtactccacggcaa

SEQ ID NO: 15719 - DNA, 18 bp, Artificial sequence
  synthetic polynucleotide sequence
ccactggccctaccccca

SEQ ID NO: 15720 - DNA, 18 bp, Artificial sequence
  synthetic polynucleotide sequence
acagctgcacctccacca

SEQ ID NO: 15721 - DNA, 18 bp, Artificial sequence
  synthetic polynucleotide sequence
ccagggtttggcaaggga

SEQ ID NO: 15722 - DNA, 18 bp, Artificial sequence
  synthetic polynucleotide sequence
cctggcatgatgcgccca

SEQ ID NO: 15723 - DNA, 18 bp, Artificial sequence
  synthetic polynucleotide sequence
tgcagccctggcaccaca

SEQ ID NO: 15724 - DNA, 18 bp, Artificial sequence
  synthetic polynucleotide sequence
gcacgtcaactgcagcca

SEQ ID NO: 15725 - DNA, 18 bp, Artificial sequence
  synthetic polynucleotide sequence
ccactgagtagccctcca

SEQ ID NO: 15726 - DNA, 18 bp, Artificial sequence
  synthetic polynucleotide sequence
ccactgagtagccctcca

SEQ ID NO: 15727 - DNA, 18 bp, Artificial sequence
  synthetic polynucleotide sequence
cccacgaggaggaaggaa

SEQ ID NO: 15728 - DNA, 18 bp, Artificial sequence
  synthetic polynucleotide sequence
tgaccgtcgtgaggggga

SEQ ID NO: 15729 - DNA, 18 bp, Artificial sequence
  synthetic polynucleotide sequence
cccccatgacaaccgaca

SEQ ID NO: 15730 - DNA, 18 bp, Artificial sequence
  synthetic polynucleotide sequence
actccatgccgagcagca

SEQ ID NO: 15731 - DNA, 18 bp, Artificial sequence
  synthetic polynucleotide sequence
ggaagacctccagacgaa

SEQ ID NO: 15732 - DNA, 18 bp, Artificial sequence
  synthetic polynucleotide sequence
aggcaacgtggacaggta

SEQ ID NO: 15733 - DNA, 18 bp, Artificial sequence
  synthetic polynucleotide sequence
tcccttggccagcagaga

SEQ ID NO: 15734 - DNA, 18 bp, Artificial sequence
  synthetic polynucleotide sequence
aggaggaggatcagctga

SEQ ID NO: 15735 - DNA, 18 bp, Artificial sequence
  synthetic polynucleotide sequence
aacctcatgaggaccgaa

SEQ ID NO: 15736 - DNA, 18 bp, Artificial sequence
  synthetic polynucleotide sequence
acaggagcattgcagaca

SEQ ID NO: 15737 - DNA, 18 bp, Artificial sequence
  synthetic polynucleotide sequence
gtgaacaggcaggaggca

SEQ ID NO: 15738 - DNA, 18 bp, Artificial sequence
  synthetic polynucleotide sequence
cgcccatgaagatccgca

SEQ ID NO: 15739 - DNA, 18 bp, Artificial sequence
  synthetic polynucleotide sequence
aggcacatctgtcaggca

SEQ ID NO: 15740 - DNA, 18 bp, Artificial sequence
  synthetic polynucleotide sequence
cggtcaagcatgacagca

SEQ ID NO: 15741 - DNA, 18 bp, Artificial sequence
  synthetic polynucleotide sequence
ccctgcctgacaagagga

SEQ ID NO: 15742 - DNA, 18 bp, Artificial sequence
  synthetic polynucleotide sequence
tgaaggggctggcaggca

SEQ ID NO: 15743 - DNA, 18 bp, Artificial sequence
  synthetic polynucleotide sequence
aagcagcagatggcagga

SEQ ID NO: 15744 - DNA, 18 bp, Artificial sequence
  synthetic polynucleotide sequence
aagcagcagatggcagga

SEQ ID NO: 15745 - DNA, 18 bp, Artificial sequence
  synthetic polynucleotide sequence
cgtcggttacagcgggaa

SEQ ID NO: 15746 - DNA, 18 bp, Artificial sequence
  synthetic polynucleotide sequence
agtgcaggtcctccacca

SEQ ID NO: 15747 - DNA, 18 bp, Artificial sequence
  synthetic polynucleotide sequence
ccctggatccagaaccca

SEQ ID NO: 15748 - DNA, 18 bp, Artificial sequence
  synthetic polynucleotide sequence
aacagccggatgacgcca

SEQ ID NO: 15749 - DNA, 18 bp, Artificial sequence
  synthetic polynucleotide sequence
tgcctctgaagaaggaga

SEQ ID NO: 15750 - DNA, 18 bp, Artificial sequence
  synthetic polynucleotide sequence
actgtgagggcaagcgca

SEQ ID NO: 15751 - DNA, 18 bp, Artificial sequence
  synthetic polynucleotide sequence
cctggatggccctgagga

SEQ ID NO: 15752 - DNA, 18 bp, Artificial sequence
  synthetic polynucleotide sequence
gtggcactcatagcccga

SEQ ID NO: 15753 - DNA, 18 bp, Artificial sequence
  synthetic polynucleotide sequence
caaagtctgccagcagca

SEQ ID NO: 15754 - DNA, 18 bp, Artificial sequence
  synthetic polynucleotide sequence
catgcaaacattcccaca

SEQ ID NO: 15755 - DNA, 18 bp, Artificial sequence
  synthetic polynucleotide sequence
acagaaggctgaacagca

SEQ ID NO: 15756 - DNA, 18 bp, Artificial sequence
  synthetic polynucleotide sequence
gtgagaagcgacccagca

SEQ ID NO: 15757 - DNA, 18 bp, Artificial sequence
  synthetic polynucleotide sequence
tccacaataggtccagca

SEQ ID NO: 15758 - DNA, 18 bp, Artificial sequence
  synthetic polynucleotide sequence
ggggaaagccaaatgtca

SEQ ID NO: 15759 - DNA, 18 bp, Artificial sequence
  synthetic polynucleotide sequence
acttgaagccacagtgca

SEQ ID NO: 15760 - DNA, 18 bp, Artificial sequence
  synthetic polynucleotide sequence
caagtccgatcctcccca

SEQ ID NO: 15761 - DNA, 18 bp, Artificial sequence
  synthetic polynucleotide sequence
tatcccacagaaggagga

SEQ ID NO: 15762 - DNA, 18 bp, Artificial sequence
  synthetic polynucleotide sequence
tatcccacagaaggagga

SEQ ID NO: 15763 - DNA, 18 bp, Artificial sequence
  synthetic polynucleotide sequence
tgcgtctcggacagcgaa

SEQ ID NO: 15764 - DNA, 18 bp, Artificial sequence
  synthetic polynucleotide sequence
cagaggccgagctgggga

SEQ ID NO: 15765 - DNA, 18 bp, Artificial sequence
  synthetic polynucleotide sequence
gcacctgcctcggagaca

SEQ ID NO: 15766 - DNA, 18 bp, Artificial sequence
  synthetic polynucleotide sequence
gggacacagaagcggcca

SEQ ID NO: 15767 - DNA, 18 bp, Artificial sequence
  synthetic polynucleotide sequence
actcagactgctcgggca

SEQ ID NO: 15768 - DNA, 18 bp, Artificial sequence
  synthetic polynucleotide sequence
tctggcaggatcccggca

SEQ ID NO: 15769 - DNA, 18 bp, Artificial sequence
  synthetic polynucleotide sequence
cacggaggtgctggagga

SEQ ID NO: 15770 - DNA, 18 bp, Artificial sequence
  synthetic polynucleotide sequence
catgttggggcaggggca

SEQ ID NO: 15771 - DNA, 18 bp, Artificial sequence
  synthetic polynucleotide sequence
ctctgagctgaccgagga

SEQ ID NO: 15772 - DNA, 18 bp, Artificial sequence
  synthetic polynucleotide sequence
cccagtccacgtgaagca

SEQ ID NO: 15773 - DNA, 18 bp, Artificial sequence
  synthetic polynucleotide sequence
gccagcagcttaaggcga

SEQ ID NO: 15774 - DNA, 18 bp, Artificial sequence
  synthetic polynucleotide sequence
catcgacaacagcgccga

SEQ ID NO: 15775 - DNA, 18 bp, Artificial sequence
  synthetic polynucleotide sequence
acaggggccaccagggca

SEQ ID NO: 15776 - DNA, 18 bp, Artificial sequence
  synthetic polynucleotide sequence
ccacgaagcaggaaggga

SEQ ID NO: 15777 - DNA, 18 bp, Artificial sequence
  synthetic polynucleotide sequence
tcgcactgatgccacgga

SEQ ID NO: 15778 - DNA, 18 bp, Artificial sequence
  synthetic polynucleotide sequence
gtgcggccaaagtcggca

SEQ ID NO: 15779 - DNA, 18 bp, Artificial sequence
  synthetic polynucleotide sequence
cccatcaggacactcgca

SEQ ID NO: 15780 - DNA, 18 bp, Artificial sequence
  synthetic polynucleotide sequence
cccatcaggacactcgca

SEQ ID NO: 15781 - DNA, 18 bp, Artificial sequence
  synthetic polynucleotide sequence
gtcccaggagtggaccca

SEQ ID NO: 15782 - DNA, 18 bp, Artificial sequence
  synthetic polynucleotide sequence
ggagagtcttggaagcca

SEQ ID NO: 15783 - DNA, 18 bp, Artificial sequence
  synthetic polynucleotide sequence
caccctggtcgagaggga

SEQ ID NO: 15784 - DNA, 18 bp, Artificial sequence
  synthetic polynucleotide sequence
ggtccattggggacccca

SEQ ID NO: 15785 - DNA, 18 bp, Artificial sequence
  synthetic polynucleotide sequence
ctacccaggtgtcagaca

SEQ ID NO: 15786 - DNA, 18 bp, Artificial sequence
  synthetic polynucleotide sequence
caactagcagccgtggca

SEQ ID NO: 15787 - DNA, 18 bp, Artificial sequence
  synthetic polynucleotide sequence
gcgggctgcatcagcaca

SEQ ID NO: 15788 - DNA, 18 bp, Artificial sequence
  synthetic polynucleotide sequence
ccataggacctggcggga

SEQ ID NO: 15789 - DNA, 18 bp, Artificial sequence
  synthetic polynucleotide sequence
tgggtgtgcggccaagga

SEQ ID NO: 15790 - DNA, 18 bp, Artificial sequence
  synthetic polynucleotide sequence
agggaagagacaaggcca

SEQ ID NO: 15791 - DNA, 18 bp, Artificial sequence
  synthetic polynucleotide sequence
ggttgaactcgcacccaa

SEQ ID NO: 15792 - DNA, 18 bp, Artificial sequence
  synthetic polynucleotide sequence
agtgagcctggtgagaga

SEQ ID NO: 15793 - DNA, 18 bp, Artificial sequence
  synthetic polynucleotide sequence
gtctcgatgggcgagcca

SEQ ID NO: 15794 - DNA, 18 bp, Artificial sequence
  synthetic polynucleotide sequence
cagcagaggtcaaggcca

SEQ ID NO: 15795 - DNA, 18 bp, Artificial sequence
  synthetic polynucleotide sequence
tcatggcagcgcaggcca

SEQ ID NO: 15796 - DNA, 18 bp, Artificial sequence
  synthetic polynucleotide sequence
agtccagcctgccagcta

SEQ ID NO: 15797 - DNA, 18 bp, Artificial sequence
  synthetic polynucleotide sequence
ggcatggaagacgcagga

SEQ ID NO: 15798 - DNA, 18 bp, Artificial sequence
  synthetic polynucleotide sequence
ggcatggaagacgcagga

SEQ ID NO: 15799 - DNA, 18 bp, Artificial sequence
  synthetic polynucleotide sequence
ggctggagttgaggagga

SEQ ID NO: 15800 - DNA, 18 bp, Artificial sequence
  synthetic polynucleotide sequence
actctgcagctcagccca

SEQ ID NO: 15801 - DNA, 18 bp, Artificial sequence
  synthetic polynucleotide sequence
gcgcgtcctgtacggcaa

SEQ ID NO: 15802 - DNA, 18 bp, Artificial sequence
  synthetic polynucleotide sequence
cgtgcagaagttgggcga

SEQ ID NO: 15803 - DNA, 18 bp, Artificial sequence
  synthetic polynucleotide sequence
gggcctgcaacaagacca

SEQ ID NO: 15804 - DNA, 18 bp, Artificial sequence
  synthetic polynucleotide sequence
gcaccagtggaagcggca

SEQ ID NO: 15805 - DNA, 18 bp, Artificial sequence
  synthetic polynucleotide sequence
cgggacacaagacaggca

SEQ ID NO: 15806 - DNA, 18 bp, Artificial sequence
  synthetic polynucleotide sequence
gcaggtgacgtagcagca

SEQ ID NO: 15807 - DNA, 18 bp, Artificial sequence
  synthetic polynucleotide sequence
ccagggacacaaggcaga

SEQ ID NO: 15808 - DNA, 18 bp, Artificial sequence
  synthetic polynucleotide sequence
tccacgtgcctgaccaca

SEQ ID NO: 15809 - DNA, 18 bp, Artificial sequence
  synthetic polynucleotide sequence
catccgggtgacatggga

SEQ ID NO: 15810 - DNA, 18 bp, Artificial sequence
  synthetic polynucleotide sequence
ggctccctgggtacagca

SEQ ID NO: 15811 - DNA, 18 bp, Artificial sequence
  synthetic polynucleotide sequence
cgtagcagcaccagtgga

SEQ ID NO: 15812 - DNA, 18 bp, Artificial sequence
  synthetic polynucleotide sequence
atgtcacctcccacggca

SEQ ID NO: 15813 - DNA, 18 bp, Artificial sequence
  synthetic polynucleotide sequence
aggcctcgtagtagacca

SEQ ID NO: 15814 - DNA, 18 bp, Artificial sequence
  synthetic polynucleotide sequence
gatggtggtggagaagca

SEQ ID NO: 15815 - DNA, 18 bp, Artificial sequence
  synthetic polynucleotide sequence
ctctcccgcacatccaca

SEQ ID NO: 15816 - DNA, 18 bp, Artificial sequence
  synthetic polynucleotide sequence
ctctcccgcacatccaca

SEQ ID NO: 15817 - DNA, 18 bp, Artificial sequence
  synthetic polynucleotide sequence
acaagacgtcggagggca

SEQ ID NO: 15818 - DNA, 18 bp, Artificial sequence
  synthetic polynucleotide sequence
gcacttgacgtagcagca

SEQ ID NO: 15819 - DNA, 18 bp, Artificial sequence
  synthetic polynucleotide sequence
acaagacctcggagggca

SEQ ID NO: 15820 - DNA, 18 bp, Artificial sequence
  synthetic polynucleotide sequence
cgaagcagcaccagtgga

SEQ ID NO: 15821 - DNA, 18 bp, Artificial sequence
  synthetic polynucleotide sequence
cgtcatgggcaccaacga

SEQ ID NO: 15822 - DNA, 18 bp, Artificial sequence
  synthetic polynucleotide sequence
gcaccagtggaagcggca

SEQ ID NO: 15823 - DNA, 18 bp, Artificial sequence
  synthetic polynucleotide sequence
acaacgaggcaggccgaa

SEQ ID NO: 15824 - DNA, 18 bp, Artificial sequence
  synthetic polynucleotide sequence
ccttgagcacgtagccca

SEQ ID NO: 15825 - DNA, 18 bp, Artificial sequence
  synthetic polynucleotide sequence
ccgacgtgcgttacggca

SEQ ID NO: 15826 - DNA, 18 bp, Artificial sequence
  synthetic polynucleotide sequence
gggcagcgtggtccagca

SEQ ID NO: 15827 - DNA, 18 bp, Artificial sequence
  synthetic polynucleotide sequence
acagctacgtcgctccca

SEQ ID NO: 15828 - DNA, 18 bp, Artificial sequence
  synthetic polynucleotide sequence
cctagcgcagaggcggaa

SEQ ID NO: 15829 - DNA, 18 bp, Artificial sequence
  synthetic polynucleotide sequence
tgccagcaccctgcagca

SEQ ID NO: 15830 - DNA, 18 bp, Artificial sequence
  synthetic polynucleotide sequence
aggcggtgaagggcacca

SEQ ID NO: 15831 - DNA, 18 bp, Artificial sequence
  synthetic polynucleotide sequence
gggagaagcggccagcca

SEQ ID NO: 15832 - DNA, 18 bp, Artificial sequence
  synthetic polynucleotide sequence
ccatgaggtgggcaagca

SEQ ID NO: 15833 - DNA, 18 bp, Artificial sequence
  synthetic polynucleotide sequence
cgtagcagcaccactgca

SEQ ID NO: 15834 - DNA, 18 bp, Artificial sequence
  synthetic polynucleotide sequence
cgtagcagcaccactgca

SEQ ID NO: 15835 - DNA, 18 bp, Artificial sequence
  synthetic polynucleotide sequence
gtcgagaggtgaccacca

SEQ ID NO: 15836 - DNA, 18 bp, Artificial sequence
  synthetic polynucleotide sequence
ccgtccgtgtcccacaca

SEQ ID NO: 15837 - DNA, 18 bp, Artificial sequence
  synthetic polynucleotide sequence
cggcacaagagcaggaga

SEQ ID NO: 15838 - DNA, 18 bp, Artificial sequence
  synthetic polynucleotide sequence
agaggggccaacatggca

SEQ ID NO: 15839 - DNA, 18 bp, Artificial sequence
  synthetic polynucleotide sequence
gtcggagccagtaaagca

SEQ ID NO: 15840 - DNA, 18 bp, Artificial sequence
  synthetic polynucleotide sequence
gatcgtacccaccggtca

SEQ ID NO: 15841 - DNA, 18 bp, Artificial sequence
  synthetic polynucleotide sequence
gagcaaagagtggccgga

SEQ ID NO: 15842 - DNA, 18 bp, Artificial sequence
  synthetic polynucleotide sequence
cgttgaggaaggccacca

SEQ ID NO: 15843 - DNA, 18 bp, Artificial sequence
  synthetic polynucleotide sequence
gggcaaagagtggccaga

SEQ ID NO: 15844 - DNA, 18 bp, Artificial sequence
  synthetic polynucleotide sequence
tgacagccacgcccagca

SEQ ID NO: 15845 - DNA, 18 bp, Artificial sequence
  synthetic polynucleotide sequence
tgacaacttggccaccga

SEQ ID NO: 15846 - DNA, 18 bp, Artificial sequence
  synthetic polynucleotide sequence
cgaccacctgaagaccca

SEQ ID NO: 15847 - DNA, 18 bp, Artificial sequence
  synthetic polynucleotide sequence
gaattcgggtcgcaccca

SEQ ID NO: 15848 - DNA, 18 bp, Artificial sequence
  synthetic polynucleotide sequence
gaggcttccgtgcagaga

SEQ ID NO: 15849 - DNA, 18 bp, Artificial sequence
  synthetic polynucleotide sequence
aagcgcctcctcaagtca

SEQ ID NO: 15850 - DNA, 18 bp, Artificial sequence
  synthetic polynucleotide sequence
aatgtgtcccggcagaca

SEQ ID NO: 15851 - DNA, 18 bp, Artificial sequence
  synthetic polynucleotide sequence
ggacactgtagcacccta

SEQ ID NO: 15852 - DNA, 18 bp, Artificial sequence
  synthetic polynucleotide sequence
ggacactgtagcacccta

SEQ ID NO: 15853 - DNA, 18 bp, Artificial sequence
  synthetic polynucleotide sequence
agcccaagcccaggacca

SEQ ID NO: 15854 - DNA, 18 bp, Artificial sequence
  synthetic polynucleotide sequence
ttaggatcggcaggggaa

SEQ ID NO: 15855 - DNA, 18 bp, Artificial sequence
  synthetic polynucleotide sequence
acacctgggcagcagaca

SEQ ID NO: 15856 - DNA, 18 bp, Artificial sequence
  synthetic polynucleotide sequence
ccttgacgccggaaccca

SEQ ID NO: 15857 - DNA, 18 bp, Artificial sequence
  synthetic polynucleotide sequence
tcctacacctgggcagca

SEQ ID NO: 15858 - DNA, 18 bp, Artificial sequence
  synthetic polynucleotide sequence
cttgacgccggaacccaa

SEQ ID NO: 15859 - DNA, 18 bp, Artificial sequence
  synthetic polynucleotide sequence
cctggaggagctcccaga

SEQ ID NO: 15860 - DNA, 18 bp, Artificial sequence
  synthetic polynucleotide sequence
atgacgtccccactgaca

SEQ ID NO: 15861 - DNA, 17 bp, Artificial sequence
  synthetic polynucleotide sequence
gtgagcctcactaccca

SEQ ID NO: 15862 - DNA, 18 bp, Artificial sequence
  synthetic polynucleotide sequence
gaccacgtctctcaccca

SEQ ID NO: 15863 - DNA, 18 bp, Artificial sequence
  synthetic polynucleotide sequence
tgcggaacttgaccccca

SEQ ID NO: 15864 - DNA, 18 bp, Artificial sequence
  synthetic polynucleotide sequence
ccggagctgcgaggccaa

SEQ ID NO: 15865 - DNA, 18 bp, Artificial sequence
  synthetic polynucleotide sequence
ctctgcaggcatcccaca

SEQ ID NO: 15866 - DNA, 18 bp, Artificial sequence
  synthetic polynucleotide sequence
ggcggctgtgcaaaacca

SEQ ID NO: 15867 - DNA, 18 bp, Artificial sequence
  synthetic polynucleotide sequence
ggatcacttccaccccca

SEQ ID NO: 15868 - DNA, 18 bp, Artificial sequence
  synthetic polynucleotide sequence
ggcaacagctgaagccca

SEQ ID NO: 15869 - DNA, 18 bp, Artificial sequence
  synthetic polynucleotide sequence
gcacctccactctgggaa

SEQ ID NO: 15870 - DNA, 18 bp, Artificial sequence
  synthetic polynucleotide sequence
gcacctccactctgggaa

SEQ ID NO: 15871 - DNA, 18 bp, Artificial sequence
  synthetic polynucleotide sequence
ccctgacctcatcagcaa

SEQ ID NO: 15872 - DNA, 18 bp, Artificial sequence
  synthetic polynucleotide sequence
caatgagcagctgcagga

SEQ ID NO: 15873 - DNA, 18 bp, Artificial sequence
  synthetic polynucleotide sequence
gccgagaccttgagacca

SEQ ID NO: 15874 - DNA, 18 bp, Artificial sequence
  synthetic polynucleotide sequence
agatgccgcttcagggca

SEQ ID NO: 15875 - DNA, 18 bp, Artificial sequence
  synthetic polynucleotide sequence
cttgcacgggactggaca

SEQ ID NO: 15876 - DNA, 18 bp, Artificial sequence
  synthetic polynucleotide sequence
ccgggctcatcagtgaca

SEQ ID NO: 15877 - DNA, 18 bp, Artificial sequence
  synthetic polynucleotide sequence
gcgccagctactagagga

SEQ ID NO: 15878 - DNA, 18 bp, Artificial sequence
  synthetic polynucleotide sequence
ggatggcaagggtggaga

SEQ ID NO: 15879 - DNA, 18 bp, Artificial sequence
  synthetic polynucleotide sequence
gcacaagaagaagctgca

SEQ ID NO: 15880 - DNA, 18 bp, Artificial sequence
  synthetic polynucleotide sequence
taggtgagggaaggccga

SEQ ID NO: 15881 - DNA, 18 bp, Artificial sequence
  synthetic polynucleotide sequence
cgacagacaagctcacca

SEQ ID NO: 15882 - DNA, 18 bp, Artificial sequence
  synthetic polynucleotide sequence
agctgctacagagcgcca

SEQ ID NO: 15883 - DNA, 18 bp, Artificial sequence
  synthetic polynucleotide sequence
gcagatggaatgaacgga

SEQ ID NO: 15884 - DNA, 18 bp, Artificial sequence
  synthetic polynucleotide sequence
gcaagcctctctagcaga

SEQ ID NO: 15885 - DNA, 18 bp, Artificial sequence
  synthetic polynucleotide sequence
gggactggcagatcagga

SEQ ID NO: 15886 - DNA, 18 bp, Artificial sequence
  synthetic polynucleotide sequence
ggtggcagagcagaagga

SEQ ID NO: 15887 - DNA, 18 bp, Artificial sequence
  synthetic polynucleotide sequence
aagctgacaggctatcca

SEQ ID NO: 15888 - DNA, 18 bp, Artificial sequence
  synthetic polynucleotide sequence
aagctgacaggctatcca

SEQ ID NO: 15889 - DNA, 18 bp, Artificial sequence
  synthetic polynucleotide sequence
atggaggagcagggcgca

SEQ ID NO: 15890 - DNA, 18 bp, Artificial sequence
  synthetic polynucleotide sequence
gggcagagagcacccgca

SEQ ID NO: 15891 - DNA, 18 bp, Artificial sequence
  synthetic polynucleotide sequence
gcaagagatgatgaggca

SEQ ID NO: 15892 - DNA, 18 bp, Artificial sequence
  synthetic polynucleotide sequence
gccacgccgacttgagga

SEQ ID NO: 15893 - DNA, 18 bp, Artificial sequence
  synthetic polynucleotide sequence
gcagcagcacttcaggaa

SEQ ID NO: 15894 - DNA, 18 bp, Artificial sequence
  synthetic polynucleotide sequence
catccaccaaggagccca

SEQ ID NO: 15895 - DNA, 18 bp, Artificial sequence
  synthetic polynucleotide sequence
tcagactagccagccaga

SEQ ID NO: 15896 - DNA, 18 bp, Artificial sequence
  synthetic polynucleotide sequence
aggttgagcaatcggaga

SEQ ID NO: 15897 - DNA, 18 bp, Artificial sequence
  synthetic polynucleotide sequence
tcgcagccacctacgaca

SEQ ID NO: 15898 - DNA, 18 bp, Artificial sequence
  synthetic polynucleotide sequence
gagaaggtcagaggcgca

SEQ ID NO: 15899 - DNA, 18 bp, Artificial sequence
  synthetic polynucleotide sequence
agacttgctgcagccgga

SEQ ID NO: 15900 - DNA, 18 bp, Artificial sequence
  synthetic polynucleotide sequence
caacctgcgggtcaccaa

SEQ ID NO: 15901 - DNA, 18 bp, Artificial sequence
  synthetic polynucleotide sequence
actggctacgcagggcta

SEQ ID NO: 15902 - DNA, 18 bp, Artificial sequence
  synthetic polynucleotide sequence
gctgcggctgaaacagca

SEQ ID NO: 15903 - DNA, 18 bp, Artificial sequence
  synthetic polynucleotide sequence
ggagcggacgaattctca

SEQ ID NO: 15904 - DNA, 18 bp, Artificial sequence
  synthetic polynucleotide sequence
taccgacgcagacgccca

SEQ ID NO: 15905 - DNA, 18 bp, Artificial sequence
  synthetic polynucleotide sequence
cgggaaccatcagcggga

SEQ ID NO: 15906 - DNA, 18 bp, Artificial sequence
  synthetic polynucleotide sequence
cgggaaccatcagcggga

SEQ ID NO: 15907 - DNA, 18 bp, Artificial sequence
  synthetic polynucleotide sequence
tgccccagcagttggaga

SEQ ID NO: 15908 - DNA, 18 bp, Artificial sequence
  synthetic polynucleotide sequence
tagggacgccggtatcca

SEQ ID NO: 15909 - DNA, 21 bp, Artificial sequence
  synthetic polynucleotide sequence
cttgaagaagatgaccaagca

SEQ ID NO: 15910 - DNA, 21 bp, Artificial sequence
  synthetic polynucleotide sequence
cctctaagaaacatcacagca

SEQ ID NO: 15911 - DNA, 19 bp, Artificial sequence
  synthetic polynucleotide sequence
cacagcaagacaaggtgca

SEQ ID NO: 15912 - DNA, 18 bp, Artificial sequence
  synthetic polynucleotide sequence
agccctgagggcacggca

SEQ ID NO: 15913 - DNA, 18 bp, Artificial sequence
  synthetic polynucleotide sequence
gaaaaggttctccccgga

SEQ ID NO: 15914 - DNA, 18 bp, Artificial sequence
  synthetic polynucleotide sequence
acagcagccccgtgagca

SEQ ID NO: 15915 - DNA, 18 bp, Artificial sequence
  synthetic polynucleotide sequence
cggggacagcatcgccca

SEQ ID NO: 15916 - DNA, 18 bp, Artificial sequence
  synthetic polynucleotide sequence
cccggatgcgagatctca

SEQ ID NO: 15917 - DNA, 18 bp, Artificial sequence
  synthetic polynucleotide sequence
gcaatgaccacacctgca

SEQ ID NO: 15918 - DNA, 18 bp, Artificial sequence
  synthetic polynucleotide sequence
agatccagcgttcaggaa

SEQ ID NO: 15919 - DNA, 18 bp, Artificial sequence
  synthetic polynucleotide sequence
ccgcatgcagcccggtga

SEQ ID NO: 15920 - DNA, 18 bp, Artificial sequence
  synthetic polynucleotide sequence
cctggccaatcatgacga

SEQ ID NO: 15921 - DNA, 18 bp, Artificial sequence
  synthetic polynucleotide sequence
ctagagcacgttccagga

SEQ ID NO: 15922 - DNA, 18 bp, Artificial sequence
  synthetic polynucleotide sequence
ccgccacatggttcgaga

SEQ ID NO: 15923 - DNA, 18 bp, Artificial sequence
  synthetic polynucleotide sequence
acagttgagccaaggcga

SEQ ID NO: 15924 - DNA, 18 bp, Artificial sequence
  synthetic polynucleotide sequence
acagttgagccaaggcga

SEQ ID NO: 15925 - DNA, 18 bp, Artificial sequence
  synthetic polynucleotide sequence
ggacgtgatggacaggaa

SEQ ID NO: 15926 - DNA, 18 bp, Artificial sequence
  synthetic polynucleotide sequence
ggtcgacgccttcccaca

SEQ ID NO: 15927 - DNA, 18 bp, Artificial sequence
  synthetic polynucleotide sequence
tgtcaacggcagtggaca

SEQ ID NO: 15928 - DNA, 18 bp, Artificial sequence
  synthetic polynucleotide sequence
tgggaccacacacctgca

SEQ ID NO: 15929 - DNA, 18 bp, Artificial sequence
  synthetic polynucleotide sequence
agcctggcaaaaacggca

SEQ ID NO: 15930 - DNA, 18 bp, Artificial sequence
  synthetic polynucleotide sequence
ccgatgtccacagagtga

SEQ ID NO: 15931 - DNA, 18 bp, Artificial sequence
  synthetic polynucleotide sequence
gctgcggagaacagccta

SEQ ID NO: 15932 - DNA, 18 bp, Artificial sequence
  synthetic polynucleotide sequence
aacctgcaggcacggtca

SEQ ID NO: 15933 - DNA, 18 bp, Artificial sequence
  synthetic polynucleotide sequence
cgagaaggcctacagcga

SEQ ID NO: 15934 - DNA, 18 bp, Artificial sequence
  synthetic polynucleotide sequence
agttaagagccaggccta

SEQ ID NO: 15935 - DNA, 18 bp, Artificial sequence
  synthetic polynucleotide sequence
cgctcgtccagagggtga

SEQ ID NO: 15936 - DNA, 18 bp, Artificial sequence
  synthetic polynucleotide sequence
gctggacacactaaacga

SEQ ID NO: 15937 - DNA, 18 bp, Artificial sequence
  synthetic polynucleotide sequence
cttcagcaaggtaccgga

SEQ ID NO: 15938 - DNA, 18 bp, Artificial sequence
  synthetic polynucleotide sequence
tcgagcagaagaccgaca

SEQ ID NO: 15939 - DNA, 18 bp, Artificial sequence
  synthetic polynucleotide sequence
gtcagcagtctcaggcca

SEQ ID NO: 15940 - DNA, 18 bp, Artificial sequence
  synthetic polynucleotide sequence
aggggaacagcgagagca

SEQ ID NO: 15941 - DNA, 18 bp, Artificial sequence
  synthetic polynucleotide sequence
gtctggtgacaggcagca

SEQ ID NO: 15942 - DNA, 18 bp, Artificial sequence
  synthetic polynucleotide sequence
gtctggtgacaggcagca

SEQ ID NO: 15943 - DNA, 18 bp, Artificial sequence
  synthetic polynucleotide sequence
cttcatcgagcagggcaa

SEQ ID NO: 15944 - DNA, 17 bp, Artificial sequence
  synthetic polynucleotide sequence
ctgctccacggtcagga

SEQ ID NO: 15945 - DNA, 18 bp, Artificial sequence
  synthetic polynucleotide sequence
cccggagctgggcaagga

SEQ ID NO: 15946 - DNA, 18 bp, Artificial sequence
  synthetic polynucleotide sequence
ccctgtacacaccacaca

SEQ ID NO: 15947 - DNA, 18 bp, Artificial sequence
  synthetic polynucleotide sequence
ccaccatcggcaacagca

SEQ ID NO: 15948 - DNA, 18 bp, Artificial sequence
  synthetic polynucleotide sequence
gtgtctgcgggacgacga

SEQ ID NO: 15949 - DNA, 19 bp, Artificial sequence
  synthetic polynucleotide sequence
gggccagatggtgatagga

SEQ ID NO: 15950 - DNA, 18 bp, Artificial sequence
  synthetic polynucleotide sequence
ggaccaggcatcaaacca

SEQ ID NO: 15951 - DNA, 18 bp, Artificial sequence
  synthetic polynucleotide sequence
gcatcagctggagacgca

SEQ ID NO: 15952 - DNA, 18 bp, Artificial sequence
  synthetic polynucleotide sequence
ggtgcactggtagggcga

SEQ ID NO: 15953 - DNA, 18 bp, Artificial sequence
  synthetic polynucleotide sequence
cggttgaagccacgccca

SEQ ID NO: 15954 - DNA, 18 bp, Artificial sequence
  synthetic polynucleotide sequence
gtgcagcgtgtgcagcaa

SEQ ID NO: 15955 - DNA, 19 bp, Artificial sequence
  synthetic polynucleotide sequence
ctcgaggaggagtagagga

SEQ ID NO: 15956 - DNA, 19 bp, Artificial sequence
  synthetic polynucleotide sequence
gatggagacgcactaccga

SEQ ID NO: 15957 - DNA, 19 bp, Artificial sequence
  synthetic polynucleotide sequence
gctacaggcagctagcaca

SEQ ID NO: 15958 - DNA, 18 bp, Artificial sequence
  synthetic polynucleotide sequence
cattcccggaccacagca

SEQ ID NO: 15959 - DNA, 18 bp, Artificial sequence
  synthetic polynucleotide sequence
tgggatgaggaagggcca

SEQ ID NO: 15960 - DNA, 18 bp, Artificial sequence
  synthetic polynucleotide sequence
tgggatgaggaagggcca

SEQ ID NO: 15961 - DNA, 18 bp, Artificial sequence
  synthetic polynucleotide sequence
gagccccaagcaaggaca

SEQ ID NO: 15962 - DNA, 18 bp, Artificial sequence
  synthetic polynucleotide sequence
cctgggagacgtacggga

SEQ ID NO: 15963 - DNA, 18 bp, Artificial sequence
  synthetic polynucleotide sequence
cctgcaaagccttcccca

SEQ ID NO: 15964 - DNA, 18 bp, Artificial sequence
  synthetic polynucleotide sequence
agcagggaagtaacggca

SEQ ID NO: 15965 - DNA, 18 bp, Artificial sequence
  synthetic polynucleotide sequence
gcctcctacatcccagga

SEQ ID NO: 15966 - DNA, 18 bp, Artificial sequence
  synthetic polynucleotide sequence
gactgatagctccaggga

SEQ ID NO: 15967 - DNA, 18 bp, Artificial sequence
  synthetic polynucleotide sequence
caagtgaggattcagcca

SEQ ID NO: 15968 - DNA, 18 bp, Artificial sequence
  synthetic polynucleotide sequence
cctggccaacttggccaa

SEQ ID NO: 15969 - DNA, 18 bp, Artificial sequence
  synthetic polynucleotide sequence
ggcagaccttcagaagga

SEQ ID NO: 15970 - DNA, 18 bp, Artificial sequence
  synthetic polynucleotide sequence
cactatcaccgggcacca

SEQ ID NO: 15971 - DNA, 18 bp, Artificial sequence
  synthetic polynucleotide sequence
actgcagggctgaccgta

SEQ ID NO: 15972 - DNA, 18 bp, Artificial sequence
  synthetic polynucleotide sequence
caccaagtgccaacccca

SEQ ID NO: 15973 - DNA, 18 bp, Artificial sequence
  synthetic polynucleotide sequence
tgaggaaggcccacagca

SEQ ID NO: 15974 - DNA, 18 bp, Artificial sequence
  synthetic polynucleotide sequence
gtccccaacaaagccgga

SEQ ID NO: 15975 - DNA, 18 bp, Artificial sequence
  synthetic polynucleotide sequence
caaccccaagctcgcaga

SEQ ID NO: 15976 - DNA, 18 bp, Artificial sequence
  synthetic polynucleotide sequence
gccacagcaccagaacca

SEQ ID NO: 15977 - DNA, 18 bp, Artificial sequence
  synthetic polynucleotide sequence
acgcgtttgggcagacca

SEQ ID NO: 15978 - DNA, 18 bp, Artificial sequence
  synthetic polynucleotide sequence
acgcgtttgggcagacca

SEQ ID NO: 15979 - DNA, 18 bp, Artificial sequence
  synthetic polynucleotide sequence
ggcttcagtcagagagca

SEQ ID NO: 15980 - DNA, 18 bp, Artificial sequence
  synthetic polynucleotide sequence
tcaaggcgcgaactctga

SEQ ID NO: 15981 - DNA, 18 bp, Artificial sequence
  synthetic polynucleotide sequence
cgaagagaccccacccca

SEQ ID NO: 15982 - DNA, 18 bp, Artificial sequence
  synthetic polynucleotide sequence
tcccagggactgtacaga

SEQ ID NO: 15983 - DNA, 18 bp, Artificial sequence
  synthetic polynucleotide sequence
cctgcccgatggcaccaa

SEQ ID NO: 15984 - DNA, 18 bp, Artificial sequence
  synthetic polynucleotide sequence
catgtgaggggactcgga

SEQ ID NO: 15985 - DNA, 18 bp, Artificial sequence
  synthetic polynucleotide sequence
gaccgcgacagctaccta

SEQ ID NO: 15986 - DNA, 18 bp, Artificial sequence
  synthetic polynucleotide sequence
agatggagaggcggctga

SEQ ID NO: 15987 - DNA, 18 bp, Artificial sequence
  synthetic polynucleotide sequence
ggccaagatcgtgacgca

SEQ ID NO: 15988 - DNA, 18 bp, Artificial sequence
  synthetic polynucleotide sequence
ctgagctgtcccgaggca

SEQ ID NO: 15989 - DNA, 18 bp, Artificial sequence
  synthetic polynucleotide sequence
atgtgcagtaaccgggca

SEQ ID NO: 15990 - DNA, 18 bp, Artificial sequence
  synthetic polynucleotide sequence
gacgaccacgtctcccaa

SEQ ID NO: 15991 - DNA, 18 bp, Artificial sequence
  synthetic polynucleotide sequence
acccctgcagcaggagga

SEQ ID NO: 15992 - DNA, 18 bp, Artificial sequence
  synthetic polynucleotide sequence
gcttaccccagagcagca

SEQ ID NO: 15993 - DNA, 18 bp, Artificial sequence
  synthetic polynucleotide sequence
tggccactagccacgcca

SEQ ID NO: 15994 - DNA, 18 bp, Artificial sequence
  synthetic polynucleotide sequence
gacggagggtgtgaccca

SEQ ID NO: 15995 - DNA, 18 bp, Artificial sequence
  synthetic polynucleotide sequence
tcacggtgtcggacagca

SEQ ID NO: 15996 - DNA, 18 bp, Artificial sequence
  synthetic polynucleotide sequence
tcacggtgtcggacagca

SEQ ID NO: 15997 - DNA, 18 bp, Artificial sequence
  synthetic polynucleotide sequence
cccagagagcagaggcga

SEQ ID NO: 15998 - DNA, 18 bp, Artificial sequence
  synthetic polynucleotide sequence
ggtcgtgtgacacagcca

SEQ ID NO: 15999 - DNA, 18 bp, Artificial sequence
  synthetic polynucleotide sequence
ggtcatgtacaccagcaa

SEQ ID NO: 16000 - DNA, 18 bp, Artificial sequence
  synthetic polynucleotide sequence
gctggggtaggcagagga

SEQ ID NO: 16001 - DNA, 18 bp, Artificial sequence
  synthetic polynucleotide sequence
ggcggaagcttcgagaca

SEQ ID NO: 16002 - DNA, 18 bp, Artificial sequence
  synthetic polynucleotide sequence
ctcctggggagtaggcca

SEQ ID NO: 16003 - DNA, 18 bp, Artificial sequence
  synthetic polynucleotide sequence
gccagctctggctacgaa

SEQ ID NO: 16004 - DNA, 18 bp, Artificial sequence
  synthetic polynucleotide sequence
gtggactgcggaggagga

SEQ ID NO: 16005 - DNA, 18 bp, Artificial sequence
  synthetic polynucleotide sequence
agtcctacacgcacccga

SEQ ID NO: 16006 - DNA, 18 bp, Artificial sequence
  synthetic polynucleotide sequence
tagcctgaactggcagca

SEQ ID NO: 16007 - DNA, 18 bp, Artificial sequence
  synthetic polynucleotide sequence
ggcagacggtgtagccga

SEQ ID NO: 16008 - DNA, 18 bp, Artificial sequence
  synthetic polynucleotide sequence
agcattcgcacgtgcaca

SEQ ID NO: 16009 - DNA, 18 bp, Artificial sequence
  synthetic polynucleotide sequence
cctcagcgaggtccacca

SEQ ID NO: 16010 - DNA, 18 bp, Artificial sequence
  synthetic polynucleotide sequence
ggggcagaagcagagaca

SEQ ID NO: 16011 - DNA, 18 bp, Artificial sequence
  synthetic polynucleotide sequence
gatagtgagcctgagcca

SEQ ID NO: 16012 - DNA, 18 bp, Artificial sequence
  synthetic polynucleotide sequence
gagcctgcagctactcca

SEQ ID NO: 16013 - DNA, 18 bp, Artificial sequence
  synthetic polynucleotide sequence
gggaaggagatccagcga

SEQ ID NO: 16014 - DNA, 18 bp, Artificial sequence
  synthetic polynucleotide sequence
gggaaggagatccagcga

SEQ ID NO: 16015 - DNA, 18 bp, Artificial sequence
  synthetic polynucleotide sequence
atgacaggttcagcacca

SEQ ID NO: 16016 - DNA, 18 bp, Artificial sequence
  synthetic polynucleotide sequence
acaggaactggcacagga

SEQ ID NO: 16017 - DNA, 18 bp, Artificial sequence
  synthetic polynucleotide sequence
gctgcagacagctgagga

SEQ ID NO: 16018 - DNA, 18 bp, Artificial sequence
  synthetic polynucleotide sequence
acttgacagggcagcgga

SEQ ID NO: 16019 - DNA, 18 bp, Artificial sequence
  synthetic polynucleotide sequence
gccggaggaggtagcaca

SEQ ID NO: 16020 - DNA, 18 bp, Artificial sequence
  synthetic polynucleotide sequence
acatgctgggactgggca

SEQ ID NO: 16021 - DNA, 18 bp, Artificial sequence
  synthetic polynucleotide sequence
gctgctcacgatgccaga

SEQ ID NO: 16022 - DNA, 18 bp, Artificial sequence
  synthetic polynucleotide sequence
ctgggctgccaggacaca

SEQ ID NO: 16023 - DNA, 18 bp, Artificial sequence
  synthetic polynucleotide sequence
ccacgatgcctcagccca

SEQ ID NO: 16024 - DNA, 18 bp, Artificial sequence
  synthetic polynucleotide sequence
gggtgctccgatgcagca

SEQ ID NO: 16025 - DNA, 18 bp, Artificial sequence
  synthetic polynucleotide sequence
ccggaaggccttcccaca

SEQ ID NO: 16026 - DNA, 18 bp, Artificial sequence
  synthetic polynucleotide sequence
gaggacccacacaggaga

SEQ ID NO: 16027 - DNA, 18 bp, Artificial sequence
  synthetic polynucleotide sequence
agtgaagagcttgccaca

SEQ ID NO: 16028 - DNA, 18 bp, Artificial sequence
  synthetic polynucleotide sequence
gcaaggtcttcaggcaca

SEQ ID NO: 16029 - DNA, 18 bp, Artificial sequence
  synthetic polynucleotide sequence
ctggtccaggaggtgaca

SEQ ID NO: 16030 - DNA, 18 bp, Artificial sequence
  synthetic polynucleotide sequence
gagaggaggcagtgacca

SEQ ID NO: 16031 - DNA, 18 bp, Artificial sequence
  synthetic polynucleotide sequence
gataccctactgaggcca

SEQ ID NO: 16032 - DNA, 18 bp, Artificial sequence
  synthetic polynucleotide sequence
gataccctactgaggcca

SEQ ID NO: 16033 - DNA, 18 bp, Artificial sequence
  synthetic polynucleotide sequence
gctccagagagctccaga

SEQ ID NO: 16034 - DNA, 18 bp, Artificial sequence
  synthetic polynucleotide sequence
gtggctccggatcccaca

SEQ ID NO: 16035 - DNA, 18 bp, Artificial sequence
  synthetic polynucleotide sequence
tagtcacccaccagcgca

SEQ ID NO: 16036 - DNA, 18 bp, Artificial sequence
  synthetic polynucleotide sequence
cttgccgcagtcgaggca

SEQ ID NO: 16037 - DNA, 18 bp, Artificial sequence
  synthetic polynucleotide sequence
cccatcggtaatccacca

SEQ ID NO: 16038 - DNA, 18 bp, Artificial sequence
  synthetic polynucleotide sequence
tgaccaccatactgacca

SEQ ID NO: 16039 - DNA, 18 bp, Artificial sequence
  synthetic polynucleotide sequence
gcaccagagactggagca

SEQ ID NO: 16040 - DNA, 18 bp, Artificial sequence
  synthetic polynucleotide sequence
aactagagaggggaggca

SEQ ID NO: 16041 - DNA, 18 bp, Artificial sequence
  synthetic polynucleotide sequence
ggaccctgcccagaggaa

SEQ ID NO: 16042 - DNA, 18 bp, Artificial sequence
  synthetic polynucleotide sequence
gatgccccactgagagca

SEQ ID NO: 16043 - DNA, 18 bp, Artificial sequence
  synthetic polynucleotide sequence
cttaccacactccccaca

SEQ ID NO: 16044 - DNA, 18 bp, Artificial sequence
  synthetic polynucleotide sequence
gagagtccacagtggaga

SEQ ID NO: 16045 - DNA, 18 bp, Artificial sequence
  synthetic polynucleotide sequence
ccacattcactgcagcca

SEQ ID NO: 16046 - DNA, 18 bp, Artificial sequence
  synthetic polynucleotide sequence
aagagccttcagtgccaa

SEQ ID NO: 16047 - DNA, 18 bp, Artificial sequence
  synthetic polynucleotide sequence
gaacttgggcctgcacca

SEQ ID NO: 16048 - DNA, 18 bp, Artificial sequence
  synthetic polynucleotide sequence
ccctagggtaccaacaca

SEQ ID NO: 16049 - DNA, 18 bp, Artificial sequence
  synthetic polynucleotide sequence
acaaggcacagatggaga

SEQ ID NO: 16050 - DNA, 18 bp, Artificial sequence
  synthetic polynucleotide sequence
acaaggcacagatggaga

SEQ ID NO: 16051 - DNA, 18 bp, Artificial sequence
  synthetic polynucleotide sequence
cgttgcccaaaatgcaga

SEQ ID NO: 16052 - DNA, 18 bp, Artificial sequence
  synthetic polynucleotide sequence
agaagtgcctggagcgca

SEQ ID NO: 16053 - DNA, 19 bp, Artificial sequence
  synthetic polynucleotide sequence
agggagtacacacagggaa

SEQ ID NO: 16054 - DNA, 19 bp, Artificial sequence
  synthetic polynucleotide sequence
agtggacttgaagaacgga

SEQ ID NO: 16055 - DNA, 18 bp, Artificial sequence
  synthetic polynucleotide sequence
cacggccagatcccagga

SEQ ID NO: 16056 - DNA, 20 bp, Artificial sequence
  synthetic polynucleotide sequence
ggtttggaaactggaagcca

SEQ ID NO: 16057 - DNA, 18 bp, Artificial sequence
  synthetic polynucleotide sequence
aacccaccgaaaggagca

SEQ ID NO: 16058 - DNA, 18 bp, Artificial sequence
  synthetic polynucleotide sequence
gggcttcaggaggcagca

SEQ ID NO: 16059 - DNA, 18 bp, Artificial sequence
  synthetic polynucleotide sequence
tggtgcaccacaagcgca

SEQ ID NO: 16060 - DNA, 18 bp, Artificial sequence
  synthetic polynucleotide sequence
ctgcagcagctccgacga

SEQ ID NO: 16061 - DNA, 18 bp, Artificial sequence
  synthetic polynucleotide sequence
caggtgcgagttgcggca

SEQ ID NO: 16062 - DNA, 18 bp, Artificial sequence
  synthetic polynucleotide sequence
ctccaacctcagccagca

SEQ ID NO: 16063 - DNA, 18 bp, Artificial sequence
  synthetic polynucleotide sequence
agctcatcaccacgccga

SEQ ID NO: 16064 - DNA, 18 bp, Artificial sequence
  synthetic polynucleotide sequence
ggggagaagccctacgaa

SEQ ID NO: 16065 - DNA, 18 bp, Artificial sequence
  synthetic polynucleotide sequence
ggctcagatccctgggga

SEQ ID NO: 16066 - DNA, 18 bp, Artificial sequence
  synthetic polynucleotide sequence
ccagctcttgggaccaga

SEQ ID NO: 16067 - DNA, 18 bp, Artificial sequence
  synthetic polynucleotide sequence
gggcagtccaggacccga

SEQ ID NO: 16068 - DNA, 18 bp, Artificial sequence
  synthetic polynucleotide sequence
gggcagtccaggacccga

SEQ ID NO: 16069 - DNA, 18 bp, Artificial sequence
  synthetic polynucleotide sequence
cttcagcagcacacccga

SEQ ID NO: 16070 - DNA, 18 bp, Artificial sequence
  synthetic polynucleotide sequence
gggactgcagattggaga

SEQ ID NO: 16071 - DNA, 18 bp, Artificial sequence
  synthetic polynucleotide sequence
tcagcatcagcgaactca

SEQ ID NO: 16072 - DNA, 18 bp, Artificial sequence
  synthetic polynucleotide sequence
gcgatgagatccaactga

SEQ ID NO: 16073 - DNA, 18 bp, Artificial sequence
  synthetic polynucleotide sequence
cttcagcgagccccagca

SEQ ID NO: 16074 - DNA, 18 bp, Artificial sequence
  synthetic polynucleotide sequence
gccatacaccttgcggca

SEQ ID NO: 16075 - DNA, 18 bp, Artificial sequence
  synthetic polynucleotide sequence
caaggacggtgtcaccca

SEQ ID NO: 16076 - DNA, 18 bp, Artificial sequence
  synthetic polynucleotide sequence
gcaccatggcctggacca

SEQ ID NO: 16077 - DNA, 18 bp, Artificial sequence
  synthetic polynucleotide sequence
cacagtccctggaaggca

SEQ ID NO: 16078 - DNA, 18 bp, Artificial sequence
  synthetic polynucleotide sequence
ggtgcgtgcggaagcgca

SEQ ID NO: 16079 - DNA, 18 bp, Artificial sequence
  synthetic polynucleotide sequence
aacaacccagagaggcca

SEQ ID NO: 16080 - DNA, 18 bp, Artificial sequence
  synthetic polynucleotide sequence
tacagaccatgaggagca

SEQ ID NO: 16081 - DNA, 18 bp, Artificial sequence
  synthetic polynucleotide sequence
ctgagggcactgtgagca

SEQ ID NO: 16082 - DNA, 18 bp, Artificial sequence
  synthetic polynucleotide sequence
agcacagcttcgagggca

SEQ ID NO: 16083 - DNA, 18 bp, Artificial sequence
  synthetic polynucleotide sequence
ctgcgaacagaactggga

SEQ ID NO: 16084 - DNA, 18 bp, Artificial sequence
  synthetic polynucleotide sequence
cacacgggggagaagcca

SEQ ID NO: 16085 - DNA, 19 bp, Artificial sequence
  synthetic polynucleotide sequence
gcagaaggcaagtgagcca

SEQ ID NO: 16086 - DNA, 19 bp, Artificial sequence
  synthetic polynucleotide sequence
gcagaaggcaagtgagcca

SEQ ID NO: 16087 - DNA, 18 bp, Artificial sequence
  synthetic polynucleotide sequence
ggagagaaacctcaccga

SEQ ID NO: 16088 - DNA, 18 bp, Artificial sequence
  synthetic polynucleotide sequence
ataagatgtgaccgccga

SEQ ID NO: 16089 - DNA, 18 bp, Artificial sequence
  synthetic polynucleotide sequence
gtggctggagcataccca

SEQ ID NO: 16090 - DNA, 18 bp, Artificial sequence
  synthetic polynucleotide sequence
ctcctggcacacagggca

SEQ ID NO: 16091 - DNA, 18 bp, Artificial sequence
  synthetic polynucleotide sequence
tcctgcagcaccagcgca

SEQ ID NO: 16092 - DNA, 18 bp, Artificial sequence
  synthetic polynucleotide sequence
cttgccgcagtcggcgca

SEQ ID NO: 16093 - DNA, 18 bp, Artificial sequence
  synthetic polynucleotide sequence
catcctggagtggcacga

SEQ ID NO: 16094 - DNA, 18 bp, Artificial sequence
  synthetic polynucleotide sequence
gcagccttctaccaagca

SEQ ID NO: 16095 - DNA, 18 bp, Artificial sequence
  synthetic polynucleotide sequence
cagtcaccagcaaccgga

SEQ ID NO: 16096 - DNA, 18 bp, Artificial sequence
  synthetic polynucleotide sequence
agtcgtactggacacgga

SEQ ID NO: 16097 - DNA, 18 bp, Artificial sequence
  synthetic polynucleotide sequence
gggatcaggatggggaca

SEQ ID NO: 16098 - DNA, 18 bp, Artificial sequence
  synthetic polynucleotide sequence
ggagactctgggagagca

SEQ ID NO: 16099 - DNA, 18 bp, Artificial sequence
  synthetic polynucleotide sequence
gggtgaactccacagcca

SEQ ID NO: 16100 - DNA, 18 bp, Artificial sequence
  synthetic polynucleotide sequence
ttcagcactgcagcagga

SEQ ID NO: 16101 - DNA, 18 bp, Artificial sequence
  synthetic polynucleotide sequence
gcaagggatgcaattcga

SEQ ID NO: 16102 - DNA, 18 bp, Artificial sequence
  synthetic polynucleotide sequence
gccagaagcaaagcctca

SEQ ID NO: 16103 - DNA, 18 bp, Artificial sequence
  synthetic polynucleotide sequence
ttgggcaagggatccaca

SEQ ID NO: 16104 - DNA, 18 bp, Artificial sequence
  synthetic polynucleotide sequence
ttgggcaagggatccaca

SEQ ID NO: 16105 - DNA, 18 bp, Artificial sequence
  synthetic polynucleotide sequence
gtgggaagagattcagca

SEQ ID NO: 16106 - DNA, 18 bp, Artificial sequence
  synthetic polynucleotide sequence
cttcccacaatcagggca

SEQ ID NO: 16107 - DNA, 18 bp, Artificial sequence
  synthetic polynucleotide sequence
gcaagagcggatcccaca

SEQ ID NO: 16108 - DNA, 18 bp, Artificial sequence
  synthetic polynucleotide sequence
aagggagaccgaatggga

SEQ ID NO: 16109 - DNA, 18 bp, Artificial sequence
  synthetic polynucleotide sequence
tgcgggagcatgaggaga

SEQ ID NO: 16110 - DNA, 18 bp, Artificial sequence
  synthetic polynucleotide sequence
ggtactggctcagcacca

SEQ ID NO: 16111 - DNA, 18 bp, Artificial sequence
  synthetic polynucleotide sequence
gccgagagtgcaaggaga

SEQ ID NO: 16112 - DNA, 18 bp, Artificial sequence
  synthetic polynucleotide sequence
cttgggacaatgggggca

SEQ ID NO: 16113 - DNA, 18 bp, Artificial sequence
  synthetic polynucleotide sequence
gagcctgacagcacgaca

SEQ ID NO: 16114 - DNA, 18 bp, Artificial sequence
  synthetic polynucleotide sequence
caagccacagtcgaggca

SEQ ID NO: 16115 - DNA, 18 bp, Artificial sequence
  synthetic polynucleotide sequence
ccaacttctccacacaca

SEQ ID NO: 16116 - DNA, 18 bp, Artificial sequence
  synthetic polynucleotide sequence
caggctgaacttccagga

SEQ ID NO: 16117 - DNA, 18 bp, Artificial sequence
  synthetic polynucleotide sequence
tcgctgaaggtccgccca

SEQ ID NO: 16118 - DNA, 18 bp, Artificial sequence
  synthetic polynucleotide sequence
tgtgcatcaccggaccca

SEQ ID NO: 16119 - DNA, 18 bp, Artificial sequence
  synthetic polynucleotide sequence
cttgggccaccggaagga

SEQ ID NO: 16120 - DNA, 18 bp, Artificial sequence
  synthetic polynucleotide sequence
gacaccagctggtgcaca

SEQ ID NO: 16121 - DNA, 18 bp, Artificial sequence
  synthetic polynucleotide sequence
gcggcctccgagacgaga

SEQ ID NO: 16122 - DNA, 18 bp, Artificial sequence
  synthetic polynucleotide sequence
gcggcctccgagacgaga

SEQ ID NO: 16123 - DNA, 18 bp, Artificial sequence
  synthetic polynucleotide sequence
tcccaggaggaatggaga

SEQ ID NO: 16124 - DNA, 18 bp, Artificial sequence
  synthetic polynucleotide sequence
gtcacaacttcccaagca

SEQ ID NO: 16125 - DNA, 18 bp, Artificial sequence
  synthetic polynucleotide sequence
gtgcaagctccgtgagca

SEQ ID NO: 16126 - DNA, 18 bp, Artificial sequence
  synthetic polynucleotide sequence
cttgccacactccccgca

SEQ ID NO: 16127 - DNA, 18 bp, Artificial sequence
  synthetic polynucleotide sequence
ggactcacacaggagaga

SEQ ID NO: 16128 - DNA, 18 bp, Artificial sequence
  synthetic polynucleotide sequence
agcaagtgagccaagaga

SEQ ID NO: 16129 - DNA, 18 bp, Artificial sequence
  synthetic polynucleotide sequence
gtcctgggaaccagccaa

SEQ ID NO: 16130 - DNA, 18 bp, Artificial sequence
  synthetic polynucleotide sequence
gacagtagggtgtgggga

SEQ ID NO: 16131 - DNA, 18 bp, Artificial sequence
  synthetic polynucleotide sequence
cctacagctacaagccca

SEQ ID NO: 16132 - DNA, 18 bp, Artificial sequence
  synthetic polynucleotide sequence
tacggttgaggccggaga

SEQ ID NO: 16133 - DNA, 18 bp, Artificial sequence
  synthetic polynucleotide sequence
tcccacattcacagcaca

SEQ ID NO: 16134 - DNA, 18 bp, Artificial sequence
  synthetic polynucleotide sequence
gggagaagtcaaacagca

SEQ ID NO: 16135 - DNA, 18 bp, Artificial sequence
  synthetic polynucleotide sequence
cttcgaagggaaccggca

SEQ ID NO: 16136 - DNA, 18 bp, Artificial sequence
  synthetic polynucleotide sequence
ggactcacactggagaga

SEQ ID NO: 16137 - DNA, 18 bp, Artificial sequence
  synthetic polynucleotide sequence
ccccaatctggcggtcca

SEQ ID NO: 16138 - DNA, 18 bp, Artificial sequence
  synthetic polynucleotide sequence
gcggaagcgttaccggaa

SEQ ID NO: 16139 - DNA, 18 bp, Artificial sequence
  synthetic polynucleotide sequence
ggacagtctgggcccaca

SEQ ID NO: 16140 - DNA, 18 bp, Artificial sequence
  synthetic polynucleotide sequence
ggacagtctgggcccaca

SEQ ID NO: 16141 - DNA, 18 bp, Artificial sequence
  synthetic polynucleotide sequence
agtggcaatgcctggaca

SEQ ID NO: 16142 - DNA, 18 bp, Artificial sequence
  synthetic polynucleotide sequence
ctggcttagaggcagcaa

SEQ ID NO: 16143 - DNA, 18 bp, Artificial sequence
  synthetic polynucleotide sequence
tctgagccctgcaaccga

SEQ ID NO: 16144 - DNA, 18 bp, Artificial sequence
  synthetic polynucleotide sequence
catgtggcagatccggca

SEQ ID NO: 16145 - DNA, 18 bp, Artificial sequence
  synthetic polynucleotide sequence
gggctcaggatacggtca

SEQ ID NO: 16146 - DNA, 18 bp, Artificial sequence
  synthetic polynucleotide sequence
cctccaccgacataggca

SEQ ID NO: 16147 - DNA, 18 bp, Artificial sequence
  synthetic polynucleotide sequence
agaaggcccaggtccgca

SEQ ID NO: 16148 - DNA, 18 bp, Artificial sequence
  synthetic polynucleotide sequence
aggtgtgggagcagggca

SEQ ID NO: 16149 - DNA, 18 bp, Artificial sequence
  synthetic polynucleotide sequence
caagcgatgtacagacca

SEQ ID NO: 16150 - DNA, 18 bp, Artificial sequence
  synthetic polynucleotide sequence
atgatccagggctgcaga

SEQ ID NO: 16151 - DNA, 18 bp, Artificial sequence
  synthetic polynucleotide sequence
tccataggtaaggacgga

SEQ ID NO: 16152 - DNA, 18 bp, Artificial sequence
  synthetic polynucleotide sequence
tccaggcaagagatcgaa

SEQ ID NO: 16153 - DNA, 18 bp, Artificial sequence
  synthetic polynucleotide sequence
ttgaactcgggcaacaca

SEQ ID NO: 16154 - DNA, 18 bp, Artificial sequence
  synthetic polynucleotide sequence
gactatgaccctgacgca

SEQ ID NO: 16155 - DNA, 18 bp, Artificial sequence
  synthetic polynucleotide sequence
cagctgtagcaggaggga

SEQ ID NO: 16156 - DNA, 18 bp, Artificial sequence
  synthetic polynucleotide sequence
ctactccaccctgcgcaa

SEQ ID NO: 16157 - DNA, 18 bp, Artificial sequence
  synthetic polynucleotide sequence
tcactggaagagaacgca

SEQ ID NO: 16158 - DNA, 18 bp, Artificial sequence
  synthetic polynucleotide sequence
tcactggaagagaacgca

SEQ ID NO: 16159 - DNA, 18 bp, Artificial sequence
  synthetic polynucleotide sequence
agttgggaaggcaaggca

SEQ ID NO: 16160 - DNA, 18 bp, Artificial sequence
  synthetic polynucleotide sequence
aagctcagctcctagcca

SEQ ID NO: 16161 - DNA, 18 bp, Artificial sequence
  synthetic polynucleotide sequence
cgagccgacagaaggcaa

SEQ ID NO: 16162 - DNA, 18 bp, Artificial sequence
  synthetic polynucleotide sequence
agggccttggtgaggcca

SEQ ID NO: 16163 - DNA, 18 bp, Artificial sequence
  synthetic polynucleotide sequence
caaggcctatcacccgca

SEQ ID NO: 16164 - DNA, 18 bp, Artificial sequence
  synthetic polynucleotide sequence
gtggtagtcggggacaca

SEQ ID NO: 16165 - DNA, 18 bp, Artificial sequence
  synthetic polynucleotide sequence
gagccagtactcccagca

SEQ ID NO: 16166 - DNA, 18 bp, Artificial sequence
  synthetic polynucleotide sequence
ctttcagggccagggaca

---

What is claimed is:

1. A method of producing a primer extension product composition, the method comprising:

providing:

(a) a target nucleic acid template composition; and (b) a set of 1000 or more different gene specific primer pairs that produce primer extension products for 1000 or more different genes, wherein each pair of gene specific primers is made up of a forward primer and a reverse primer and the forward and reverse primers of each primer pair comprise gene specific domains selected from SEQ ID NOs: 37 to 16166, wherein for each gene the gene specific domain of the forward primer comprises the sequence of SEQ ID NO: X and the gene specific domain of the reverse primer comprises the sequence of SEQ ID NO: (X+1), wherein X is an odd number from 37 to 16165;

wherein the primer extension product composition is produced by a method comprising:

contacting the target nucleic acid template composition with the forward primers of the set of primer pairs under primer extension reaction conditions to produce a forward primer extension product composition;

separating non-extended forward primers from the forward primer extension product by digesting the non-extended forward primers; and contacting the forward primer extension product composition with the reverse primers of the set of primer pairs under primer extension reaction conditions to produce a second extension product composition.

2. The method according claim 1, wherein the gene specific domain of each primer pair ranges in length from 16 to 24 nucleotides.

3. The method according to claim 1, wherein the set of gene specific primer pairs comprises all of the gene specific domains from SEQ ID NOs: 37 to 16166.

4. The method according to claim 1, wherein the method further comprises separating the second primer extension product from non-extended reverse primers.

5. The method according to claim 4, wherein separating the second primer extension product from non-extended reverse primers comprises digesting the non-extended reverse primers.

6. The method according to claim 5, wherein the resultant primer extension product composition is amplified following separating the second primer extension product from non-extended reverse primers.

7. The method according to claim 1, wherein each of the forward and reverse primers comprises an anchor domain comprising a universal priming site and the method further comprises amplifying the resultant primer extension product composition by contacting the primer extension product composition with universal forward and reverse primers having sequences complementary to the universal priming sites under amplification conditions sufficient to produce an initial amplicon composition comprising multiple product amplicons.

8. The method according to claim 7, wherein the method further comprises sequencing the multiple product amplicons.

9. The method according to claim 8, wherein the multiple product amplicons are sequenced using a next generation sequencing (NGS) protocol.

10. The method according to claim 7, wherein the anchor domains comprise a common PCR suppression sequence.

11. The method according to claim 1, wherein the non-extended forward primers are digested with an exonuclease.

12. The method according to claim 1, wherein the set of gene specific primer pairs comprise primers with gene specific domains ranging in length from 15 to 18 nucleotides.

13. A method of producing a primer extension product composition, the method comprising:

providing:

(a) a target nucleic acid template composition; and (b) a set of 1000 or more different gene specific primer pairs that produce primer extension products for 1000 or more different genes, wherein each pair of gene specific primers is made up of a forward primer and a reverse primer and the forward and reverse primers of each primer pair comprise gene specific domains selected from SEQ ID NOs: 37 to 16166 and an anchor domain comprising a universal priming site, wherein for each gene the gene specific domain of the forward primer comprises the sequence of SEQ ID NO: X and the gene specific domain of the reverse primer comprises the sequence of SEQ ID NO: (X+1), wherein X is an odd number from 37 to 16165;

wherein the primer extension product composition is produced by a method comprising:

contacting the target nucleic acid template composition with the forward primers of the set of primer pairs under primer extension reaction conditions to produce a forward primer extension product composition;

separating non-extended forward primers from the forward primer extension product by digesting the non-extended forward primers; and contacting the forward primer extension product composition with the reverse primers of the set of primer pairs under primer extension reaction conditions to produce a second extension product composition;

(c) amplifying the resultant primer extension product composition by contacting the primer extension product composition with universal forward and reverse primers having sequences complementary to the universal priming sites under amplification conditions sufficient to produce an initial amplicon composition comprising multiple product amplicons; and (d) sequencing the multiple product amplicons.

* * * * *